United States Patent 7,365,185 (GENOMIC PLANT SEQUENCES AND USES THEREOF) - sequence listing, part 76

SEQ ID NO: 75870 - DNA, 26427 bp, Oryza sativa
tcgccagccgttgcgtcgtggcctcggcctcctcgagagctcgctcccgctcagcgagtgcatcctcgcgaaagcggagcgcggactcctcctcggcgcaggcggcctcgtgcgccgccagcgtcgtctcccggagagcagtggcggcctcgcggtccgtgaagcccttctccacggtgccggcgtgttcttccagcgccatggcacgggcctcaagggcctcctcgcgccgccgggacgccgcttcggcttccgttgcccgccgctctcgggcagcagcggagtcaagaaccccttgggcggcgtcgagcttgttcttcagctccgcctcccagctcccgtgttgaaggcggagggagtcctgcgcctcaatcatcgcggtggtggcgacaagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaagatgcgctgggctcggggatgtcccccgggcccgtttgatcatgggcgtcgcccggtgaggtaggcccaggcgatgcgcccgcggcctcgtcgcgagccgcctcggaggatgtcgcctgagggccgcccgagggagtaggcccaagtgacgcgccagcagcagctgtcgcctcagcctggcgagcccgggtggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggctgctggatcttcggcctcggactggccggacttggggtggcgggaggaatgcgacgggacatcgctgaagcagaagaaaaagccagaagacgaacaaagtgagcaagaaaaaacttctttttggagaaagatggttgcaatgagagtgagacgaacctgcgagggggtcggttgaatgaccaccttggaggggaaatcaggtttccccggcatggttccgtctcccccgtcttacggagccgcttcttcttgcgcaccccctcgggctgcgatgtcggcgcggccccctccgggcgccgactgctggcacgcaccgccccgccccctcggggaggagatggcggaggtgttcctcccagcttcctcttcccctgggcgacggcagggcggctgctccccgagcccccgacgcggggcccagaagcacgaccccctcctggggcaggttgttccccccggcggcgctcgcccgcgccgtcgtggcccttaggggctctctcctctgaggccccgacccccatcataatggttagaatggagacgcggtcgggatcgctgcagagggggaggatctcttgaggaaggcgagacgcctccgcggagctaagattcagcaccctttggactacgatcttgaagtcctcgggagcccaatcccatctggctccctggtgggtccgcatgtagtcttcaggcccagtgtactcccaggcgctccgggcgcgccgttggagcggcgcaatccggcgacggagataatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgcttcgtcggcaaggggggtgtagaaccggtcgctcttccagtcgtcccacttcttgcggaggacgcaggggatgtagcggttcaacactggcccccgcggctggaagtagcagccgccaaccgctgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcgttcacgatgcgggaaggcggtagtacactgccatcgagcagagcagagccccgtgccatggcggtggaggaagagatgattgggaacgagcgcgtgtggcgaaagtagggcgtagcagagaaagagttagagctcaggcggcaaaggcaagaggaacaatggcgaaaggaagggagcaaatccttttctcgatgcttttatacccttgccatcgctgggcctggctcctcgtttctcgcgcccactacctcgctccctcgtatctcgctatcccgctccctcgtttcctgtgcccacgcttccactaatcccattcgcccgcttacggcgcatgaagtggatatgcggttgtggcaatcgaaacggattgtatcgtgcgcgcgttaattacgctcgccaaccgaagcggcgttaccgtatctccgagcgagacaaatctgctcacccagattcgcgcgctgctcaagtgatgtggcagtcttgaatagaccgcccattatggacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatggccagaggcttgaggcagacacaatcgcccacgtggcctggcaccttcggggacgtcgggcccgagggtgaggtgtccgccctcctcctgattccccccgagggggggtcgggttgcgcttgccccgaccccgagggccgaggcaccccgaccccttaaggaagtctgcgccacatatatgggataagtgagcacagctgtgctcacctaacagcatttattgcggtctggtcaagcgtgtcacgctgcatgcagcgcaatacagcgcgctcttttatccggtctgtgaccagtcacagaccggtcagatcaacggttaggtggcgactggcggtttgacgcacgcctcgccccgtcccgtcaagacgagtgcctctaggcacacgtctccagccggagctagcgtgttacctcttagagatggcacgttagccctggttagatgaataccaggcttcatcctaaccattacaggcaaggtgttacacgaagaagggcaaacatgcacgttgttaatctgacgcgtggtggacaagaatgaccggtctgacactggtcgcgtcagcaacgagcagccacgatcccacgttgcgcccgtctccgccgggagtggaggtaggtgtgggctgtcccatcgaagtgtgattcggacggcaaccatatcaatctccgttcgtaaagagaaggaaagtccagtttggaaagggaagggtgcgtgtggtatccccttgaagtataaaaggaggaccttgcccacagagtagagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgcgcggtctcccggtgaggagccacgagctccgtcagatagtgatattcaaagtatggccgttggtttatttgcataaagctagtttcacaattcttttcacaagcttattatctagcatagactagtccagttttaattccagtatttattacacagcaacggttcttttcaccatccattgtcttcccaaagatggcttcccgttactggctgtaatggttttctggggtttactccttctcgtctctcgagaagatgatccaccagtataaaatcatcatgcatatcccatctcattcaatttaagaatttagagtctagccaagtgtaatacatgtcctgatgctcaatatccgcgagcacggctattcgaatagattggttttactcacactgcagtggatgtacactttacccgtactccgcgacttgcccaacacatgagcctacgtcccaacgaatgagacttgccaaggcaaaacctttcaataacctcacgttggcagtacccgctccatgaacttgcatcctcatgcactccatgaacttgcatcctcatgcactctaggtgtcatgagtttctagcagtgagaggagttctggcgctcccgggaagggaagactcacacatgcattaagttttagttaaattaaatttacacatggcagtcctaccgatggcggcaccactataggcactcgcccctcgcggccccaccaatggctgtcccatcgtaggccctgactcccacacaccaagaataaccactatgcagggatactgccttcgctcggctacgtactccgctaggtctatacccatacgagaagtacggttgtacgagggtcgtttcatgcttaactttacggctcggtccttaactgaccagggacggcactagccttttctggacaccacccaagtaccccagccgccccggtcgaaaacagtgtttagttttgtttctcttttcacaattcatgttatccttgtcatggcaatgtggtgcccatgcctccacatgccgcatctcaactaccttccttaaggtagttgcccaagcatatagcacttgataaatatgagaatgcatgattctaattagcatgactaagcatttgttcaatatcgactaagtacacacgttagcagggtttacaatggtcatacagataatcaatatcaaggcatggcatatttaacaagtagggcattcatattcacatatgtatagcatgtaattttattaaatcaacataattttcgcaataggttcaacatgctcaaagattagtgatgacttgccttgatcgcagtcttgctatccctgctcctcaatcgactcaacaattccctcggaatctaaatttacgtgcgaaagatcggatttgaactcaattagaattcaaataaattcaccaaaattcaaacagtacaaagcatattgagaaaatgttatcaccagatagatcttgattttagatgaatttaggttcaagtttcattcaattccgagttaagatgagtgagttatgcttgtttaaagattcaattttgaattaattcaaacaattgtgaaatggcactgtgcagccgagaggggcattattacagtggctgacatgtgggccatccccctattttatttctggtttttatttttttaaaggaaatcctattgtgtcattgacaggtgggtccggccccctgttgaatctcctgtgggacccgcatgtcattgagacattcacttaaaacctaatttaattagatttctaagcatccgggcctacatgtcataggttcataataatatcattagttttagggattactgtacactaatgaagtggggtccacatgtcataatctctccctctctcgtgccttctctctctcccgtcgtcttcttcctcgtgctcgcgacgaagcagaggagcggcgcgcgacggtacgacggcccgagccggaacggctcggcgcacggtggggctagcggcggcgcatcaccggatgcccgccggcggcggcggcgaagcgcggcgaccgtccggcgcacggcgcgacggcgcgcgacggcgccgagatcccaaaatcggcggcggcacgatgaggaccaatgtgagcgcaaccaacaacgattcaaccatctagggtccacatggagtatatagaagcaaaaatctagcctaggttgtattggaacgaagtccccccacggtgagctcggccatggcgcggcggcggccggagtcggcacggttacggcggcgcacaccccaaatcgagggggccgttggtttctaggtgaccaggcgggactacaggcgcgagggcttaccacgaagtggcggaacggcgaagttcgacggcgagtggcgcggtgcggtcgaaacaggggcagacggcggtcggcgacggtcgcaagtgttcgatgctcgtactccctcgcgtagcggctcccggctccctccaacagcagcaacggcaacgggcacacctcctcaacacaccccgccacccacaccggccgagaggccctgcggcggcggcgcaacccccgcccaccaggtgttcgacacccggcggcggcgcgattttgttttctctgggatggagcaagaactccgggaaaggggagacgaatgagggttcgattttggataaggtcgagctaaaggcgagcttataacagcgagagggagggcgattcctattggataagatcactcgatgactcagccatgtttcgatctctcctaggttcgattcaatgccttgggccggcatgattgcctagacgatagggtcccaggagagggatcattagctgtgggaggaaccccccctattatccagcggtctcggtggggtgcgacaggatggcgacgcgacggtgacaagagcgacggcgacggacagagataacgacttggatagggggcgccgggctatgccctagggtgacgcggggttgtcgtggcggccgttatcactccatcccgagggcgacgtgtgaggggacgggatgacgcgggcacccgtggcggcgcagcctttggcgcgggcttttggcggcttggtcggcggcgggcccacgcggcgtggcatgacgcggtgcggcgcacgggcacgactagtgcggcgcacgagtcggaaagcaggcgcgcggcacggcagcggttggagagggcggcgtcgggtgttcggtcgggttaggcacagatcgaacacctggcgcgcaatgaacagtagcgccaggaaaagaaaaaggaagagaagagaaaggataaggaaaaaggaagggctaatctgcaaaatggcttggaattgagttgtaactctatctattttggattcaagaattcaaacatttgatttgaatatttatttggttattcattagtccccaaatgaatttgcttcccatcatcccaaatacaaatattttaatttgcatttttatttatttattcatatctctaccaaatgatattactctatattggattattccaaaattaacttaaataattggggggttttgatagtcctaaaattaattaaaatattcaatgggtccattattaatacaatagcacattggttgaacttatttgcataacaaggtattcatgtaaattgtaattattatttagatgcgcgtctttactttgatttttccattgagatgatttatagtttggcaagcaatatcaaccataacatccatcatgatgcaaagttttaaaaagttaaaaattgtagtgatttttattatcgaggatttttaggatgttacacttaatctcgcgaggactcagtctcctgccacgcgttgcatccgcatctgaagtctacgccgcgtcaccgccgcaatcctttcgccctactccgacgcggtgtccaagtgccgtcctcttccggcctccgatgcggtgtggcggctcctcctttggccgcagcttttcccctcccctcggtcccctcctcccctacgcctctcggctgcccctgtgcggtgcggcagctcgtcctttgtccatggccacaacttgtcccctcccctccgtcccctatgcatctcggctgctggcacctacgcagtctccggcacaggatcacgataccctgagtttctttatggaagatgtatgagagagatgaagtatttctttcctgctggacattgctttgctgctatattcattggaagaatctgctatgttgatgggagaggctgagtttgatttatgttgtgtgccaagttctggacctagttccttgtcttttgatatatgtaatgaacctacttgattttgctgaaagtatgaatgtaataatagtaaaaaagaagtagatgttctgaaagtttgtagtttcttgctctgatgtgtaaactgttctttcgttgtagaccttaaacttactgtttcatcttaaacaaaattaacatcagcggtcattgaacaaattgtcaactatcttgaataaaatggacactattacaactagtgatcccacaaacaaacttctgaaattcttcgatctcttttctttgcttgcccaatttcttcttgcttgtgcgatccatggccaaaagcctttcagccatctcaatatctagcttcgttttttcttctttctgtcccctccttctagggttgctagtgctcgcgatccaatgcataccacagcgatggcgattccacgaacaaaggcttgcgatggcgtcggcggacgagctgccgaggccatattcgccacgctgagctcgtcgccatggtcacctcttcttgttggcgcattgaggttgtcgtcatccagggatagaacgactcccagaagtcggcggcggccagacctggaccggctataggaagggcaagttgggaatgggcaggttggcgacggctggttgcagtgagggaggaagcgaagtccggcgagattggctgcgccgctgctagggatgacggaaggggatcgggaagagacagattaccgggttggggacttgtaccgtctctacaaaaattgactaaccacgcgaaaatccaattctgcccttccaccagttccatacacgtgaacaaagggggaggtaccccgcaccggattcccgtaactcgcggtaccgacaattgtgggtcgtttgatctggctgaatggacggttacgattgcagtaccacgcggtaccaaaaattctgctggacagtaaaaattctcttaatttttataattgtagataagtagagatagagatagagattgaccggtctaacaaaaggtgtagacgtggtacacttgagcgcgtgaaactccatgatgataaggttcgattgttaaaatcctaaggcaaccaagattactatttaatatctattaaaagaaaattacatataaaaattttttgaaaattttatatagatgtagctgtgcaatttctcaattggttagtttctttacagctaatccaggccacccatgttcaagtcctaaacttattagcatttacggctaattattttttcagtcgtagtcctaaacttattagcatttacgggtaattattttttcagtcgtagtggtaggtgatctaccgtcgatagcaagatatccgtggtgacgtcatcaattttaaaatatgttggtccggtatttcggaggtgctcataggggtagggtatatacctgtgtatgtttatagggatgagtatatgtgcctgcatttgtattttgtttcttaaaaacatcatcaatttcgagatatgctggcccgatattttgtagatgctcatgtattcatgcgggtagggtgtatctgtgtatgttcgtatggacgagtatacatatctacgtttttactataccaatcaggttttgccttcaaacctataccaataccaatcagcattggattcgtcagcagatgtgttgatttgcataggtgaccgtctacacggaggagttagcactagtccaataacgaatttcccgtgcggtcgaaagtgattttcgcgtgcggatcttccacccgtctgtaacgaagtgcctgcaaaaattgctatttttgcgtgcgggtggcgcacccgcacacggtggttatgttgcccgcacgtaaaaatgaaaaaccgaaaaaaaatccaaaaaaaaaccctaaccctaaagttgctgccgccaccctcctcgtggtcgtcctcgtcgttgtcgtcatcgctgttgccggatccgccgcctccccaccgtccgagcccgcccacccgccgttaccgccgtgccggccaccactgccgccgcatcctggcaggggacggctaccgccgccagatccgggttgggggcaggtgcctccgccggatccgggcaggggccggtcgctcgccaccgtgcgcacgccatcgagcccgccgctcccggttgcctaccgccaagcccgccgctgccggagccgaaggaggcaaagaggtcggagccagaggagaaggagaaagtggcgctggcgccggtggtgtggcctgcaggatgcgaggtccacgcagccgcgtggtgctagcttagcggaagtgaggagaatattgagcggaggagaggaaagtgtggagaagatggagggggggggagaggagaaaggaaatttgattttttttttgaacaggttcatagggaatgagtatttttccgtgcgggtctattaggaggcccacctgcgaaaattgatttttgcatgtggttttcacacagaaccgcacacaaaaatggaggatgattttcgcagacgcgactagttatctgcaatctaaatgggtccctgtacaagaacattgttttttaagtagtgtagcgaacgtccttctatcaagaagaagtgggaagactataagttacccatctatgctctaaaaatactataagtactccttaatttattacccatcagctaaagatttacgatgttaatagagtcaccaaccatctcgatctagagaactctaaatcaatatggggtttgggataggacaaaggctgtgttcagatgacccttttcccaacccctctccctcattttccacgcgcacgcttttcaaactgctaaccggtgttttttttttacaaaaagtttctatacgaaagttgcttaaaaaatcaaattaatccatttttgtaaaaaaagcaaatacttaattaatcatgcgctaatggattgctctattttccatgatcactgttccggatgggaacttgttctagcgaacacacccaaaatccactaacggagccaatttagagatcagaccaacctctaggtcaatttggattgatttgaagttaaccatctgtctcgtgggcgaatcagaagctttttgagacaaacctatagagcgtatatcacttgtcgacgagctatatctatctatggtatttgtagagtatgaggattgttagtgctagggtatgcacaagattgaggaataagagacagaatatatcgatttttatataggttcggaccccttaactgacaggtaatagctcttctcctgttgaccggagtcattgttgcctttatatattagtctcacacgagtacaacatttgagttgacctaatctagtccctatcgatctagcagcatggagctctcacatgtgatcgacgacttgtgcagtcttattcctcaaacatgaactcgacgaaattgaatatatctctagatccctcatgtccacattgggtttgtctaaatttgtcctcgtgtctctttccttctagggagtcttgtatttatatcattgagtatcctcttatccaagtagaactaggtaactgatacaaacacacccgcaaggggaggctcgatcttcacggtagtaggttttgaaccaaagagcaccggtgtaaaccgtgcacaagaggataactagctttatacctgcaagggttggatgcgaccaagtggtgagggtgagaacgatccgaatcctcttggattccgacccatcaaaccaagcaatcacagaaccataatccaggactaatccacacaagagggggtaagacacttatgcaatcttcaacaatcgtctctcatctatgctttttataaagttaaagcccactaagtataaagctcaacatgcaaacatgctaccttatcattcactagcaacaactaattatcaaatagttcatacaaacatgcaatatcatccatactttatttaattctacaaatcagaatgcaaatagatccaatcatcacctctctcatcatttccataatatttcaacaaatatatccatcattttttataatacttaacatacatacatccatatattctgtatcaaagcgaagatattatttagtttgtttcatgtttactactaataaatcctaacttttcatttctttttcccctgtcttccgcttcttgcgatacaaattttggccaacaacataaatttcatctataatcctctacaaagtctattaaatttatttctcttcaaatatggcttgaaaaaaaatcagttttatttgttgttaataattaacatcatacttacttcttgctcgattgttgaaagatatatatgttagaaattacttagtaattcttgcagtaaagcgcagggaatcacctagtatatctataaagttcatccccactaagtgtagttaatgttatttctctcttctctcttgaagccgcatcatctcaattatttttagccattgtgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggggtcggaccactcctgcctcgcccccgagggccgaggcgccccgacccctcgcgggttctactccgcgtgcatgggttaggtgagcacagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgttagccccggtcgatatatgccaggcttcatcctaaccattacaggcaagatgttgtgtgaagaagggcaaacatgcacgttgctaagctgacgcgtggtggacaagaatgaccgatttgtgatcggtctgacactgctcatgtcgtcagcacacagccacgttcccacgacgcgcctgcctccggcagaagtggaggtaggtgtgtgccgtcccgtcagaaggatgttcggaggacaaccgtgcaaatctccgtccatttatgaagagaagaaaagtccagtttagaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacataggagtagggtgttacgcttctcagcggcccgaacctgtatacatcgcttgtgcttcatgctctttcgataggtcgcgatctttccacatacacagagagcttgggatctcaccctgagcccccggccgaaccggcaaaggggggcccgtgcggtctcccggtgaggagccccgcgctccgtcatctggcgcgccaggtagggggctcagcgtgtgtcttctgagctcttgcgctctttcgtgtgcaccaagcctttcctgttcagcctcatggctgagcaagcaaaggtgcccgacctctctcccagtgtgagtggcgacgacggggagccgaacccacgccgtcgagctcgtactccaccgcctcctccacgccaaagtcctgggcgggagaaggcacccaagagggctgaagggtccgcgacttcggcatccacaggagctgggaaagggcggcgagatggggagcgtcgcctcctcgtctatggtgacggcagcacgccccagggcgcgctccaagctgcgggcgcgctcctacgtcacccgcctgtcgcccatgacccggagtctccagcccaacgatggctggacgacgtggccaaattggtcatgacggcgcggcagcgcctagacgctggtgggcgatcctccgccaccaagacctctggtgctgctaccaccggctccgcgtcgtcaagacggagggcacgacgagcggcagccgctgttcgccgttcggctgccactccttcatcgactccttcgacccgggaagatctgcgtggggagcaggacgcccgcgccagcatcgagcgccggcgtaatgaccgaagtgctgcccacgcaacggaaggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaagggacaggcgcggggttggctaatgaacctgccccccgcgtcggtccactcctgggaggatttgtgccaacagttcaccatgaacttccagggcacatatccgcgccccggtgaggaagcggacttgcacgctgtacagcgaagggacgacgagtcacttcgatcgtacattcagcggttctgtcaagtccgtaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccggttccggtgtggctgcttcggccgcccccggatccgccgctcagacagggcggcgtgacaggaggaggaagaagaggacagtccgttccgacgacgagggtcatgtcctcgctgtcgagggcgcttcgcgggccacccgaaaggggaggcctgtgagcgacaaaaagaaggaggccagtgctcccagcagggagcgccccaccggcaagtggtgcaccgtccacaatacctccctccatgaccttgcggactgtcgcgcagtcaaaaatttggctgagcggacaagaaagtgggaggaggagaggaggcaggagcgccgggaaggcaagtccccggcggttccttccggccatcggcgaagtgaggctaagcagaaggcccccgccgaggacatcgatgatggcgatgatgacctaggtttccaagagcctggggccaccattgccactgtcaatggaggagcgtgtgctcatgtttctcgccggagcctcaaggctatgaagcgagagcttctggccgcggcccctactcataaggcgacgcgccgggcgcggtggtcggaggttgctctcactttcgaccagaccgaccacccaccgtgcgttgcccgaggagggcagattgcgatggtggtttctcccaccgtttgcaacgtgaagttggggcgtgtcctcattgatggaggagcagccctcaacatcctttcccccgcagcctttgatgccatcaaggccccggggatgatgctccggccgtcccagccaatcatcggtgtgacgccggggcacacttggccgctaggtcatatcgacctcccggtcaccttcggtggacctgccaatttccgcacggagcgggtaaacttcgatgtggcggacctcagtctgccctacaacgtggtcctggggaggcccgcgttggtgaagtttatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggctcatctgcccccgccgccccgaggcagcggatagtcacgtgcgatgaggtcccggtcaaggaggttgccctgggcgacggcccgtccaagaccacacggatcggtggtcttctggacggcaaataggaagacgcgctcgtctccttcctgcgggcaaacgctgacgtcttcgcatatagaccggcggatatgctcggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccgtaggaacttattgttatacgacaatgcctttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatttagcggaaacttttgagagcctccgctccgcccgcataaaattgaaccccgataagtgcgtgtttggtgtacctgcgggcaagcttctcgggttcttggtctctgcccgaggcatcgaggccaaccccaagaagatacgagctatagagcggatgcgcccccccagcaagcttagggatgtgcaatgcgttaccggttgcatggccgccctaagtcgtttcatatcgaggctgggagagaaggcgctacccttatttaaactcctcaaacgctccgggccgtttacttggacggaggaggctgaacgtgctctcactcagttgaaagtgtatctcagctctcccccagttctggtcgccccggagccaaacgagcccctgctgctctacttagcggcgaccccccaagtagttagtgcatcgttggttgtggagcgcgatgaggacaatcctcattccgcgcactctcaccctgtgctgactaggcccgggagtgagcagggaggagaggcccccgagccgaatagtggcctaaggcccctaacgaccggagtcggcgctctgcccgctcgtcagacggtgctgggtgcccccgaccctcaggaaggccccgaggccactgcgggaaggccgcacctatcgccctttgaccccgaggctaaccctgtgctgactcgacccgggaaagagcagggagaagaggcccccgagccgaacggtggcctaaggcccctgacgaccggagtcggcccttcgcccgcttgtccgacgacgccaggagcccccgacccacaggacggccccgaggccactgtgggaaggccgcccctgtcatcctccgaccccgaggtcatcggcacagaagacgagtgcgccccgagaggccacttggacgaagagcgccccggggatacggcccctagcaaagaggatcggccccaccgaaaggtgcagcggcctgtctactttgttagtgaggccctccgggacgccaagacccgataccctcaggcccagaaaatgctttacgctgttctgatggcctcgaggaaactgcgccattattttcaagcgcatcgagttacggtggttacgtcataccccctcggccaaatcttgcataatcgagagggtacaggacgggtggtaaaatgggcgatcgaactttctgagttcgatttgcattttgaaccacgccacgctatcaagagccaggccctcgccgattttgtggcagagtggaccccggctccagagcctgtctcaatccccgaggtcaactcggacccctcgcagccgccacacaccggccactgggtgatgcagtttgacggctccctgtctcttcagggcgccggtgcgggggtcacgttgacctccccgactggagacgtcctgaaatacctggtccgcctcgactttcgagcgaccaataatatggcagagtacgagggactccttgccggactcagagtggcagctggactggggatccgccgcctcctggtgttaggcgactcccagctagttgttaaccaagtctgtaaggagtaccggtgctctgacccgcagatggacgcttacgtacgccaagtgcggcgtatggagcgccattttgacgggatagagcttcggcatgtgcccagacgggataacatgattgccgacgaactctcacggctcgcgtcctcgcgagcccagaccccaccgggcgcctttgaagaaaggcttacccagccgtcggcgcgacctgaccccctaggggagacgggtgtgcctgaccggcccccgaggcccgtcggagtccaggcctcgggacccgaagggagcgctccaagctcccttagattgattgcttggatcgctgagatccaagcatacctcacagataagactctacccgaggaccgcgaagggagtgaacgcgtccatcgcatatccaaacgctacgtgctggtagaagggaccctctatcggcgcgcggctaatggaatcctcctgaagtgcattccacgggaacaaggcgttgagcttcttgctgatatccatgaaggcgagtgcggagcccattccgcctcgcgcaccttggttggcaaggcctttcgtcaaggattctattggccgacagctctcaatgacgcggtcgacctggtccggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacggcccggtttggagtgcctaaccgtattattacggataacggcacccaattcactagtgaactcttcggcgactactgcgaagacatgggcatcaagctctgcttcgcctcacctgcccaccccagaagcaatggtcaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcaaccggagagacgccttttttcctcgtctacggcgcagaagcggttctcccatccgagctcaccctgaggtctcctcgggccaccatgtactgcgaggctgatcaagatcagcttcgcagagatgacctcggctacttggaagaacgaaggcggcgtgcggccctccgagccgcacgctaccagcagagcctgcggcgctaccatcagcgccacgttcgggcccgatcactctgcgtcgacgacctcgtcttacgccgcgtccaaaggcgtgctggattgagcaagctctcaccaatgtgggagggtccgtatcgagtgatcggcgtcccccggccgggctccatacggctggccacgggcgacggcactgagttgcctaacccatggaacatcgaacaccttcgtcgcttctacccctgaggggggggtcgggcgtcaggtttcgggctcgggccaaccccgcacccccccctcgggagtgcagggttggccgggggctgccacacatgcacattctcttttctcttatttcagtatttcaataaaagcagtttcaatttcctaagggctgtatctgtgccgttttttcctttttgaagaattttgacttgaaataaaatcactcgtgctcaaccttgccctcgggggctcggttcggtcagctaaaatcgccaaacggggcccagaaccgagccgtgccctggggcgtggtgaactccgggggggaatcggcaaaaacccacaatcgggtcacccataaccctcggtcaccacgttcccggcctggccagcctcgacatgtggatctccccaggcactagccccgacccgcgcctttcgagggctgggacttgggcacgagtccttaaatcaagctaagacacaaaagaggaccacggcacagatcatcctcatctcatttgcatagcaaaataaaattaacacaaagaaaattttcatcatttttgattgcagattaagttgatctatacaaaaaagaggcctgaaggccttagaagaaagaaaaggaaaaaaactggagattagcgggggcctgggggctcaatccgatgcgcccgggtcgccggcctcgtcgtcacggtcgtcagcaccgctggcgtcgccctcctcgtcggagttgggggcgaacgcgagctgaggggccgacccctcgaaactgtggacgatgtggtcggcggcatccctgacccgcacgcgcgcgtcgtcctcggtcccgggagggaactcatccagcgccatccacggagagaagttggggtccctggcctggtagctggccaggacaagctccaccgctccttgagcgaggtccctcgaggatgacttgatgatcttctcgagctcctcggggagctgctggagagctccggccatctttgagaggtgctgagcgaggcctcccaagttggtggagtacttcatcgtttggcccttccagaggcccgcctgccgaccggcgcgatccagacgggagactgcatcccaaagcatgccgggccctatctcgcccgccaagcggagggcctcggcttccccggcggatgaatctagcgcgcgctgcatgtcggtgacgatgtgttcggcatctgcgaggcgggcggctaagtcgctttcgcccgcagccgccccgccgatgcgtgccctcgcgtccagctccttttcccgcgcctcgaggtcggcagcccgctgctccagcgtggctctctcggcgcggacggattccaagttgcggcgcgcctgctccgtcagcgctgcctcacggagggacaggctgtccgccaaccgttgcgcctcggcctcggcctcttcgagagctcgctctcgctcggtaagcgcgtcctcgcggaggcggagtgcggactcctcttcggcgcaggcagactcgtgcgccgccagcgttgcctcccgggaggtgacggcggcctcgcggtccgccaggtccttctccgcgacgcaggcgcgctcctccagcgccatggcgcgtgcctcgagggcctcttcacgccgccggagcgccgcttcggtctccgttgctcgctgctctcgggcagcggcggcatcaaggacctcctgggcggcgtcgagctttttctttagctccgcctcccagctcccgtgttgaaggcggagggagtcctgcgcctcgttcatcacagtggtggcgatgagggcagccccccgctcctcctccacctctcgggcgatctccgccagcgccgtcttacgggcttcaagatctgagacgtgccggcggtgtgctttgcggcctgcttccaccatggcctccaccgagcgccgcccctcctcgacacgcgcccatgcggcgtcgagctccgcacgctccgcctgcagggcctccacctgggcgcttaatccatccaacaccgcggtgttggcggcggctaaggcctgcagaaggggctctgcgctcagcggggcgacggaaggcgtggggaagagctgccttggagaagatgccgcgcggctcggcccgccaatggacgtgccggcctcggggatgtcccccggacctgtttggtcctgggcgtcgcccgaaggagtgggcccaagcgatgcgcccgcggcctcgtcgcgagccatcctagaagctgtcgcctgggcatcgcccgaggaggtgggcccaagcgacgcgcccgcggcctcatcgcgagctgcctcggaagtcgccatcgcctcagcctggcgagcccgggcggcctcctcccgagcggcttcttcggcttggcgagcccgggcggcctcctcccgagcggcttgcggttgtggcagccgagatagatcgtatcgtgcgcgcgttaattacgctcgccgaccgaagcgacgttaccatatctccaggcgaagcaaatcggctcgcccagatttgggcgctgctcaggtgaggtgacagtcttgaagagaccgcccattattgacagccaagttaccattaccgatgcgcatggtttgagaccgttgggtttctgcccaaccatggagaccggtcccacctgtcaccaggctttaggagtggcgtcacgcccgaccgcttcccttgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggtcggaccactcctgcctcgcccccgagggccgaggcgccccgacccctcgcgggttctactccgcgtgcatgggttaggtgagcacagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgttagccccggtcgatatatgccaggcttcatcctaaccattacaggcaagatgttgtgtgaagaagggcaaacatgcacgttgctaagctgacgcgtggtggacaagaatgaccgatttgtgatcggtctgacactgctcatgtcgtcagcacacagccacgttcccacgacgcgcctgcctccggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacacaggagtagggtgttacgcttctcagcggcccgaacctgtatacatcgcttgtgcttcatgctctttcaataggtcgcgatctttccacatacacagagagcttgggatctcaccctgagcccccggccgaaccggcaaaggggggcccgtgcggtctcccggtgaggagccccacgctccgtcacattggatgattcatcaagggtgtaaattgcacctcttcgcattatctaaattgtttttaggctttggatgatttatcaagggtataaattacatctctccccccccaaaaggcataccatacaacccaattatttataacctatggataactgataaaggtaaaaaaataaacacatgaaaaaatcatatagtagggaaaaaagaaaattttagaactcatatatactatattatcacacaattctcctgcagcaacacgtggggtacccatctagtacatgaggttttaattgaacaaaagttgtctaatggataaagtagagtggtatttatactaggaacatccctcctagcttagtgtgaacataagaaaccacatccaagtaatcaaggctaacataaatgagaatgcaaaaagttttctcgggttcgcgcacagcccttcagctcctgcacagccttaagtaaaattactctaacttcttattggaaaatgatattgtaacccttgagaacgttctcaaggtaacctatccttcttggcgtagtgatgatgccttcagatataaaccatagcaatataaaggtagagcatttaggtagtataaaactctcactaaaatttgggttaagttgagcaaagagtgagttcacctcttgttgtattttcctagcattgaggtagtataatttaaaaacataaaaagataaaaaacataaattacatttatcattaaaaaatacatccgcttcggtctccttccctcttttctccctgaatagatgagatcacaattattattagtgaaaataattttaagttgactttataaacatagattgtatatattatcatatatacgtaactaaattagctccacaatgtttaaaaaagaaaatttataaaatcatattattttacccattatattaacaattataattcttagttaggtgcaccttttattttgtaccattaaattagcaatttatgatctatataaactaatttataacccactattttgaactatttttaataaaaaatattttgctatgataatagaccatcaggtctatcttttgttctaaaaaagcctctaaagatctctttccagtctttgcacgttgcacattgtgtccttgcctagtgggcatatgacctagtgctctacctgaagtagctaagttgatcacaatcgcccataaactttattaaaaacatttcaaaatttataggcacactacacatactaatatatttttactcttatttcaaataaatattgttttgaacaaaaacaaacaaacatacaaaaaagaaagaaattagctgcaaactattgttgatattttggactacaagccaactaattgtgtaggtgaattgtttcctaacataaaacgccttaaaaattcattagaattatggagaaaaaatatgaaaattttaaacttgtacgaacggaaaaaaaatccaaccataattttcatattatattaatctggcttatagattatactaatctattatattatactaatttggcttatagattagtatattagattatactaatctggcttatagattataataatctatcataataatctacttatttgttttagcttatatactcctaataatttagattataataatcctaagctaaatcaaacatggcctaaatcataccttgagttccttaccgtcctaatttttccttttgacaatattgaatggtatgcatgataattgcattctcgatccaaaggttggttcaaaagtcatatgagcttgatctatcttgtaagtcgatgaattgtttttagattcacccgacctatagtttgccctatgagatatgatttttgaacaaactataatatcttgttttaataatatgaatgcccacgtgttgcgtgagtcattcctagtttttctaacaaacgctgtatataagagaattagtattaaaataagagggataccaatcacacagtgaaaaaagtgaatgggatcaagtaaaactatttaattatatgtgatgcgactgcataataaacagttcatttgaatgttttgatcttcttgttggcttatcctagaaattctcatattaataggagagaaagaaaaacagagcccatatagaaatacaatttagaaagagttgaaattcggaattaaaaaataagaaatattggaagaggataatagagtccatatagaaatacaattaagaaataatagaaattcgaaattaaaaataaggaatattataagtagagtacagagttcatatagaaatacaattaaggaataatagaaattcggaattaaaaataaggaataacagaagcagagcatagagtccatataggaatttaaaagtaactaaaattcggaataaacataatacac

SEQ ID NO: 75871 - DNA, 3905 bp, Oryza sativa
tggtgaggaagaaaaaaaaatcacagtacacacatatgctgaaaaaaaattgttcccacaacctttattttaccaaaataatatgttatggagagatttttgaaagttacatacaagttatattataagttatattatagttatagtgtaattacatataagttatagtgttaaatttttaagagaaaatttgtcgacaaatatatagcaaaattggtcatcataggttgcccgtttgggcgtccgtcaccgtcgtggccgtcccgttccgagttttgttcacaaattagacgcgagaaaaaaaatcaaggagatgcggtgaagctgttggttggcgagctaactcctggtggcgttacagtatggcggcgtctttggctgattcttgtcccattgctttcgcctgctcaatttcaattctcctaatatttttatgagccggccagagctatcagcagatcgagcgtcgtcgccctcttatgattggatttcatcaccaagtaagtcattgtgataaccatccaatctggatgtttgacatacacatagacactgataacatatatttgaacctgcattcgactgtatacacttgaatcaaacccaataatggcacagtatcaacttgccaagcgtgccaaaaatcacaaccacaatatcgacttgactactccacaggacaaggaaaattgggggtgacataaaatttattctcttgcttgatacatccttacatcagagtaatcaagacaatatgtatagttatataccaaatggtgcaaaaatggaatttctttgatgaggttcctaataactacagtaccttactcagaaccaacaacttaaattggtaagagcggcattctaggcaacattgtgatgattaggaagtttcctctacactgactgtagtctttctacctttcttgccatcaacatataattggtggccatatgacataaatccccaaatggccatcagcatagctataatctttactccatccatcttgtcatgaaagaaaatcacagcaaaaacaggaatgatgggtagagctagggtgcttatcacatttgaaaacagcgatgacaccacaaagatcaatcccaccactccaactgatgctacctgccaagatatagccgtccacagcagagtcattacatatgacagtttcccagactggaatgcatgcatctctccttgtaaagtcatccattcaccacttgcaaataacccaacaagagaagccaatgttgccaccatagctgtttatatatgcatgttcaacacaactgagaacgtctccctcttaataaccttctcaaatgtgacttgcatcagggagagaatgagcgagtatgtagctgatgcccctagtgtcaacaggaaacccaaaatgtacttcccatgtgatatactagtagttccctgagaatcttcatcaactccaaggagtgaagcagaaaacgtaaggaggactacggaattgaaaatcagaggggtgaatttttgagcattgaggaaatatgagaagacagcattgaaggcaagctgactagcacagatgagcgaatatgttgagaccggaagatatagtaggccataggaatacatcaagtcgtctgcagcaatgatgaggcccaggacaacatatatcagagtaattttggggatagaaattgtaggggcaggactactagtgactgtttgtgtagaagatgtctttgaatggaaaagaaatagggcaatgaacaaaatcggaaagccagcagtttggacgaatgtggacatccacttgctattgccgccttgattgtagtagaacctcccaagaagtgtagatgcggtctgaccggcaatgaggaagaacatgttaactcccaccatcagccaccattgccaactcttgacaggagagttctgtataggtacttcatgagttgacgaagttgcagctttggatgaatctgcaagttacagaaggtaggcagtatcaacaggttagcccaaacttcatgtgttaagcatagcacggccaactgaaactttcttttcctattcaaaatagactaccaaagttcccatagtgaagtgaaaccctcctctcctttttttccccccaacaattggccatataaaccccaaaagctctaaatttattgagagaaagtcgagcaacacaagactatagctccatccttacagtattgtccattggtgaaactatcaaatgaaagcgagttacttggaatctcagggaaatcctgcactaatataaaaaaactaatataaagattttacttttgttaaatgcagtgcattactatagctggtgctatcatcaaccacttatccagctcatgtacgcgaacaacaggggtttgccaattaaactcacatgcctactctgccactcgatgatgtcacgatagtctgaaaagttaatatggtctataaacaaaaaacaaatcccatatgggcatatggccatatccaacacgccacgcacgagaaggcaattcatcgaacacctcgcgggcttacttccccacaccatcgaacaccaaataagcccgagagaacgaacgagttcatttcatctgcgtttaccgccgcccatcgcaagacgactctaacctcctcacccccactccctcaacgaagaaaatcggacatagctaaacagtgaggctttcgacagaggaagggggggaaagatttgattgacctgcgatctgtatctggacctcctcatcccggttgctaccgccgtcgctgttgccgctgtcaccggccatgcccgtcgttgggggcgctgctccgcgcgagcgcgagcgcgatccgaggcaagcggagcggtggagagagagggagttgataggaggagaagatgagaagaggtgtggcgccgcacgggggaagacaagtggggaaataaaaagagtaggaaagggtggggcgctgcagtcgtgtgaaaattgaaaactgcctcctccttctttcgcttcgcgagccgccgaccgatcccttgttttactatcgtcaggggctaaaacgagccgatctcgaccaagcccacataggggtggatatgagccggctcggctcggtctggcttgctaggataacaagccaagccagctcgttattctaacgagctagaagactggatcagctcggctagcttgagctagctcgttcagctcgcgagccaatacaccaaacccaaaaagtttgcaataaaaattcagattatcaaaccagcgttcaaatccaagtatgcaactgtatctaagtatcaaagtaatgaggcaacgaatcacagagtcaagtgttcaacaaatgaatcatcagttgaacaaatcacaggaggatgttagtacgttacacctacacggctgcacctcgtcttcctcctccgtgatgcacagggacactcggcatgggttgctcatcgagaggccgacagcgaccagtgagcatcacggcgtgggtagctccgcagttggggaccggccatctggttcctgggcatgaaccggcaagcagcgagcgtcggccactggacgctggacgggcgacggcgaagcaggatggagggagtgcgcaggcggctcaggatggagggagcggcgtgggatgtgcggaggcggcgcagacggctcagcggcgcacgggcggctgttgccgatgccgaatctggatctatcgagaatgaggggaaggggactgattgaccaagtctactagggttttggacattcctattgcacattttctttgggcctagcacgggatggactgatttttctctttctgggccagcaagttgagttatacttatgggccatgttttgttaatgtctctcctatctagctcattaagctcatgagcagctcg

SEQ ID NO: 75872 - DNA, 1554 bp, Oryza sativa
gatctagtttttgctagattgaggtggttggcgactctaggatcaccgcaaagcattaggtgctgcgatcgtggttgtcaacttgtcacaaaaagttgccaacacgattttttgacacctctttatagatttatcctgaaaaccttccgttttgcccacgagacgggtagttacctagaaatcggctttgctagccggtttagttatcaaaacccatcttggtctagtttttgctagattgaggtggttgatgactctaggatcaccgcaaggcattagcattaggtgctgcgatcgtggttgtcaacttgtcacaaaaagttgccaccacccactagagacaaaagaaacaccaaccaaacaattgagcaagaacaacatcatgcgaggtgatttggagattgacaaaaaaaaattaaggaagagcaaagggagatggggactgtgattttcgaggaggaaaagacggtgccactgtggcggagcacaagtgccggcgggatcgtcgggaatcacgcggtggctggccaaagttcttgccccgttcatgtcgtggttgctggccagcgagcaaagttgaaggagtcagatggaagggaagaagatgtggatggaggggtaatttcgtctaaaatggcattctagtgtttggtcactgtttaaaaatggaattttagcgaacacatctcccgaggatggcattttggtgaaacccaattctaataatggcataatcttaattttctagcctatggtggtctctctctctctggctcagaatcatgtagtatttgtgtttattgttgcttggttggactgtaggtcctggtgttctgacagcgccatcactttggatcttttgcctttcatcttccggtttctacttgccggccagcctagctatggaaaagtatggatttgttttactatggcagcttggctgttcactctaatcatgaggacggattgaacgcgttatacgacctcaatcgaagtaataactcttgtgagagatgtaatgttcattgttttcccttgcttttggtcatatactcaatgaccaggtggttgggttagaaagatacttgagaaaaaaatcgaagtttgtagacaaaatagaattggtgtgcaagctttagttgaaaatggtaaatgcaggctatagcatgggagaatttcaacttaatcattgtattttactttgactcactaaagagaagagaaggaacatttaataaataagtttgttcgcccggcgagaataaagaaatgtatttcattgttgtttcatttcatggaaggaagaagaacatcctgctatttacactggtggagaaaccatctttggtcggtcggacagatttcacaatagtcctggttgtattaaaaaccgggactaaaaatatctttagtcccggtttaaaatctcagaggtacttttttgatctttattcccggttggtgttaccaaccgggactaaaaatctatttatagtcccgattggtgttacaaaccgggaaaaaagatcgacatacactttactctcggttggt

SEQ ID NO: 75873 - DNA, 1153 bp, Oryza sativa
gggcggccgatctccactagtggatccccttgaaaactcttgtgacaaggtctggtcgatcttgaggttgctggccgggttcgagatgttctgttatctgtcacgcccagaaatttaacccaaatttccagactattttgcgtattaaatccctgtccaggaccagccagggtacacaaaacgataagtaatatacagttccaaacgtaaataaagcgtaaaatacttacggaagaggcacttagtcctcacaccgaaacagaacgacagcagcggaaaaaggtgatcctagcggggcttcagctccactccacaggcaaaactcaactggggtctgagccttggtcctctaactccatcttcagctcagaagcactacacctctgaaaagggggaataatagcaagactgagtacaaccaccgtactcagcaagccacaccaacgatgcagacgtgcaaggggatacaaggaggggtttgaggctatttgcataaaggcagttgtaaaacattttattgagcaaaacagtaaaactgttgagtaattaaagtaatattgaatctccactgatcaacgctacaccacgttgaacaggcccaaccaacccacctgaactacagtgtattgagtcgatttattaaggtgggactaatcatggtgaatctggtcaaccgcccataaccgcgggcacggctattcgaatagctttactctgatcagaggtgtacaactgtacccacaagacacagccccacggcacatttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccaaggcatcccgcgaaccggtccttaattgcctgggtgcgactagcaaaaccatgcacccacagcccaccattcagtcgcattttagttggataattac

SEQ ID NO: 75874 - DNA, 4647 bp, Oryza sativa
caaaaagagttgacatggcttctctcaaaacaagctttggtgcctcaattccaaaatttcaacaaaatattttttgcacaactattgtatttggatcagctgtccagttccatgtatttgtttagaaaacaaaaaagatagtgatcatatgatgctatgaattgaattagtgatttgactgttccttttttattagagggtaagttgacgaagtattcttaaagtggtctgatggatccctgcctattcttgaatgaatatttaattatatgctgtcatttctcatttagttactttcaactaatactacgtgcacattcactttttcttctagtctagtattccacgcggcaaagcaacgtgtactttctagtcaaccaaggcctagtttagctgaggaaaattgttaggtttggttctcacattgaatatacggacacacatttaaagtattaaacgtagttcaataacaaaacaaattatatatttcgtcagaaaactgcgagacgaatttattaagcctaattaatccattattagcaaatgtttactgtagcaccacattgttaaatcatgacgcaattaggcttaaaagattcgtctcgcaatttaaacgcaatctgtgtaattattttttttctacatttaatattctatacatgtattcaaacatttgatgtgacagcataaaaatttttgttttaacagcgtaagttttttttgctttgggaactaaacacagcgcgccctctaagaaaagaacacgtcgccgcgtgttctttcagtcaactcctaatacacgacgcagcttccatgacacatcctcctgatcttggcatatttgccctccaaaaaacgaaggaaggaagcttgtgcgcgatctatttatatggatatcaagcccggccggcatgtaaaagcaagacggcaagaagaacaacacgaaggcgattatacatgttagaaatggctaccactagtacactgcatcaggcggttgcctacttattagccgtcatgctcgtctgcttggcgccggtgacaccggcatcggctcagccatggccgggctgccccgacaagtgcgggaacatcagcatctcctaccccttcggcattggcgccggctgcgcccgggacaaagacttccagctcgagtgcgacggcaacactccgcacttcaactacctggatgatcgtgagaaaaagctggtgagcctttccatcgccgacggcgaggtccgggtcttcgtcgacgcgggaagcaactgccacgacgaccgcttcaaagcaatcagtgggcactaccgcacgccggactacggccgcagcatcgcctaccggttctccacagcgaggaaccgccttgtcgtgctcgggtgccccgtccttggctacttggttgacgccgacgataactacgtcactggctgcacatccacgtgccggcggtcgcagtcgcagggtgacttgccgggccagtgcaccggcgagtcggggtgctgccagaacaccatgccccgcgctctcaacgtctacaagccttacatactcacgttgaataagacagaggaaccaacgcgaaacgtccccgaccaacaggagctcccgccgacggaacccgtcttccgccatctcgactcaacaaaatgccagtatgtgttcgtggcggaggacaagtggatcaacaccacctacagctatcgcgccttcatcaaccgaaccagcgacttcaccgtccccgtcgtgctcgactgggccatccggaacgccggcaactgcgacatcgccgtgcgcaacaggacggactacgcgtgccggagcgcgcacagcgagtgcttcaacgccagcgacggccaggggtaccggtgcaggtgctccaagggctacgagggcaacccctacctcgacggtggatgcaaaggtgggtgcctaaaacgcaaatggagtaataatctttctgacaaaaaaaaattaagtgatgaatatgttttgctttgccaacgctagacatcgatgaatgccaacgcacaaaggaatacccatgcttcggaaaatgcacaaacacaatcggaagctacacctgcgaatgccgaccggggactagtggaaatgcaacccaggagaatggatgcctcccaacggacaagttcacgttagctctgaaagtcgttacaggtattcaatcggccggttatcaagcaacattattaatgcacttattttcttgtcgggaactaatgaatatcattggcataccatgttcaggggtcagcgtcggtgtgttcctgttactgttcatgttgttctggctctacctggggctccaaaagaggaagctcatcagaacgaagcaaagattctttgagcagaacggtggcgtgcttctccagcaacagatgagttcctatggtggcaccagcggcggagcgggtgggttcaagattttctccaaggaagagctcgagaaggccaccaacagctttgccgccgaccgtgttcttggccgcggtggctacggcatcgtctacaaaggcgtcctggaggacaacatggtggtggccatcaagaagtcaaagatgatagaggaggcacagaccaaggaatttgcgaaggagatgtgcatcctctcccagatcaaccacaagaacgtcgtcaagttgctcggttgttgtcttgaagtcgaagttcccatgctagtttatgagtttgtctcaaacggcaccctcgaccactacatccatggcagcactctcaacactgtcatatccttggactctcgtcttcggatagcggcagagtcagcagaggcactctcctacatgcattcttcagcctcaccacccatcctccacggagatgtcaagacggcaaatatcctccttgatgacaaactcaccgcaaaagtttcagattttgggacatcaaaactggtgcctaatgatgagttcgagattgcaactctggtgcaagggacatgtgggtacctagaccctgagtacctcatgacatgtcagctgactaacaagagtgatgtgtacagttttggtgttgtcctcctggagcttctaaccaggaagaaggcactctacttcggcggatcagaggaagacaggagcctcgtgtcttgcttcatgacggctgtgagagatggccgccatgaggaacttattgacagccaggtgaggaatgagatgacagaggaggtgctccaagagattacacacctcgtgatgcgatgtgtgagcatgagtggtgaggaacgaccgatgatgaaggaggtcgctgagaagctggagatgctgaggagataccagctacacccttgggataaaggtgatgccaatccggaggagaagcagagcttgcttgacatggaacagagaaatgtggatcagaagttcagacaccaccatgactatgatcctgaaaatccagcttgcagatcctagtatttgtgccattcgggtatgacctgtgttttggggtagaaataaaatagacatattgttaccttgaatgtgcgttggtactaatcatcactatgctttctccaaaacacactcaggaaatattgctgtctctccgttgtccattcagttgcaagaaatcaacctatcagaatagaactttcagtcacaataacgttgtgaaataaccccaataaactggtggatcgcacaatcgcactggttttatttttgtcataattcttcttgtggtgttgtcataattgtctctatagcaaaataacattcgattaaggtctttatagcaagagacaaaatcaaaatttaaaattaacatgtactttacatactactagaatggaatgtttacttagctagattacatgtcgctaaacaactggacttacaggattgtttatgggcaaaaactgtgccttgtatttagatagctgatgatgtaccatgcagtccccagagaaatgcatcattcacagcttcctaataacggaataagcctcccaatgtaggtcgtagcactcagcatcccatgataaaacttttgacatcgcatccttaatacgccaatcccactgggaagggttgttcttctgcacattcaagaagcaaaaaatttgatatagcttattcggggaggctattttagcttcctataagccttctttcttgcagatttggcatgtcctaatgattcaacagcttccaaaggataagtgttaactaagtagtgtcctagagattgtgaacttacaatgccatcgagagcttgagaaagggacatgtccccatatgttgagatgatgtactgagagagggctgtgctagggtagtcatgccactcagtttgcctggttacaagtaaatttaaacacagtgccataagtacacataaacacatatttgccacttcttagtaaacttgacaacacataattgccaattggcacatcaaacatctataaaatattttgcagttttcacctggatccattactgggaaagtttatctgtactggtgcagatccatattttaatgctctaatctgcccacaaagataagagtcgccttgctatgagacaaagtagtgagattgcaacttgtaagctaactttcattgcagaattaatttcattttcatgtgtcaaaaatcagaatata

SEQ ID NO: 75875 - DNA, 5571 bp, Oryza sativa
aaacttttatatatgtgtttttagttacttaaaagccaatgctgaaaaagaaactacgttgaaaatatctcaaaatcaatctcaaaattaagtttgaaaatttaaattttggcttattctttggttgtttaggctatccgatgggagccgtataagaaatctatgtaaaaaaactcgcatgctaacttgatatgattttctagagaaatatatatctaagcgaattctcacagtgaattcactactagaatagtgaatgtcaacgaccaaaaactaacgacggctgcataatcttggtcgttgatactgctttgggccgatttctggtatccgacgacgctagttttttgtggtcgctaatgtgtagtgggctgcggtcgttgttgttatttactcaggttggatgggcaattgcaaatggtcgttattactcagcgacctgtgtcctcagctctccggccactgcagccgccgccgcactcggcttcggccaccgccgccgccgctgccctcggcttcggccaccgccttcgattcgctccacagctgcaagcctgcagctgctgcccatgctccctataactttgctctttgctgctctttgccatacaaaggaggtagcggcacagcgggaggaagaatccccatcattggcataggaacagtctatcagatcccctccaatccgctgctcccttccaaatccgaaatcccctcttttccccaaacatatttcgccccaaatcaatatgaatcaacagtttttgattccaaatccgagatcccctctgctacccccacatatttcgccccaaatcagtataaatcatgaggttgagagatgagagaagtgttgattcaccgccatgtctcgtagccgcagtttatcaccggaggtgacaactaggggctgcatcgaatggcctacatggtctcctcagggctcccaaatgtcaatccttcccaccaatgaacatcttgatgccaagctccaccatgagtacatctctccacctgatctgcccagccactctgttatttgttccagttcacttgggactcatcaatcgacgaaaatagtcacaacaggtattcttcaatctcctaatgtaaacatttgcatatgatttgtgaaacatattgaattatgtgctaggttaaatgttaaatcttgccaggttaaagtgttggttgtattgtccacttcgaaactaataaaagctgcaaagtttgctaggtggatactgattatttctatgctgccctcaacctgaaatgtttgatatggtcctgacaatttattgttgtggtagctatggcactttcattagcattaggctgtgtttagttggatccaaagtttggattttggttgaaattggagatgatgtgactgaaaagttgtgtgtgtatgacatgttgatgtgatggaaaaggactgaagtttggatccaaattttggatctaaacacagccttagtaatagaggaatgtaggcaatttgtttgtttgtaggcaagaacagcaagtgttctagctttattcatagaatgaattcataattatattttataaacagaaacattaggtgtgacttctgtgcaattaacaattatagttacatgtgcattagttcttcctaatttgacatatattcttctcctagactgtttttcatgatggtactactagtttgttgattttaattgtaatttgaaataattatagtatcagcagtgctttacttaaatggtgtacatctcttgttttcacctctgctataatgctagcaatacaagttatttctatttacttaaaattgagttctgcatccagctaactctatacatacttcaattgaagggtctgaagaccatagcttctccttggattcagttgggtccaaagaccatagctactcctttgtttcagttgttgaggacactatgggtgatgctgtcgaggacaagatgtaccaagttgtaaatgaagatgaaccaaaggaattacttagagactccaaggttaatttgatggcaaacgttgttgaagacaccatgaaagagaaagagattaatgaagatgaccatatgggttggtactccttagcttcagttgttgaggacaccatggatcagcaagtgggagcagacatcatggaccagcaggttgtagaagactccttggtaacagacaccatggaagagagtgatgaagatgaatacttgaaggcagaatatgaaaagggtgcattaatcttcgctagagatgaggcaaatgcgttggaaagaaaagaagctgaagctcgttatgaaaaatcacttgaagagattagagatgaatttttgaaaatttatgtccctttgtattttactctaagaaaaaagtaaattcagttagatagataatatataaattcgatcagcatccagttcatggccagttatttgttagcaaagaataactcatgcatctgtgactctgctatcactttagtatcttcaatgaagactatatattgtcttattgtggggtctgacttgattgatctatgttcactgtgtgcattcttgtttcagtttatagtatcattctctgcagcagtaagatagtactttgctggacaatatatagtctgaaagtttcacttcaactggaactttaagttatgctagacaccacagggactgggactctaccaatgatttgtttgttctatcccttttaaactttgtatccattgtacagtgcaatatgatttgttcaacaaagttgtaaagtattcaagtacaggtctagatgaagggtgctcgatttgttcaaggaagttgtacatgatttaagtgcagcctgtacactgctatgtgtatttcaagggtatgctaatgctgtaagcctgtaaatctgtaagcataacatcgaaatatttttgtacatgagctatgctttacagctcagaaaatgcatcttaccttttttttctgctctaaacatgatgtgttcgattttctggtcgtccttttatttcagttagtatatgtataaagtagcaatacaataaaataaacatcaaactagcttttcccagttggatattgtgttgtaccttaagttagaaaggtgctggtgctgggtttgagtcccctgaacaaaagtttttctaatgattttactttcttttccatacgttttttttttaaaaaaatacatctactatatgttccaaaatcattctatgtgaacaagatatttttttattaattacaatgttaacaccaaatttagtatagtttatggatttgtcgctatcctgcgtatctttgttcttgggttaagaggtttagacaaccaatccaacactgtcgtctagttataaaaatgtactctttagtataaggtcataaccgatccaacaccatcgggtgtatattcggcatagttcatcaaggcattaggtgttagaggatcgaccgttcaaactagttatcatagtagaagaaaacaaccattatatttctttcaaaaaagacaataaaatatatgccgtgaaatatattgtactaaaatagtgtatattgtaaatgaattttaaggtaaaaaagaacagagaaaatgtattgtccgattatgacaaaaatgagtatagttacaaagtttactccttcgtacaaggtcataaccgatctaacgccatcgggtatatcggcatagttcaagaagccattaggtgttagaggattgactgttccaacaagattattacaatagaagaagacaaccattatatatagtgcataaaactttgaataaacacaataaaatatattgtactaaaataatatatattgtaaatgaattttgagttaaaaagaacagagaaaatgtgttgtgagattatgaaaaaaatgagtctaaaaaaattattagtacaatttcacatcagggacattaaagaaaataagttgtggctttttaaaaaaatttcagatgaatggaaaaaattatggcgggtgattacataccttttttattttttttggcgctcaaaggaggagttttaggcatatgtccatgtacatatctcctcctccattcataatagacccaatatcttctcccctctcacatcccctccctcactagattgagagaaccacggatggagcgctaatcattggtgccgatcggctgatcctctacttctccagcgcggcaccgtgccgcgtggcctcatcgcgctactgatccggtggttcccgtccgagtgcttcttcaatcaaaccctagaaagttctactacaggtcactacttctccctttgcattgaaatcatgtcgtttctgatctggtgcctgtcctctatccttaatcaatccatgatgtttggattctatccttaatcaatctgttgcatgtccgcatttgttagacatttctgaattgttgttttttgaatcaaacatattttatagcgctgggctgtcactttttttgtgtatgaattatttcatctatagtcaactaaaaacagaatgcagtgcaattaatcatattgccaaataataatttatatgatatctatctagtcttgacattttacctaacagtgtatcgtaactctcctttgacattaattatatatacagggtcatataaaacttaatatcaactagcaattagaggggatggctccaagcaaggcacggatgggccttgtggacgatcggctaaatcacgagtacttagagggtgtagagaagttcatagattatgcattcagtaaattagatggtgtccaggttatacgttgcccatgcatcaagtgctgcaatacatattctttgcctcatcacatagtgtcttctcacctgaaagcgtatggaatactgaggagctacacattttggtaccatcatggtgaagtcttagcagaacaagagaatgacatagaagttgatgagtatgattcacaggaatttaatggggaaggatataatggaatgcaagacctgatggaagatttatttcctcagtgcaacacccctggtggagacgaagcgacacatgaatctactgatcagggacctgaagaggagccaaacactgatgcggccaagttctatgctttgcttgacaaatacaaccaaccactgtatgaagggtccagaatctctaaattatctgccttagttaatttgcttcatgttaagaatttggggaaatggagtaataagtccttcaccgcattgttggaattgctgcgcaaggactttctacctcatgactctacactgccaaattcttattatgaagcaaaaaaaactattcgtgaactaggactaagttacataaaaattgatgcttgcaagaatgattgcatgctgtactggaaagaagatatagatgctgaatcctgcaaggtatgtggatcatctaggtggaaagaaaaacacacacgggaaattaagcactcttcagctgggaagaagattccacataaaactatgcggtactttcctataaaacctagattgcagaggttatttatgtgtaggaaaacggccgcatggg

SEQ ID NO: 75876 - DNA, 4864 bp, Oryza sativa
tctatgtgaaggtagttcaaagtccgaccgcttaatcgtagctgctaactactactaaaaactgtccacatggtaagcacttgaatatgcatctcccatctgttgaatatatcagaacctgcaataatcatgttcttaggctcccattggatggcctaattagctaaagaaaaagccaaattaaaaattttcaaacttaattttgagatattttcactatagtttctttttcaatattggcttttaaatcaccaagaacatatatatatataaaagttttacctacaaatttatttgtatttcctaataaactgttttggcttattagggaaaaagccaaacgatggggcccttaagattatcagtttacatcgtataactgctaacaacaacataagagtagaataagatattagtttccgtttgggtgaaccctatattttatctaaaacaaaaaaaaacaatatagctcattggggtgaacccttaagagcagaataagaaattaggtcagctgcagtgagaaagaactcaacgagttcttgaacagaatattggttaagagataacccggtatgttttttgggggtcatgatccaatataccaactgattggtccttaaagtccagatgataaccaaattcgtcaatgtaatcgaatatgaaccaagaagcttgagtaaacctgaataggaaaaaaaaatgttagtcccattcgaaaaaaaaaagtagtgtggtttttcatacatgcaagacaaagtaattgacatttttggtttggataatggctgcgggaaacgggagggtttgctggggttttggacacgggggagaaaacgttttaagaatggagagacgtattctatgagaaaccgccttcttagtcaggaagcggatttacactcagtaaaagcaatataaaaacgacatctcacattctcaccacgtcgtcctgtatccatgtcgatgtttgacctccaagcacagaaatgttggaggaattgtcacccctttccattcaatttatacagtggtttcggtgaactacctggtcggatttattttctaaagaatacccacgtctcaaaataataatccatgtgtatgcaaaacaatctcaggaagttacagcgtaataccattataccactatattatcttgccgcacataaatgcggtaattccgagtcaacagttaactgctggttcagcacaaataaaaaccaaaccaaagaagaacagcgaaaaataatatctgcaattaaatgagtccaaaaaggaaggaaaaaaaattaaatgatcttcccacatcaaaatgcaacgggccgctactatttatgtacattcccgcatttcttccgatgatgccactgcagctagtgttactgatcagcagctctacatgtttttactaattaacaagaaaccgtattgatctttgcagggaggcatcccagtcttctaccagccggagccccgatgagcttgaagagtctccacggatttgccggagttgagtagtagatgtcgacggggccattggtgcagttgatgcttgagtcgacgaccctggtgtgacggcgaccacggtggcggtcaaggtagacgacgatgatgctgatgtcgtcgtggaaacggcgcctcacttctctatcgtcttcagatggaagttgacctccctcttcctcgtggcttccttcaaagcggcctttaccactctgtttgctacatcctacatgaatattcagaggaacttggtgttatctcattgtgtgattcctcgttcattcatggggaataaactcccgatgatggcatgatcgaatgctgtagatgttgtctgaacttaccgttcttggattcttgaagacaatctgcaccgcagcgtcatcgctaagatgctcctagggaccatctgaagcaaatatcaggaacatatcatttggtttcagcttgcgaacttgaattgatggttctgcactaagagctagctgctttagaggaatagggggaccaatgctacgaaacacgggatccatgctatactcttgttccttcaagtaaacatcaccaatggttctcgatacctgacagtagaagagtaaaattttagcccatgtctctagtatttgacataaaaatcttatggtatcttaagataattaggtaagtgaaccgagagataaagcctgatcaaaatatcaaaccatgtccaagtgaccaagttcattactctggtaagatataataaaagtagctgtcatactttcacacttggcactataaattgtgaaaagtaaactatgaaaacaatataactcatcgtttttcattagttttcctggataagcaagagtagctgtcatactatgcacagttggcagtacaaactgtgaaaacaaaaatactaaaacttggtcatttttgctcgttttaaaacaatgacaaatagtagtcacaagctcacagcatcttcttaaagcactgcctgctgaactggtccaagtcctggaaacgtgtaaaacgacttttaagttgtgaaatcttcaaagcaagaactttaagactaacaattactcaattagtctaacacatatgatgaactgcaccaatcaagctatgcaacaaaggttgagtaattgacagaaaggggcaatttattttaactccttggacagtaagttcaggatttctgaattcaatccttatgaagctctgatacatcatatgagaagttgcaaaatgcacgaattcactctaccacacaaagctgtggataagttatatccagaagcaacaatttttaccaccaaatcctggcatacatgcatcaaattaattaagtaaagagaagtattttctcatcgaactctcacctgaatgatccccttcaccctccacgcaaccctggtgtgcaccaggatctggccatccaatcctgtgggctgtgttggagtcacctcccgcatcgagttcttccgcggctcttcttcaccgaagaagaggaggggagggggacacaggcaccgactgcaaccacaacaccgtcgtgaggggacactggcgccggttccgaagccgccaccggcccagacgtagccaggggaggggaacacctacgccggtcacgtaggcttggccgcaggcccctttgcgttggctccgatgggcggcggtcgtgcagccggctccgctcttgcgtgcaatgccctctgcttccacccagccaacgccagccgggtcagcgtagaccgaccgtccggccggcaccagatccagctttcaccctctcctctacgtggatgcgaaggagaccacaacgcgtccggataaaggtagacgaagccgaagctgaagaggaatccaaagaatcccaagccaacagactgcgacgcatttgccgtccccgaccttatcgacgttcgggttcgaggagtcgccttgccacccagcattcgtggtgtcgcctcagccttgtcgttgccgtttgtccctcccctccccagccaccttgtcgatcgtccctcccccggctgcaacctccgtccctcttgaagcagtactgaacatcatgaaaggaggaatttatttttgcaatgcaaatgtagctaacggtttggtttatggttgatttgtagtctctgaaaatcagtgtatcgtgtggtatcaagcaactgcagcagtgtctgtcatgttctaagagacttagactgtgcaaatggacctaacaatgccatatatagttaataaaaataaatcatgagtttgcttgtcatacagagtacaatggttctagcatggaaatgtttggatttgtttctgtaatgattttttaccttatttgcttcatataatgtcctgtatagaaatggatttattggataaagtattggatgccataaaaatgccaatgtcatgcaatttcgattttgtatataactagcaaaatgcctcaaatatcattagtgggtatgatggcactgattgcattgatagtctcctgattatttcttttttcatcacttagctgtccatgttcagtgattttttcttcagtactcatcacatactatatcagttagtatttgttctctcttgtcattttcttccaggtgcaatattaagttctgaacatagtattgtctacaatcagatttggggatcagactgcacgtaggcttcctgactgatacactcaattaagggaaattaacaatcactagagttcagtttcaagttaatcggaagtaatcaattgggggaaattgagactgacaagagttccattttcagtcaatcaaaaggttaatttttttttgttcacactgacgatttccaactcaaattctgttgacgcatgtaaacaatctgagagtttagagcacgtgaaagctaggcaataaagttataacaccgagcattttgataaattactttgctcaaactgggacctaacatcaccatcagtaaaattttgaaataacattcatctataagcgaatttacttccaaacatcactttggtcgttgatgttaaaaagaagaaaaattattttcaaaagcattgtttccactgctgtcaaaaattaaaaaaaaattggctcacacctactcacctgaggtacgttcttttactaatatcgttgtattgtcttaattttgattttttttttgtcttaggaattccattatcaggactacttaatatttcttagcattcatccaatgcttcgggcatatgctctgtcggtgacatggggccgggggtatcgtgactagaggcttgggtagccgctgtcacccacgtggcctgaccctatcgggggggtcgggcccgaggatgatgtggccacccctccctctg

SEQ ID NO: 75877 - DNA, 705 bp, Oryza sativa
tcagtttgtcagaatcttgtctaaaattcccagttaagttccaggattatatttaatcagcaaagaatgtgatacaaactaatcagttctacctaatctttttgtatttgagtgttacctaaattcagaagttgttgttagtgctaaagctaaactcatagatcaatttttccccctctatgattgggaaattattctcgcaggtatctcatcgtaattgatgatataagggtagaacagtggtgtaatatggagcctgctttccctgccgatcatggtatcagcagcagaatagtggtgaccacgagtattcaatcaattgccaatgcatgcagcatcccaaaaggctacatctacaaaatggaaaaactagatgctgaatgctccaaaaacctgttcttcagaagcgcctctatcgaggaatgctcacctgacatagagagaggttcagaatcacttcggaagaaatgtgatggcctcccactggctctgatctgcgtaggccagttcttgcgcacagaaggagctctaacagggcatgcaattacatctgcagcaaactactccttccgtccaaaaaaaaaaaaaaaaaaacaaaccctgggttttcatgtccaactttgactatccgttttatatgaaatttttttataattcgtattttcattgttgttagatgataaaatatgattaatattttatgcg

SEQ ID NO: 75878 - DNA, 720 bp, Oryza sativa
gattccggcctccgtacggtccataacagtttgtccggaatgggattctggcccacccttcgtaaggtctggacgggattacggcctgcgtgcggtccacataagttgctccgttatcaaaactagtaatatgcccgtgctaaacgctacggtgtatgtctttaataatttttagaatttcatgttagaaaaagtttatatgatctatgcatttgaactttaattcaattcatatcctacataaaatatatttcatgtaaagtgcagtactatgatattgcgcgggcacaataaaactttacaagataaggcctacatgtaagtgataggagaaaaactaaaaagcgtagggcccacttgtctgccctattctccctctctgtctttccccccaaaaaaacagcagagcaagcagcggcgacagcgatggtgatggtgatggtagtggtgcaggctatatgcggtggatggcgatggcggtggtgcgggctatctgcggtgcattatccatttaagttgtatgatgaaccatatagaaaaataataatccagaacaattttgtaagcatatgtatccctttatataatacaaaccatatttacaatctcaaatgacagcctggtgaaaactgacgcatctagtgtgagatagtatgtagaagataatcacacggcattccatataaaaggtgatggcgtgctgtaccaaacaagaggtcg

SEQ ID NO: 75879 - DNA, 10000 bp, Oryza sativa
tgggaagaagagtataaagtaatatagcaatacaatttagaagtaaaattcgaaattaaaaattaatgaatattgaaagatgagtttaagtccacatagaaatataattagaaataataaaaattcagaattaaaaaaatattattggaagaagagcctagagtcaactccctacgtcccaaaataaatcaacttctacaattcaaactttgtccgaaaataaatctacctctaccttcttatctactctcggttcacaaatcaaaaaattttattcctttaataccccttacctacctacccaccaatactaatttactaatattaaggggtagtttggacatttatcctctcctttagtgatgcattgggatgctagaatttgtctctttgtggaaaagagggagtatatagaaatacaatttacagataacaaaaattcagaattaaaacaaagaaatattgaaagacgaatctagagtccatataggaatataatttacaaataactaaaatttaatattaaaaataattaataactaacatgtatgtaaaatacaatataaatattacacattagtagtttcgtaaagttagtacaaaatttaaaattatgttgtcattttaatatatttgaataatacattgagaaaacatgtatgttattctatgagagaaaataccatgcgttagtattaaaataagagggataccaatcacatagtgaaaaaaagtgaatgggatcaactaaaactatttctgtagggtatctaatgaacagagaaggcagtagtcttctttgtaccgccggacgtaacggccatgttgctgttgctcgagagcttcttaagcattgtccagatactccatactgcagcgaaacaggctggacgtgtcttcacgcagctgcatactctgatcgcatagagtttgttcggtttgttctggggtcagaacaactacggcatctcgttaacatccaagataaatacggacgaactgctctgcatctcgcagcagagaagcttaattcgaggataatttctgctttattgcttcaccaaggcatagacgtcacactgcttaacaatgacggtcagacggccacctcggttttaactgaagctttagctagcagaaaggacgatgacatcgaccacatctgggtatgtacttccaccatcctataattgttagtatctttatagtatttaaaagttatagtaaaatagttatcactatgatagtgctacttgtcatatcaaccacttcgaattcaaatttctccacattctgcctataaccaccatcctacatctaactatacattatttattataagcggtattatatactccctctgtctcaaaatataacaacttttggactctgacacgatcttcgatatgctactttgaccaactatatcaataaaaataaaatattttaaataaaaagatttgcatattatgatagcttgtctaatgataaatctagaaacatcaattttatatgattgaccttttttattttttttctattaatagtctgttgatgcgaaaaacatacactggcctggaagatctgtttaactcctgtgcaggttcaaaatctcgcctttagattcgtaagcgtgccagttgatttgatcttgcaatcaataagaaagaaagataagaaaaacacggttaaatctatagacgatagctgatcggctagttgccgatgatatatcatttatctctgagccgatgtcatatctgaatcgatcggcagtcattaatgaatgaaataagactaaatctactcgatcggctatagatattaataacatataatctctacttcgatacatatttaaactaagtgattgggatagatcggtcgctgtgccgagacagtataaatcacttaagtcgaaatatatactaaagtattaattatatagatgtttatagcatagccgatcaaaaagatctagcatgtaccagctaatactccgataccactctatactaagatattagaacaagcagaatatatcaaacaagaagcctaatataccttaatgcaataagatcttaatataaatggcagatttagcatatcaatcgaacatataggatataaagtagctaaatcaggtaagatcggctgaaaccccgatactatctctattaattattataaaacaggctagatatcacaattatagatagaacttaatagatcgaactcaaacttaaccgatgcagcattaagcataaagataactgtaggatctaaacaagatgatgaaaacttctaagagatggtagatacccgatacaatccaagttaacaacaaaacatagccctatcggttacttcttaacagcaagaactagccgatgacaagttatatagcacaactaacaaagattgtaaagtatatatgataactcgacgaattacataaacaagattagagtgtcataaagatggaagcactaatcccgagaacgcaaaccgccttgacaagtttacctctagttgaagatcgaatcaatgcagctcaacccgaaagcaagaactcgtcgaaatagaataaaagggtggcgatgcgccgaaagtgttattgaatgtgtgttatttgattacataggctcgggtcatatttatatccgagattacaagatatgtccttgccggacacgattcttatctctaacaaactctaagataccataagtctttgcggcagacttttgcccaaacatatctctaaagaatttacatgagatatccttattaatagctacaattgactttctaaaagctttttctccatcgtggcaatccttatgaagcacgttaattgattctaggaatagcctcgaagccatctttatcagaatcggctataccaactctatcggctgtatcggttatcctctgtccgatccatctcagccgattcagactccagccgatgccttcacagccgacgcatacgctgttcttcaaatctaactctttgccgaatccgccgaatccgcttcgattccaacgtcgaacctaattcatatcttaccaaatttggtcgttaacatagtcaaagttaaaaatgtttgacttgttactatgctaaaaatgcttatacttacacacacatatatatacatatatatatatatatatatatatatatatatatatatatatatatatatatatatatatataggacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttaatatatatatatatatatatatacatatatatatatacatacacacacatagacacacatatatatacatatacatatgtgtatatatgtgtatagacactaaaaaaatgttcgtgtgttacaacgggtaaatgtgtttttttccagtgatacaatagttactaagaattagtatcgctatatattataattgaaaccgcgctgcctcctacccctcttcgctctgtctgcctgtcttaacttccggaagaaagtttcgtgcctgtacagtgccgaagccgatcttcctttctcggtctcccaaattgattgagggcttttgatcaacttgatctcttctttcaatttttcctaaaaacgcagcgaatccacaaaactcagaggataaaaacaaccggggaaaaatcaccggccgagcatcattcactaccattaaactgagttgaaatctagtgaattaaagccaaattgaaagggggaaatcatgggggaaaggatgattgaggagtggagaatccatttttttaattaattagaggagaaaatgcatgtggaggtagatcgatgtggcggctgtgttagggttcggctcgggcggcacggcggcggctggaggcacacgacaatggtttagacacgtagagacgacatatgaaatcaaatgcatggaatccttgcttatttttttattaggtattaggtattaagatagattagagataaagataaatattagaaaatcaactaaaatgcggatgacgtactaaaattttagcagaaacatcttcaatttttataatatttttataatagtttatatataccccctctcctcctggtgtgcgcctccctctgctctcccatgcccttcctcctccctctcccttttttctttttttctcttttatagaaaattaaaaaaataaattagtgaattcaagatttgaactatgatctcacagtatataccaagttattcttaccaatacatccaatgatgatatttgttttaaggattattgtttgtttttttatcttactttgtgagaaaggaatatagtgatcgattctaatctctttcactaccaccataaaacaaaacatatatattattaggaaactcataacattttactatattcgtgaagtataattatcgtaaaagtacagtaacacgtcacgctactgtaaaacatataggacattactgcacttctgactgtaacactacggtgaaattatagtaaactaggaatcaaagcaaaaaaaaatattgtttaaaacatcttacttgtaaatattgttagtccaagtagcatctcaaagactgtatcaaaaatataaaaatgcttatatttttagtcggggagagtggtaaccaattaatgacacccaaacaaaagtttagagttttcccagctgacatgtaccgctaatccacatccaacctcctgcacgttcgcatccatcgttcgtgcaatcgtgctcattcattgcgcttgacccgactggctagacaacgaccaaacctctcctgacaaaaaaaaactgctcgcgttgccacttctgatcagctatctcatcatttgtcaccttgccttatactaactccatattttaacgttttgtctaacgtttgaccattcgttttattaaaaaatttacattattataatttattttattgtgacttgatttatcatcaaatattcactaagcatgacataaatattttcagattttcataaaaattttgaataaaacgaatggtcaaacgttggtcaaaaagtcaacggcgtcatatattaaaatatggagggatatattaaaatatggagggagtatcatttatcaccttgccttatacccctccgtccaaaaaaacccaacgtaggtagcgatgggacataatacagtataatgaatctagacatgagaatacccagattcatggtactgtataatgtcccatcactatgttaaaacgttggtttttttaacggaggaagtagctcttaaaaccttctcctacctaccgctccatcccatgaaactgaagtaaaaaaaaaaatacccctccataaaaaaaaaactaatcctaacttcagctggtaaaaaaaaatacccgtccatccttaagattagattttttaactttacaagtgtttaacttgtaattattacaagtgattgagtagtactactttgctaaaaaaatctaatgtgttcagagtttgtctttttagcaaaatagtacgtgtaaaaaagttcaggatacccagactgatacgaattggattggaacggaaaaacgagccatcccagatggtactgttgacacgaaaaaatataggtatggaagatctgcttagctctagtgcaggtctaaatcttggtgagatacgggcgtgatagtcagtttgaccctgcaactgacaaaacatacaaattgaagatcaatgagctgatcggttgacaagccgatggagtgattccagccgatgccgatactagccgatagcgatagagttttgagatgtcggctatatgtccaatgtagataatgatacttgagtaaataatgatataatgcaatcggctgatgataatacagtataacagtcatataatccaatagaaaccaatcggctaataatgatatgataggataagtactgatccaaaggataaagcatacatcggctagaggtccgatgtcataaaatccataagattagattgaacagtgaaatctttattgcaatcggctaaatccaaattgtatgtaatccttgtaagccgatacaacgtccagatacctcatcggctaaagccccgatgaaacccttattggcagtcaacaagcatgctagatattacgattctaagcatgacttaatagatcaaatttagttgatgcaacactaaatatgaaaagaaacataatatctggacaatcaagcctatggctgattttaagggtggtagatgtctaagttaatctaatctagcaacacaatttagccgatgccggcagaaaccctaaaacgagaagcagccaatagagctaaattgatatgctaagactagattaacagagacatctgataaataggtaggcaaatatatcatccaaactagagcaattcaagaggtcgaatgtactgatgcagccttgaacgatgccgacgtagacgagacaattgcctaggccggtggaacgttggacttatcccttcgctagagatcgaactgaactaatgcagccccgtgtcaggtgccaaattccactggaggataagtaaaaacctcggtaaagagggtggcgatgcgcttagagtagtattattgatcgtggagataatttacaatgacctgggtgtacatatttatacccatggggagtgttcgcggtatgtcatgagtcccttcgaccagacctaccgaaaccatgcaaccagcgaggattcaggcccaggacgctaagatcatttgggcgaagtcccatggcgaagactatgaagtagaaatcgcgaaggccgaagaatcgcgctggtatccggcaagaccaaatgcatcattgggcgaagggtgtatgccgaaggatggggtcttcgccataacaagcccaactttgaagaggccaaaggggccatcccagccgctcaggcctgttcgccaattggcccattagaggcccatgtatccaaattacaatgtatacccaatcaaacgtccctttcataagggcagccatgtaaattcccctgtaaagcctaaatcctaatgggggaacctttaataggattataaatagcccctagggacatgtgaagtggggaacccaaagaaagatctcaaaataatacatgtactttttccaacactgttgagtaaccacgtccttcgatgtacgcggttgtcgcttcgacaacagctggcgccgaccatggggacctctgagtgaaaccactaagagcgaatgccaccgaagaatgtcgcaaaggagaaggttgctaggcgaatggagtgtgaagcaagaggcgagatggccgccgaagaggtagtagagccttcggcgcccgacgttgaagctggcgtggcaccatcggcttcggcacctgcgctgcaaccaccaccttcggctcctgccgcttcgacggggcaggcgccgaacacggctgcaacagcaagggtgctccagaccagggcggagatcctttcaacgagccaacaggtggcgccccaagctgcttcgccacagcaggctccgacttcgaccgcgctcgccgctgcacaagtcaaccccaacctcgacgcgcaggccgaagctgacatggaggccatgcgtcagaacatggcacgacttcaggacatgcttcgtcagatggaagggcagcagcaggcgtacgaagcggcccgacaagctaaggctgcatcagcacccattctctagtactcggcaggctataacccacctcaagtctatccgcaagcgccgatccaggtctttccgctgcaagtcatgcaagcgccagcgtgcttcgcctgacagccttcagccgtaaccatacacccatcccctcacgtacaagcacaagttcggccggttgctgcccaagtgcatcctccgctactggcacagacatcacaggcgatggtggaaggggtttcagcctggcaagcgcagtttcaagctttccttcaccagctcaactaaccccacaatatttcaagtacaaccccttcgatctgaccggaagggaatgcaagtcagggtgcacccagttggctaccgtcgaaccagcctggtccaggggcttcgccttggagccaaggaccgcagttcgaccccaacactgccattcaagcaccgaccgtccaaccacaggcgacggcaccaagcttcggaaccaatcaagcgccgaaccaggtcgccatggcttggacacagcgtacgttcgacctatccatggcggttccccaagcgtcgccgttcgggaccgggcaaccgaacacgatggcccaacctcatgcgcaagtcatgacttcacccttcaccacaccatatccgcagctggtgccgaacaagccagggggtgagaaggggctaccgctgagcaggggaatcaagattcatccaatcccaccccagtttaagttcccacctgttccgcggtactcgggcaaaacggacccgaaggaatttctgtccatctatgagtccgcaatcgaagccgctcacggcgacgaaaacaccaaggcaaaggtaatccatctcgctctagatggcatcgcccgttcttggtactttaatttaccagccaatagcatttactcatgggagcaattgcgcgatgtttttgttattaactttcaaggcacctatgaggagccgaagacgcagcaacatctactcggcattcgccagaggccgggggaatcgataagggagtacatgcgttgtttctcgtaagcccgatgctaagttcaggacataaccgaagcgtctgtcatcaacgctgcttcggccgggctgctcgaaggcgaactcaaaagaaaaatcgccaacaaggagccgcagacacttgagcacctgcttcgtatcattgatgggtacgcaaggggcgaagaggattctaagcgatggcaagcaatccaagccgagtacgataaggcctccatcgctgctgctcaagcccaagtacaagcacaggtcgccgaaccggctcctctcaccgttcgccaacctcagctgatgaaccaaggacagccgccgaggccaagtcaagcccccatgacttggaggaaattcagaactgaccgcgcaggcaagaccgtgatggctgtcgaagaagtctaagccctccgcaaggagttcgacgcccaacaagcgggcagccatcaacagcctgttcgcaagaaggtcggaaaagacctctactgcgcttaccatggacgttcttcgtacaccatcgagcaatgctgaaacattcgacagcgtggcaacgctcaagatccaaggcctcaacaaggagcagctgtcgaagcacctcgcgaggctgctcaagaacaagtacccccggccgaatagcgccaagacatgaagcgcagagtaatccaagtgattacaagggctgactcgccagcttagccgtcaaaactgcagaagaagatgtagctgcgaatggtgcacaacattgcttcggccgacgaaggggctccacggtacttgaatcagcaaatctctttcgggccggaagatgccgaaggagtgttgttcccgcatcaagaccccttggtgatcttggccgaagtagcgggcttcgaagtccggcaaattctggttgacggaggaagctcggccgatgttattttcgccg

SEQ ID NO: 75880 - DNA, 557 bp, Oryza sativa
catccgcaaacagtgatgttgtggccgagcgccgaagtcaccaccatcaggcgcagaccttggacggcgaggaattcccgcgtcatgaattccaaccgatagtggcctcggctgatcgagggcctcgagacgagccggctgctggcgtccgttccttctcaacgccaccagaagcatgcttgccagcatcacgagccatgaatggagctgctaaagcaaatatatatatgatgagaagcaaagagtaaaaaaaatcacgcgaacagaaaggtcagtgagaattaaaagaggtacacgaagatgaagtacaaacttgtggcttccctaccgagattgaacaatattgcttgatcaggtcgctgatggtacgtggtatttatagggtgcttaaccgaagcttatatttgggagtatttggctaaaggaaagtgacgtgagttaatttggcaacatcattcatacttccacagccagatcgttgttttcagattaaaacatacatggaaaacatctgtacgagggaaaggatcatgctagaatcgataggggaaatagaa

SEQ ID NO: 75881 - DNA, 10235 bp, Oryza sativa
tgtggttttggcgccacgtgtgtgggttaggtgagcacagcggggctcacctaaccgcatttaaagcaggttggacgagcgcgccacgccgcatttaatgcagcgcagcgctcgcttacccggtccgtgaccggtcgcagtggtgaccggtcacagaccggtcggatcgcgggttaggtggcaacaggcggcctgtcacacgcctcgccccgtcccgtcggaatgatgagagcctccaggcactcgtccctagccggagccggcgtgctaactcctggagttggcacgtcagtcccggccagattcataccaggcttcattgcaaccattgcaaggaagtcattgtatgaagaagggcagacatgtggcatgctaaactgacgcgtggtggacaaaaatgaccggtctgtgactggtctgacgccggtcacgtcatcggcagacaaccgtgctcccacgttgcatctgcttccggcggagtggaggtagatatgacccatcccgtcggagggtaattcggacagcggcaattgcaaatctccgcccattaatgaaggaatgacaggggtatcccctgtgtcaggcgagtgacggcgctgagcctcactcaaggacaagctgtgatttagcttccaggagaaggcgcgtgccaagttttggtcaagatagggtgggtccccacccaaaagaagagtaggtagaagtggtgcatgtggtatccccttgagatataaaaggaggaccttgcccaccgaagaagggggactggaggacgacatttagaatagctgaactctcttgctctccaactctctgtaactctttcacacacagatccaccagaacacaggagtagggtattacgcttctcagcggcccgaacctgtctacatcgcccgtgtcttgtgcgtttgctctctctcgcgaacattccatagatcgagggtgaagaatctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtgctccaccgtccccctctcgccgaagtcttgggcgggaaaaggcgctcgaggaggtcgaaagattcgcgacttcgccgcccgcgggcgatggagaaggacggcgagacggggagcgtcgcctcctcgtctacagtgatggcagcacgtcccagggcgcgctccaggccgcgggtgcgctcctgcgtcacccgcccgtcgtccccgatccagagactccagcccgacgttggctggatgacgtggccgacttgatcatgacggcgcagcagtgcctagacgccggcgggcggtcctccgccaccaaggcctctggcgctgctaccgccggctccgtgtcgtcaaggcggagggcgcggcgagcggcggccattacccgccgttcgtccgccattccctcgtcaacgcctccgactcaagaagatgtgcgtggggggccggatgcccgcctcaatatcgagcgccggcgcaatggtcgtcgtgttgcccacgcaacggagggcgcttcctcgtccggagcgccacttcggtccgagcacgggggccagccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaaaggtcaggcgcggggttggctaatgaatttgccacccgcgtcggtccactcttgggaggatttgtgccagcagttcaccatgaacttccagggcacatatccgcgcccaggtgaagaagcggacttgcatgcggtacagcgaagggacgatgagtctcttcgctcgtacattcagcggttctgtcaagtccgcaacaccataccgtgcatccccgcacacgcggtgatctacgcattcagggggggcgtgcggcacaaccgcatgctcgagaagatcgcctccaaggagccccagaccaccgcggagctttttcagctcgcggaccgtgtggctcgcaaggaggaggcttggacctggaattcctccggttccggtgtggcagctccggccgtccccggatccgccgctcggtcagggtggcgggacaggaggaggaagaagaggtcggcccattccgacgacgagggtcacgtcctcgccgtcgagggcgcttcgcgggccacccaaaaggggaggcctgcaagcgaaaaaaagaaggaggccggcgctcccagcagggagcgcccgaccggcaagtggtgttccgtgcacaacacctccctccacgacctcgcggactgccgcgcggtcaaaagtttggctgagcggacgaggaagtgggaggaggagagaaggcaggagcgctgtgagggcaaggccccggcggctcccgccggcaaccggcgaggtgaggccaagcagaaggcccccgccgaggacatcgacgatggcgacgataacctggggtttcaggaacctgaggccaccatcgccaccgttgatgggggagcgtgcgctcacgcttctcgccggagcctcaaggccatgaagcgagagcttctggccgcggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgatgccatcaaggccccggggatggtgctccggccgtcccagccgatcatcggtgtgacgccggggcacacttggccgctaggtcatatcgacctcccggtcactttcggtggttccgccaacttccgcacggagcgggtggacttcgatgtggcggacctcagtctgccctacaacgcggtccgggggaggcccgcgttggtgaagttcatggcggcagtccactacgcctatctccagatgaagatgccaggccccggtggccccatcaccgtccatggtgacctcaaagtcgcgcttgcttgtatggagcagcgcgcggaccacctcgccgcggcgtccaagcccacgggcggggcgacgagaggctcagcgcctccatcccggacgcccgagggcagtgaatggtcacgtgcgacgaggtcccggtcaagggaggttgccctttgggcgacgggcccgtccaagaccacacgaatcggtggggtcttctgaatgacaaataggagaaacgcgctcgtctccttcctgcgggcaaacgccgacgtcttcgcctggagaccggcggacatgcccggggtccccaggaaggtgattgagcactgtctcgccgtgcggccgggcgcaaggccggtccagcagaaattgcggcggcaggccccggaacgtcaagccttcatccgcgaggaggtggcgcgacttctggaggccggattcatccgtgaggtcatccatccggagtggctggcgaacccggtcgtcgttcccaaggcgaatggcaagcttcggagggacaggcttctagatcgcggcgcgcttgctccttccgcgctgcctctcggagggacaggctgtccgccagccgctgcaccgcgccctcggcctcctcaagagctcgcccccgctcggtgagctcgtcctcacggaggtggagtgcggactcctcttcggcgcaggcggcttcgtgcgccgccagtgttgcctcccgggtggcgacggcggcctcgcggtctgccagctccctctccttcgcgttcagggcgcgggcgcgctcctccagcgccgtggcgcgagcctcaagggcctcttcgcgccgccgagacgccgcctcgttctccgccgcccgccgttcccgggcagcggcggcgtcaaggactccccgggcggtgtcgagcttcttctctagctccgctgcccggctcccgtattggaggcggaggtcgtcccgcgccttgttgagcacggcggtggtgatgagggcagtctcccgctcctcctccacctccctggcgatctccgccaggtccttacggtgggcctcgagctcggaggcgtgccggcggtgtgccttgcggcccgcctccaccatggcttccaccgagcgccgcccctcctcgtcgcgcgcccacgccgcgtcgagctccgcccgctctgcctgcaggacctccatctaggcacttaacccgtccagcaccgtggtgttcgcggcggctaaggcctgcaggaggggctccgcgctcagtggggcagcggaaggcagaggggagagccgcctcggtgtgggtgctgcgcggctctgtccgccgatcgacgtgctggacctgggggcgtcccccgaagctggcttgtcccaagcatcgcccgaggggtcgggtccgagcggcgcgctcgcggcctcgtcgtgggtggcctcggaagtcgtcgtcgtctcgggcggagtcgggtcggaggcttgggaggccgcctggcgtgcgcgcgccgcctccgcctcccggacggactcctcggcccggcggagtctggcctcctcccgagcggcttcctcagcctggcgaacccggacggcctcctgggcggcttcctcggcttcccggaggcggtccgcggcttctcgccggtcagcttcccaccttcgagcctccgcggtcaccgtctcctcggcctcagaccggtcggacttggaatggcggagggggtgcgacgggatctcgctgaggcaaaagaaaaaccataagacaaaaagaaacgggtgagtgaaaactcgccttgggagatgggagaatgaatacggccgcggtggacgcgggaacgaacctgcgaggaggtcggctaaatgaccaccttgggggcgagatgaggttcccccgtcatgactcggtcccccccatcttgcggagccgtttctttttccgctccccctcgggctgcggcgtcggcgcggcaccctccgggcgcctgctgccggcacgcaccgccccgccccctcggggaggagatggggaaggggtaccctcctgcttcctcttcccccgggcgtcggcagggcggctgctgtcacaccccgaagttttcctcccaagccaaaattgtaatttataaatgaccctaagaaaataccggtgcaaatcaggagaaaaccctaagaaagtaatgcaaataataatcggatttgacatgtggaattttttcttgagttctacatgtcgaaattcattaacaggatttttagtggaattttcagagctctagaaataattttaaccaattaaaattgagcaagcaatattttaattctagggaaaatcctttttccttttctttttcttttccctccctttttcctccttttttcgaatgggccgccggcccattctctcctttccttccccctcccccttgctgggccggccgcaggccgaggcccagccaggccgccccgccgccctcctctccggggtcgccgacaggtgggacccacctgtcgggtccttcccccacctcccgccgatctcgctcgcgccgccgcgcccgcaaccgccgccgcgcccacgtttccgcctcctccgggccacgtcgaccacgcccgcacgtgcgccgcgttccccgcgcccactcccctctcactcccgctcgcacccgcgcccgagatggccgggattcgattttcgaatcccgcctctctctcctccccactcccccacgtcgtccggcgattcccgcctctcccggccacgtccggtcctctctccccctatttaagcatcgccgtcgtcccctctcacttttttccacttccgccgtactctctcgagcctcccatcgctcccgcgccgtgcaaccccttgccgccgcctctcccgctactccggtcgccgctagccgccgttagggtcgccgccaggccgcgccgtcgccgccgtcgggttcgcgtggccgagatccaccccgtccacccctcctccgtcgaggttcgtcgccggagccctcgttccctcgcactcgggtgagcaccaccttcaccgccgccttcggccatggtttccggtcgccgtggttcatccccctctctctaatccctctcttctccttccttagggcaccccgaagctcgtccgcccgccgacgtcgtcctcccgtggcttgccgtcgccgttcgccatcgtattcctccgcgccggccaccctcggtgaggcatccctcccctcttttccccttcctctcctcctagtgccgcgcagccgcctccgcgtcgccgtttgcgccgtcgcattcgccgtcggtcgcatgcgtcgccggcaacgcgttcgcgcgcgcgtcgtcgccgtcgccgcggtcggtcggccggccttgagccaagccgagccgcgtgccgccgccctttttcccctctcccgcgccgctgaccggtgggccccgcatgtcggcaccgctcctccccggtccgtggatccgatccgccgtggaccgccctctcccgggccgctgaccagtgggccccgcatgtcggtgccgcaccccctccgtgctgacgtcagccctggaatatattgcgcaataaatagtttaaggtttttcttgtatagtaataaacacactgaatcttctaaaattcatatctaattcatccgagctccgtttaagcccattcaagtctcagtaaatcaagaaaaatgtgtagaatccattaaaaatggttttgttccctgtttcagtagtcttatagtctgtttgcaatgtttgctttgtatgtcgctagattccgtttcctccgacgctccggtgtacttcgagatagtcgccgaggttcctccagcagcagagcaaggcaagtcatgcttgtcacttgaacatgttgatcctacattgcaaatgctctattgttttctttcaaatattgcattgttttataatattactatgggttgtttacctattgttacagccatgctattttgataccatgctcctttgttagcttgggttataacatgattagagttaggactagggtttgcttagccatgcctagttcaactagttcacattggggaaaatcctattaatgtttaggctgttagttctaatggtaatgttggattagtgacaccgctttggtgttggttaattaaaatgaatcacatggtgggctgtgggtgcatggttttgctggtcgcacccatggcagttaaggaccggttcgcgggatgccctggaagaatttatcgtacttaccacaagccagcgtgggcaacggctgggcttgtagtgtagcttttctctagccgacgcatccaggcaagggtgggcgtgatggagtttggatgggccctgcgacggcctatgcggcttccggattcacctaggcacgagaggggactgcccgctgccttgcgaggagtaggggtgaaacctgaggtgtggtgtgcttggttagagggggttatgcgaatggtcctgtcacggcctctttccggtatgtcgtggtggcatgtcggcgcacgggaacgtgtcgtggggctgtgtcttgtgggtacagttatacacctctgatcagagtaaaactattcgaatagccgtgcccgcggttatgggcggtcaaccagattcaccgtgattagtctcaccttagcgtaatcttttgaaactggatagtttaggtggatggttgggcctgtcgcaacatgggttagcgttggacagtggatagttaatattaattaattattacaactgtttaatctttcaacttctgtttataaatgctcgctttatgcaaatgaaccactttagctcttctttgataattccctgcatcatacccctattccggtatgacttgctgagtacagtgggtagtactcagtcttgctctacttttcccaaccccagagttcgagttcgggtcagatgaaggtttccccgaggagtaggcttcgtccgtgccgtcgaggatgcctgtggagtggtgttcccgctgcagttttagtcaaggcttagctcttgttgtctttcttttcttccgctgcatttatgtaagatttttatgatgtttgtaagacgtggatctgaatgtcaacattgtcgtttgtgtaccccggccggtcctggacggggattttaatgcacattctgcttgaaattctattcgggaatttctgggcgtgacagctgccccccaggcccccgtcgtggggcccagaagcacgaccccctcccggggtagattgttccccctgcagctcccgcccgcgccatcgtggccacggagggcctgctcccccgacgccccgaccgcctgcatgatggtcaggatgttggcgcgctctggatcgcagcagagggggaggactccttgggggatgagggatgcctccacggagctgagattcagcacccgttggaccaccatcttgaagtcctcagggtcccagtcccatgtgcgcccctggtgggtcctcatgaagtcctccggcccggagtactcccaggcgccccgggcgcgccgttggagcggcgcgatccggcgacgaaggtagtcgccgaacaccatggcgccagtgagtccctcggatcgcagacccgccaggcggtcaagaacggcgtcgtagccgtctcccagatctaccgtcgcccgccagctggaggcctgcgccgggggctggctcggaagtcggaggcgcgcttcgtcggcgaggggggtgtagaaccaatcgctcttcagtcgtccacttcttgcggaggacgcacggaatgtagcggtgcagcacctgcccccgcggctggaagtagcagccaccgactaccgacggcggcggcaccggctgtacggtgaagaaccaccggaacacccggagagatgggcgcaccccgatgaacatctcgcacaggtgtgggaagatggccaacgtcattaccgcgttgggggtgaggtgcgccatctggagatcataaaactccagaatatccatgaaaaaagaagagaatggcgggaccagccctgccattgcgaaagagaggaagaagacggaccgccccgggtagtgtggcgccgggcgtccttcgcccagcacgaccacctcccggctggtggcagattccggcatgaatcggcgcggcagcccggcctgcctctcgctcacgatgcgggaaggcggcagcacgctaccatcgagcggtgcggagccccgtgccatgatgccgacggaggaggagcttgagagcgagtgagtgcggcaagggtagggcacaggaaacaaagagttagagctcaagtggcgaaggcaaggggaagaatggtgagaggaaggaaacgaatctcttccacggcgtctttatacccttgccaacgctattcccggctcctcgtttcccgcgcccactacctcgccccctcgtttctcgcgcccacgcctccactaacccaactcgcccgtttgcggcgcacgaggcagatgtgcggccgtagcagttgagatgggacagatcgtgcgcgcgttaaccacgctcgctaaacgcgaaaagcgccatcatcacgcctccaggcgaaacgaaccggctcgtcccgattcgcgcgctgctcgagtgatgtagcggtcttgaagaggccgttcattattatcggtcgattttcccttgccgatgcgcgcgacttgcgaccgctgggttcctgcccacctgtagagaccggccccacctgtcaccaggcctaaagagtggcgtcacgcccgagcgcttccctcgaggggggcgatcgccctggcgtaacgccgggggctactgtcggtgacatggggccgggggtatcgtgactagaggcttgggtagccgcggtcacccacgtggcctgaccccctcgggggggtcgggcccgaggaagatgtggccacccctccctctgtctccccgaggggt

SEQ ID NO: 75882 - DNA, 620 bp, Oryza sativa
gtagccaccggacagaggcggcgccgacatccgcagcttcttggaggaatctgcctttgaagcttcaccatgctcccatggctggttcttgctgttgggggagctcaaaagggcccccattttgagcacttctcctttctatctgcaaattcccaaagagaacagtaatctcagcatggtgttaaagctcacaacttccttctctaacctgtggagaaatcaatatttcgcaacatgaatagcaagataatatgaaagggaaactgggtacgtcaaattcagaagataccacgaaaaaaaaatcccactttatccacgaaagcggcggcaatggatggatgattgggtacaagaggagacgagattgggaggaggaaggagatggggattaatcaagaacagcccaagtgtactacaggttcaactggatgcgacaatatcgtccaggtttaacgtcgtttgcatcaaacaataacatccaattgcaattgaattagcatcgagatctctctctttgctcctaatcaccaccccaagattcgattccgaacaaaccccagtaggcggttcgtcagaagaatcttccgaacatcaaagaacaccacctcctcacccaacaa

SEQ ID NO: 75883 - DNA, 5719 bp, Oryza sativa
agatatgaccaatccgtcggaggtcattcggacagcgcaaatgcaaatctcggcccattaatgaaggaatgacaggggtatcccctgtgttaggcgagtgacggcgctgagcctcactcaaggacaagctgtgatttagcttccaggagaaggcgcgtgccaagttttggtcaagatagggtgggtccccacccaaaagaagtgtaggtagaagtggtgcatgtggtatccccttgagatataaaaggaggaccttgcccaccgaagaagggggactggaggacaacactgagaatagctgaactctcttgctctccaactctctgtaactctttcacacacagatccaccagaacacaggagtagggtattacgcttctcagcggcccgaacctgtctacatcgcccgtgtcttgtgcgtttgctctctctcgcgaacattccacagatcgagggtgaagaatctcacttagcgcccctggccgaaccggcaaaggggggcctgcgcggtctcccggtgaggagccccacgctccggcatgctccattttatcaacttatcatttaatgcttttttttagtgagcaacaactgtaaacagtaggctgtattgctgtaaacataaccattgttgggttgagatgtcaaattctgtatgttgcattctgtattaaaggagtgtgtgttcttatctgagatgttaagttcatcaattttttgttcagtatgggagttggttaatggtttcaaatttttggggtattttacaggtgtttgacggttatggtcgtacagacgaagcatcttttgtttagaagaacttacaaaggtccatgatgatgcttggttgacttcctcagcagcatccacaatgtaatcaagagtgcattttggcaagtatctcaaaatgttattctggtggtactcataagatttggaaggtttgacctcaggggccataggatctgtcccttgtgctgccgcctccaccgtaagggggagaagggagggccaagtaggaggagatagcgggcatggcctggtttcacgacagacgccgggaaggaggaggttggagggcgaagggttgatgatggccgcaacttgatgccttggtgacagctcaagcggtgtgatggtggtgtcatggcctccagatttggcagcgaggaggttgtggcagcacctcgggttctgaccttctatatagctccttctgcccatgtaaattttctgtaaagttctcttgtgtgatgtctattcaggccctcctccccctgattctttgatggtttaaaagatcgattttgtgattgtgttggatccattcatttttgttaaagattgattctgttggccgtgttaagatttattcgaggcacaggctcttccttcagtttatgtgatgcagaatgttggagaaacgggaaccggagtcctccttcctccggggccctagtgcgccgttggctatatatttatgcaatcgattggcctgacaaaaaataataatgtaatatgatataaaatttgttcccattgcaacacatgagtgaaatttcaaatggtattcgagaattcaaatttgaaatagtaatatcgatctaaatttgataaaaaaaatgtatcaaaatttgatgaaaaatgtcatatagctgagggttggcatatgacactaaatcgaaaaggtgaaccttagctacaaaggcttagttgtgtctggattataaaaaattaatcatgccatataattcacttaatatttcatatcttttaattcgtaaacaaaatatcatttcgtaacaaaatactagctcagtagctctcatggctcatatttatctttgatgaatcatgaaacggctattgtcggggtaaatatctagcttcgaacatgatatcttttgatttccattgtaacacgcgggcacacaactagtatacaagataaatcaagacaattgtgggacccacaaagcccggagaaaacagtgcaggtgcgtagttcaaaatttgaacagtacgtgtgggacccaccgaaaatattaagcacgttttctaaaaaaattaagtgggacccacaaaagcccaaaaaacaagcccaaatacctggtccatccaatccacaaaagaaacaagtcaacatagaaggcccatatgaattataaaagtccatctctcagcacgaaggaaaaagtatacttcgactccctcaactatcgcccaagtatgatttatgtcctccaaccacaaaaccgggtatattaactcctccaactatcaaaaccggtgcaaacaatgactctgggtggttttggatgacatggcgcctacgtggcagtcttggcgcttacgtggcattagaataaaacaaaaaaataaaaagaatatgtgagacccacatgtcattcacacaaataaagtattgcatgtgggacccacatgccatcctccctatccttcccttcttcctccttcctccctctgtctctctcccttatctctctctcctccggccttccgccccgtgacgagctccaggatgagcacgccgaagacgccgtagatgtcgcacttctcattgatccgaaggctctggcacgccagctccgccgccacattccccataccgtcctggaaccggctgctcatcacgtgcttgtccagcttcggcagcagtcgcgccagccagaagtcgccaatcatcgggttgcactgctcgtcgagcaggatgttgctcggcttcacgttgtagtgcaccctgccctcgccgaccgacgcgtggtacaccgtcccgaacacgccgcggccgatctccgtcgccttgctcaacagcgcgtcgcgccgcccacgaagtcctcggaacggaggaggctgttccccggcccaaacgtcaccatattgcccgtggcaagcttgctggacttggtcgagcttgacacgatgctctccagctctttctccggagtcgtcccgccgtcgctggccctccgccgcgccgatatgttgagcagggtagatgccgaggttgccctcgagcgcgctcgcgtcgaggctctggaacacgcccgacgccggcagccggccgacgaggcggttgtgcgagacgttcaccgccaggaggctctcgatcccgctcaggttgttgtactctagcctcagaatctccagcttattcagctccgagatgcccaccagtatcggccctgtcaagctgttgtgccccaagctcctgccatagcaaacccgatgcatcgatcaaacgtcatgcaattcgtcgttgtcgtcttcaatgcaacgaggacattgtaaatgtaattagcaattttttgacttacagttggtacaggaacgaacagttgccgatgttgttggggatggggccggcggcgagggatcagttgcagtcgagctggagcacggcgaggttgccggcctcgcacaggtcgctcggcattgtcccgtacaagccgctgctgtggaggtcgagcacggtgaggttgtggagcaggccgagctccggcggtagctgggtgcggaggtcgttgcggtacaggttgaggtagcggaggttcatgaagagcgccatttccgccgggatgcctccggtgagctggttgacggagaggtcgagccattgcagggtctccgccagcttcgtcgagcccaacggcacgacgccagagagcacgttcgacgacatggtgaggagaaaggccggggaagagagagataagggagagagagggaggaagaagggaaggaaacatgtgggttccacatatttctttttatttttttattattctaataccacgtaagcgccacgtagggtagagactcggtcaaaaccgccacgtaagcaccgtcatccaaaaccacccaggggcattgtttgcaccggttttgatagttggaggagtcgatatacccggttttgtggttggaggatatgaatcatactcggacgatagttgagggagtcaaactatactttttcccagcacgaatcttgaacagataagggtccaaaaaacgaaagattaagcccaacagagaggaatagcaattccgttattttattttcacgggcggcagaaacatcttttattttttattttttataagtagtagagatatatatcagtttttaagaatactttccttgtaatttagcactccctctattcaaaacataacaattgctagatagattggtattagaatgtcttatccaaaaaaaaattaattttaagatggagggagtaatacactgcacagcggcaacagcaggagcagctggcgacaacatttcagtttcaggattgcatttcacgctcattccattgccaacatcagttcttaatttagatcaatatcctgtcttgtctggttatattctgaaattctgcttcgatcgaggaccttgcaaccctgattctcagcttcactttgtgctctcccttgcaacaacaatccatactggattcaaaattgtatttgaccaaacaggttttgcagtcccgttgcaggagacaatacgtaatactccctccttccatttgaactaaccaataataacaataactaacagataatatatagtgtcaactccaaaagttattcagatcatacattatgatgggtagaacagggtgttgaaagattattcagaagatatcagcgatgacggtgccattagacacgtggcatagcgacttgttctttttcattcgaagcttaagtttggtatttccactgccatcgccgtcgtgtccaaccggcaacacctccacaccggtgaagacttcaatcctgtcaattatttcaccgtcgtccatagacacaatgcggaagaatcttgcaatgcagaacctgcccgagcccaggttgacaagctgcggatcatgtgattccagccaacccttaggtgggtcaaattccttccaatcaccaataagttgtggctgggagtgggagtccatggtggagagatcagcagcagccaacggcgacatggtcctggcctcagtcgagaagccaaaccagagcttgagctcagggacatacacaaccttgccatacaagggtagattcccattaccgacttcccatgtgtttctcgctgtgtccaagcagtaggttgcgttgcagctgttgtgggatatgcagatgttagagccgaccactgcataggatgtgatcttggggtaggtgaagcagcaggtacgatcagagacgaatggcggtggccggaggaggtggcagttccatgggccctcaaagatgttgctgcacacaaaggcctcaaactgatcactcagcttcacatcgcccttctctggctcaggaaccctctccatgacatagaggctgccaccgccaacgctgggatggtcattggcatcagcagtacttgggatgaatagagagatgggccgtgacttgggcttgtggaggtttgggatactcaccacggcgcgcgtgtcggcgtcacaaaggaacatacgcctggtgtggtccgctattaccaccttgcgatctacaagggggaagcagtcgagagaaatctggtcggatccatgtgtagaacaaaacttgaggatgggtctgggaagccgaatcctctccatctttaagcctgctgccttcttcttgggattacaggagtcggacaccagtgtctgagaggtgtagtcttcttgcacagctgctgact

SEQ ID NO: 75884 - DNA, 662 bp, Oryza sativa
gggtgacgacgaatggcaaccggcggcgagctccaactcctcatcaaagtggtgacgaagttcttcaatggccaccaaagctgcctcctgatgagcgtgtggatagtttcttcctccaagcttcaaacatcattgacggaaggtcttcacgatcactgatcagcgtcacgcgaacacgacacctcctcgttacggtcatggggaatttggctatactccggggtaacatcatatcttatggcaaacaccatcatcctcagctccctgatgaatcctactacactgatcaaactttctggttgacgaagtggcttctagagaacacatgataagagggagagagagagttaatgcattgattcaagttgattgcacaagcaagttaaggaaaagacactcccaaaaggattaaattaaacaagatttttttttaaatggtaaagaagcaatttctggatttttttaggaatttcaaaattttccttttttagcaaatttcctttttttaaaattttaaaatttattttctataaaatagcctatacagtactttgtaaaataaccaccttttcaacaaacagaggcaatcaaagacagttttgtcaattgacttatcaaaacgtgttttttttacttatcagaggcactagacatacagacgt

SEQ ID NO: 75885 - DNA, 3530 bp, Oryza sativa
  unsure (1)..(3530): unsure at all n locations
aagccaagattaggagtgtgaactaaatatcttagaattctcttgacggcaatcaaatggcactctttaggctccgcttgaaaacgggcacacatgcaaacactaagcatgatgtcgagacgagatgcacataagtaaagtaaagatcctatcatggagcgatataccttttggtccacacatttaccattatcgtcgaggtctaggtgtccattagtaggcatgggcatcttgataggtttggcatcctccatcccaaacttcttgagtatgtctttcacgtacttggtttgagagataaaggtgccctctagtgcttgcttcacttgtagcccgaagaagaaggtcaactcgcccatcatagacatctcgaaccttttagtcatgatactactaaattcttcacaaaaagaggcattagtagaaccaaatattatgtcatcgacataaatttggcatatgaataaatcactcttaaatttttttagtgaagagagtagtatctgcctttccaatttcaaaaccatttttcaaaagaaaatctcggagacattcataccaagctctaggggcttgtttgagcccgtagagcgccttgtggagcttgtacacatggtttgccaactttggatcctcgaaccccggactttgattttgtactttttgaggggtctccaagcatccatctttcacaccttggactaatgcacctgaaagctactcaatgagctcattagacccttaaccacatttgtcattaatcaccaaaacccactaggaggattaatgcactttcacccatgaccccctgggaaacagtattggtgttgtctgaaagctgcttctcaatgttttcttgtccagaaactgggttcacctcaatgcctgcaattttcatcgcacggggagctattctaaacaattctctagaaattctatataatggacaatatataaatttttgaatacgaagtttttggcctgtttaggggagcttaagattctgataagtagctggttggtagcagcttctgagaatctggaaaagctaggttttccaacttctgacttctagttcattatctggattctacaactacagcttctcaaaatttggaccaaaagctggactgtttgggggagcttttaattatgggagaagctgcagcagctagaagctccccaaacatgcccaaatgtgtgttctggtagaaaagtttggctgttttgagaaaagagttcaataaccgatctttttggagaaacaactgtacaatactaattgtggtgaaagcttgacaaacatatttatacttgagtttgctatgtatatccctgattgtgagttcatcacttttcctcaccagtaatatatccgtgctaatacaacagatacgatcaatattgtaaatgagcaaccacaaagttggtcatatgtaatacattgaagccgtgaactccagcattccagcataatataatcagttcgagtgcaaaggtaatcaccgaggagtacgatgtggccgattaagttcatctgatccatggacaatcgctatcaccatataaaccctctaatgtaatatcgtcttcttccctcatagatcaaatggcttcttgtggcgactattgtggagacgacaactttagtgtgtatcgaggctggtaaagttgttagaggtgtatattgaagctgattaatagaggcagtgcggagcagagttcaccaaaccgttttgggtggggttaccgtcaccccacggtttggtggttatcacggtaaccacgcggttaccgcgatgcataccgtgattttaaaaactgagaagcttactgcacgcgataaccatggtgatcgcacatttttgtaaaccttagcgtggagtagataggttgtggaatggagctccaccacaactaggaaaaagcgaatggagaatggtgtcgcaatagatatgtaaggtggaatatagaggacaggaggagaggtagatatgcaaattgaccgaaaggaatagcggtggatatgggatttgagagcaacaccttaaactagtataaggcaaactttcatacttttatatgtcattgatatgcgggacctacatgacgtgaaggaatctttgataagcgccatcattagacnttaaacgaaaacctctttaaccttccaanaaatttncccaactagattaacttgacaaggtaataagtgacatgaagtaaactcttggagacgaccttaaactaatcaattggatcctttataaaaataaggaaaaaaaatcaaataccccttataagtcacggtctttctaccctctccctacatcttacttttgtataaaacttcccctacaagttcaatttttcttccagtttctcaacttccattacttttcaatgatcttatcatcattggctcaatccctcgtgacgcgtgggcttctagcaagacgagatgaggttaccccatgtcacctctaaagggcacctatctccttaccaaccatgaatcgcactgcgctgtatatgtttcgaacaccaccattgtgttttgcatcgaggtttgccgccatgctcgcgggaggtaggtggaacccacccttgcaaaagatgacacgaggtaaatctattatttttccatgtcggttgcccactaaggcacgagaaattggaaaaaaacaagtgaaaactagcggcaagtggaaagcaagaagagatggatcaaacttgggggggaggggagtcttttgtccaaaagtgaattttataggggtatttggatttattttttatgagaaaataaaaactaatcgattggggaccacttgccagctccacgtcagcccccatccccgggcccacaacccgacaaagataaaccccatgacggagaggaatcaatcatcaagataacgaagagtcgaggagaagagcaaaaaagcaaaacagcaaagcgaggagagagatggcggcgaggcgaggtcgagggcgcgggcgcgagtgggaggacgacgacctcggcgtcggcggcgggcagcccccgcacctcgccgcgcccgtcgtctgcctcgcccgctccgccggggacctcgccgccggcgccttcgtcggctccctcgtcggatacggtctctctcttctcttcttgccatatcctctttgtttgttgatgacttgatatagtctaactagcggttagttttgagatgttagctcgagttttattataggaagaattctggctttgtttctttcttcttcttcttcttgtttttttttttgggggggggggggggattttttgggatgaacagcgaatctgttcttggtactgggggttaactgtagatggcatggaaaatgtacttctttttatattatctggaggttctagtgccgttgcctggacacggattctcaattgaaatggataaaagcttggaaatgacaatgcgagtttttttctttcccccaaagaacattgtcataggtctgttcttagtctatctgaaatgtcctgacaa

SEQ ID NO: 75886 - DNA, 3462 bp, Oryza sativa
  unsure (1)..(3462): unsure at all n locations
aattatgtttattaatctttaagagcttagcatacatatagcatatcaagtcatgtgttgcaataaaaagaagatgaacccatctataatataacaagcatgcattaaagtataatcatgaaccgaagattttacaattaagtttgaatcaacaatcaaaattcatgatttcatacgatttataatgcaacatctttacaagcacataggttgaagaataaacactaaacatatatacctattgcatttatcactctttctcaaattagctttagcacaaaacaaccaagagaattttttaactttttcttttcttgagcctttttgcttatttttttctcaattattccgggtacgtccctatcgtcaagactgtttccagggattcggcacccattatttttgctcacatcgaatacgtccttgtcgtgaagactgtttccaaggattcggtattcatttttttcatttttattctctatgcacaatgagcaattacaaagctatttgaggaataataattcaataaagcatttatagatcaaaccatatgctagcatcaatattgcatatttgcttaattcaagtagaatgtaagtgtcatgcatcatctcccttaaaagcaatatctaaacctcataaaaagactagaatacatacaagctatgctagagacaaataaaccttcatagtattgctagcatgcacaagaaaataccatatgtatggaacaaagctcttttttttttaatttttctcattgtcatatttttgcttgataaaaccatgaggtacgaaaaactccccctcaaacaatgccaaaaggattcacgaaaaaaaacacaaactcccccctcaaattaacctctaattctccccgaagaaaaatcaagaagaaatcaaagattttgaaaaagacatccaattgccaatgaaaccaccaagattcttatgaattgatattcaaccactcgtataaaccaaaaccactacctcaaacactagcacttgaaaagctaataaacgaggaagtaaaaccaaagttatatcaatcaaaagtaaattgatgttaccttgaaagcaatcgtcatctcaacattgaacgctcatggggagtatgccatcaaaatacctatgaacaaaaagatgtcgaggcctccgtgttggggttagaaatgtaactaccccaggtaaccacgtacctagaatgccacaccaaaatacactcaaaaactaagtcctaaaattattagaaatttcggcaaaatctcccctaaaaatacggacatcacgacaggcagttataagaaaggtcaataccgatataagccacacaatccaaaccatcctagctccacaaatcccacgtgaaaaataaggatcagaaccttaaatgacctttacaagttctatgcaaaacttttgctgagcaaaaaatagtctaaaactaatttcaattgtgtgcaataataatgtgtagtccaagggtgctactcccgccccatgccgatcgatgtcattaggtacctaaaaaccaaattaaacacaagagtgagtaaagaatactcagcaaatacaatcttgaactagtaaaacatacgcatgatttatgcattaagaaaccaatatgaagggttggatttactttatttttaaaccaaagaagtcaaaagatagtagttccctcccgggcaggtctgaatatcctcttagcattaccggtaagccgagcaagcgtgatcagcgcttctcaaggatcatgaataaagacccaaattgcactcccatggctacgcatggttcttgaataatgtaaacagaacatccggaataatgaaacatgaataacgtcatgaatttgaatatgggtcgaaacacgaataagtagcataacgtcagagccatacaatcagtaatatcaagcaattgaataataattatgcaagtaaagccaaacaaaacaactcagtttgtccatcacataagtctgtcttgtacttgccttaactccttcgatactccgactcaactcctccaacgttggaacccttcacacctgtggagcaaaactacgcataaaccactatattcaactaacgatggttacaagggatatttactaaaatcgaaacctagaacatataaaccttttaccgatttgattaaataacctatagctgntccattactggtttatgcgtaactcacaaaccgtctaacggaaactagcaaataatacaacttcagacatctagaaaaaattctctacaactttcatgttgagcacaaaatcagattatgcctctgaaaatcccagattaaggaaaacgaactactgtcctgagttcctgtctctgtcagcagnattggttttgctgtttctcctaaaccggttatcggaatcgagtgaaactagcaccggtggaaagatatcgacaatgactacaaactttatttaggacaactaacccgattcctgatgggttaataccagatttgaaaatacggtttcagcctagcggtcgatataaaataaaattcaaaaaaccgggaacggatcgtctttaatataaattagaaacaactatagactaaaacggattacctagcagtactaatgtataagaaaaacgaagaatttggaaatattcaccaaattccccaaatttcccttcttctatcaaatttccccttctttccttccttcctgttcttctctgccttctctccctccttcctgttcgttgcaggccaacagcagcagcagcagaaacgaatattggcagcaacagcaagccgtgcatcaccagcaaggaagagatcagatcggcaacagcagggatcggcagcagcagggaaattaacagaaacaacagtagctcaccaacgaccggctgtggacgacgacggctgtggcgaccggcgacggctgcaccagcggcggcgccggcgaagacaggaatagcagcggcagcggcagagcgcacgaggtgcggcggctagggctacagtagcgattctcctgttttttttttcgtttgttttttttgtgggttatataaagagactaaataagatctaacggctcacatctatttaatcctcgggacttcgttcggactccgattactataaatttatagtctattttgcactactcggcgagctctacgcatccacggttcccaatcgcctatacgaacaatggtttaaaagttgaacttttgcgcaattgctctaatactccgcgaaatatattaatttaaaactcggggcattacaagaaataagaaattttggaatccaacactgagtcacatgaccagtagaaccagtaggcacatatgcactaataaaatcagaatcagacttacctgaaaacttaccttcatgcttcacaatagtctaacttagattatgcacaaacttgcctcgatgccaatctgaccgccactgtacctg

SEQ ID NO: 75887 - DNA, 6115 bp, Oryza sativa
  unsure (1)..(6115): unsure at all n locations
cgcagtggcggatccggaggagccgtcctagggaaggccggatccgccgccctagggaggagcttggctctcggcggcgggcggcgggcacggcgacagcctgctccggcggatctggcgacgcgtcctcgggaaggccgaatccgccgccctaggggctctcggcggcaggcggcgggcacggcgacggcctgcggcggcggatccggtggcgccgtcgcagaggcggaggacagcggcgcgtcagaggcggaggacccatcggccaggccggcagcgagacggtggcggagctgcggaggcgggccggcgtggatggggtcggtggaggtggcggcgacctggtacggtggcgggagggagtcaatgcgagggggttcaggcgaggctagcggcgtggctcgcaccgcggcggctcctctcctccagcggcaaggtgctcggcgaggaggagaaggctgccgagaacatctacatcaaggtatatccaccctactcgcttccctaatcttccttccacctcgtgattgttgctgttcttgctgcggtagatgggctacagatgcaactagagatgtattggtgtgctgtgtagaggttttggatgtgctccaaattgaaatgaggctgtttttcgtgtgcgaattgctgagtttgcttcaactttcatccttcccatggtcacttttggtgagttcttatgagtcccatggtcacctttttttaaaaagttataagtgaaatcctattatgaatgtcatatctgatgactccctttatcttattcatgtnaaaannatggttgccaccatatgtggtgcttaggaatgtcaaaactgtaggggcatgtttcttcctaacatgtgaagtggttttttttggctatctagcaaacttgtggctgtgctttctcatgttatactatgctaggcagttgcattgcagtttaagatgtctcagtttatacccaatctttggaaatttgggagcatgatgtcagtcttttcgttttaaattaagggataacaggaagaaaccagggctggcagttctttttgttaccaatttttccaccgtgcaagtacaaaagcatttcagtgtcttttcagagttcacgaaagaactgggctatttatttggtagcaggacaggaagtagggttgttttttacacctgtaaatgttactttagtaaggaaatttgagggtgcctctccctcatgcgtgaaaaccattatttccatagtgaaaaggggtaaaaagggatttaccatatccacagtgtatatccacagtgtgctgtctgtaataatctccatgtcacattgaacgcgcgtgcacacacaccagtaagtgtctactcagcttccaggattgcaagcaacttaattttgcaagcaacgaaaatcagaaacctggtgcatacaaattctaagagtccctcttgtgcgattgaagaatatttattttcttaagtgattgcaaacatagtacttcacattacaacttgtgattcatgccctgtaatggaactgaattagcctcttttagaagaggatgaatgattaaaccattttttaatacattattataacttttattgctcttttgggtatgataaattgttgtggtttctaaacttattaggtgattttttatcttgcagtatttagggtcaatttcagatcatcatgttacatcggaattcaagttatgtaacagcttgtgctagaatgaaggttcttacgaactcaacacttaccaatataagtacatgttttgacttgtgatactatttaccaataacaaacggtagggcgccgcgaagcgcacctaaagttctagtataactttataggtggcatttagacacagccacagcacagtgtactgctctgaagattgcaatatatgttgtttgttgttgccgaaaaggagaaagtccttcacatctatcactgtctaactctccaccagaagcaatttgcattttttgcattcctcacctcacctcacctcacagtaacataattcttgacttgtaatcaaattgaaggtttgtttgttaatctcatcagaattcagaaaccatccaattcatctttcaaaagaaagtatatatatatcgttttgcctgatctctgagcatgcttagtttctttgttacaaaatgctaaactgagatgaactgaaaattttagaaatgtgcgatgcgcaggtggagataacatgcagagggagacagctcctcccgatcctgacattgcagcatgtccgtgacatcagtaactgcatgaatattttttattcatctattatactgcttgaacagtagaagaaactaggatgatatggtagttattgatgttttatcttgtgcatatgcagtgctgctaagctcacttggaagatcttggtcatgcgacatctggtgaaattttggttactgtgattgtatttggaatgtgactggatttggctgttaactgtgttgtaaattttgtgttgtattggatgtttgtcgagttgtgttggtttgaatctgagatggtatgagaaattggattgaatttggtgggctcaaatttaatgggcatgtttagtgggctttaatctgatagttggttgacaaaataggctagttttgaaatgggcctagttctgaaatgggcctattttaaaatgggccagttaaaaatttaatgggttgtttaaaaattaatgggccgtcaaaaaaataatgggccgtataaaaaaattgctgatgtcagcagccacgtcatcagtgacatgtcatcgcacaggtgtcaaaacaaaccatgtcagctgccacgtcatcagtgacacatcatcgcagacgtgtcgaaacaaccacgtcaactgccatgttggcctccatatggcaaccatccatgacgtttaatttcgtcacagaggttgggcttgggctagactacacgagcccataagcgttttatgacggttaaaaaacgtcatagattgtgctgatctgtgacgatttcggagaaaacgtcagcagatttaatctgtgacgctcaatagatgacgataagtataatcgtcacggacaaattcctatgacgaattttcagtgatacatgacgaatttttttcatcatagattaaatagattcttgtagtgtaatatagatcatagcatttggagagtgaaagagaaactacaaagttcattgccttggatggcagttcattgccgttgtgctctacacatacctactccaacaaattaatcttcaacctgtattagcacgcagggaatgtctaaaaaggaattcattgaaaatgtcataactcacaaggcactttaaaacatgattcatcaattcagaactgtattcttttaacagctaatttgaaatgttacagaaattaacaaaccattactaaggacaaacggtgataatccttgtggatcaaaggaaatgaaagtatagaaggttgcacatacctgaaagaagacaactggataatgtcacaccttattatgcctctcctgtataggacaggtatctcagtgatcatctcctgatgcccttgttcattaggaagacaagttggtccttaaccctagatttcttgcatggacagtaggagtatcatctgaaccagattatttgataattggagagcaagttgctgtctcgaaataatcagtggcaatagtaataggattagatgcttacttgcactgcatgtaaattcatacattaatattccctaacccagagcagttcaaggtagtttacaccatacaatttagacatgcaattatgtgagctagctaatatatgaattatccaattgcaatgatgagcaaaggttaattaaatcgtaccaaaccactggaattataagcataatgtacaaagctgaatcttgatgagtttccgaacagttaccaatgatccgaacaactgaacgaacataacacgatttacttgtactgcccatgagcctagtaggactaataaactcaaccatgagcctagtagggccaataaactcaaaggatcatgatcttcctgaaaaaaatgttaaatgaattagaaaatgaggcatgccaccgttgtatgttctctgaataaaacaaaacatatatcgagaactgatgcaaatgtagaaagtttaatgcaacatgattcaacggagaaataggtgcaccagaattccatctatgacttaatgcttgggctaggcattttgacaagaacctccagtgcataggactgtggcttacctctgggctgtggcagcatccacagatcttatgtgcaggtgtgctggcagaggggatcatgtacgtcttcgatgagcggcggacagcggacgacctggaagtggcggtgacttggcgacaggaattcggggcggcgcggggcgtggcggcgagcggcggacaacctggacccgacggagacctggcgacgggagttcgacgtggtggatgacccggcggcgggcttcggcggttgtgagattgaggggccatgggcgagaatctcgccgcgaggttggtgggggatgggagttatgggagagagagagggggaggcggggagggagactgatctagatcgttgtttctacagccatatgatttaggccgttggatgtgtgatatgatgaatgatgaataatgatgatgaatctaccctatagttgaacaaatggttttactcattcatcattgatcatatcacacatctaacggtgtaaaatcatctgatgagttaagatcgtacgtcccagatgcgcgcgtgtcgctcctcctcctctcccgcacccccctctctctctgccgcaatcgacgccgcatcggcgcgaccgcgcatcctctcccgcatctccctctcttccgcattcgtcgcgcctcctccgcatcccgtaccgcatccacgcctctctctcccctcccgctccgtcgtcaagtgcgccgccgccgccaccgaggccttcaatcctccatcgtcaagggcgccggctcgccatgctctccatcgccccgacacaggacgccctcatctctcccctgccgtcgcgccatcgccgattcacctccgccaggtcgccgcctatccccagcagccgccagtccacgctcgccctcgccgtcgcacagatcggcaccgccgccgacccgatgctcgccctcgcgcattcatcgccaccccatctggcccctctgcccatcgcgccaactcgccctagcaccgtctcgccgcctcgcgccatctctgccggtcgccatccgcatcaagcggtcgccgatcccatcgccgaccgctctccatcgggacttcatcaaatcgccgccgcgccgcctgaccactatccccgccagtctctgtagcgcgctcggtcctctccgggccctgacgtccggtttctagagctctacggcaagtttgattcttctccatcccagttcattatttttcttgtgcctatttgattttgactacgatgcaagagcaaactattagatgttagcgagcctgatctacctctgttagtccaccagctaatttgcgttcccttccagatttcgtagggatatgcctcacaacaatttggttacggtaaaataatttgattctattgttgtgctttcaaccataccattacggtttcaaccttatgattgatccaaggctaaccatttggaagcatcgaatcatatattattattatttttggatgggtccatgaccttctctcagttttttttttcttttgctgttctaacatcagttctgattggcaaaattgttttttacagaagctaggaggggagcaaaggaggtgctgggactgatggaaggggagctgttcaggtgcttgctcggtaatagttgggtttttttatgctctataagtacaagatatttctttttttatttgaatggaaacattctgcctgggtatccactttattaggtccatttcctgatttctgttggttatttaggtaatcattttctcaataaaaatagtttttctaatgattttgaggttttccattcgcgagttgtaaaatgtagctgctgcaataagataaaaatcaacaagttgct

SEQ ID NO: 75888 - DNA, 4043 bp, Oryza sativa
tgtactcccttgcaattattctgcatttgtgggtgtgtcttgttgagtacggtggttgtactcagtcttgctcaattttttccccaagcccagatgaggagttccttgaagatgaaggctttggtgtctagctcgtgcctgccgtcaagcgcctgtggtcgtcgccctagtcttccgctgtttctcgttgtctttgagtgtgctgggccttcgttgcccgtgtaataattttatttacgcttccgcttgttaaactctgaattgtatcaacttttggtgtaccttgcctcctgggacaaggaataatacacgcacgtcaggaatgcctgttgggtgatttccggtcgtgacaagttggtatcagagcctcccttgaccctaggacgagccgtagatcccaagccttagctatattttcaaaaataaaaatcctctgttatttgtgaaaacccgctattctctctttgtcttgctgcttcacttatcatcaaaatctgatcttttaaatgttgcttttcttttgtttttgtttgtagatggccggcagcgttacccgtcgtggtttgcacatgactggcttcgtcttggagctgcgaggcatgtgcgtggtcttggggtatccacatggagtggattaccaggccaggccgctcccggatcaggagggtgaggatgcagagcctcacgctggttgggaggtcactgcagtgatcctctccggctctcccgagcggacttcgctggcagtcaccgcgggtggagattccttccccgccgcttgccagaacgccgctctcctcgccatcggcacccttcaccagcgctacccggacgagttgcagcactcgccctaccgctaccacccccgtcgcggaggagccagcgaccacgccaccttccgagacgccagctcggaggatgacgctaccgtcgtgcatctggcacgcatggtggaggcgtacgacgcggctcgtatcgacttccaccagatggtgcgtcgtggcatggtggagaacaacctgaagatcctggagctgcgtcaggagaacctgcagctcaagaaggacctcgacgcgttggaggcgcagctgcatcagctcaagatcgcccagggagagatcagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacaccggtgtgtggtgtaactatgtcggagcctgtcttattttatttgcctaagcaacttgaacattaatgaaccaatttaatagcagtaataaattcaagaattatggtagtcgtgggtggttagttttaattgttagctccttctctgtttgctggttctgtgtggggtttttcagatggtgacgaccaggagaaatgctgctaccggtgatggcaaccaacccgaaggcagcaaccacaaccaccagggcaacccacctccacctccacctccgcctccaccaccaccgccagacaccaacgccattctcacccaaatcctcgcccagcaagccaacatgatgaccgctttcctccaccacctccaaaacccgccacaacagaatgctccaccaccacctccccaacactctaaactcgccgagttcctccgcatccgtccacccaccttctctagctccaacaaccccgtggatgctttggattggttgcatgccgtgggaaagaagctagacacggtgcagtgcagcgacgaagagaaagtcatcttcgccgcccaccagctgcagggacccgcatctctctggtgggaccacttccaggctacgcagccagaggggcagccgattacttgggctcgcttcaccgccgctttccggagaacccatgtgcccgccggagtcgtggctcttaagaagagggagttccgggagttgaagcaaggcaaccgctccgtgatggagtatttgcatgagttcaacaatctggcccggtacgctccggaggatgtgcgggcagacgaggagaagcaggagaagttcttggcaggaatggaccctgagctgtccgttcgtctagtctctggggactatcctgatttccaacgtctggtggataagagcatccgcttggaagccaagcacaaggagctggaatcgcacaagcgccgcttggcgaacttccgcaatcaacagggtgctaaccagagggtccgctacaccaatccctacccagggggatcctcctcgcagcagcagcagcagcagcagcaacctcgctccgcgcctcgaccacaattcgtggtgcgcgtcccacagccgcagcagcagcagaatcaacaagggactcgtgcgccccgtcctcctacgccagctgtgcagcccgctcaaggccgcagggacgctcaaggtcagcagcgtctgtgcttcaactgcttcgagcccgggcactttgcggataaatgcccaaagccaaggcgtcagcaaggccaagcgcctccccgctccaacaacggcgggaaggatgtcattcggggccgtgtgaatcacgtgacggccgaggacgtgctgacaactcccgacgtcatcgttggtacgttcctcgttcattccatccctgctacaattttgtttgactctggagcttcccactcatttatatctgtgtcattcgtggggagaaatcagttgggggtagaaaggcttagaaaccctctgctcatcaccacccctggaggggttatgacagcaaagtattatagccctgccgtccctatagaaattcaagggattccttttccctcggatctgattctgctagacaccagaatttggatgtgatttcttggtgatcgaattggtgtggcgtcaatctccaaggtagtagatggattggcgcgcagacgctactgtcacctctgtgaccgagcgacctagaacagaccggtctgtttttctttgcacctccaacctctgtcagaagttcagaactgcatcagataggtctgtcagaaatccccgtagtcagagagttcggagacgtgtttccggaagaactacctggtatgccgcccaagcgagagattgagttccggatagatcttgctccagaaccactcctctgtacaagcgaccctaccgtatggcagcaaacgaactggccgaagtaaagaaacagttggaagagttgaaagaaaaggggtatatacgtccgagtacttccccgtggggtgctcctgtgatttttgtagagaagaaagacaagacgaagaggatgtgcgtcgactacagagctctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattccgaagaccgcattcactacgcgatatggactgtatgaattcacggtgatgtcgttcggtttgaccaatgcgcctgccttcttcatgaacttgatgaacaaagtgttcatggaatacttggataagttcgttgtggttttcatcgatgacattctgatatactcacaatcagaggaagaccatcagcgccatctccgtctggtgttgggaaagttgcgggaacatcaattgtatgccaagctcagcaagtgtgagttctggttgtccgaagtcaaattcttggggcacgtgatatctgctaaaggagttgctgtggaccccgaaacagtgaccgccgtcaccgattggaagcaacccaagacagttactcaagtccgcagtttcttaggtttggcaggatattcccggagat

SEQ ID NO: 75889 - DNA, 1249 bp, Oryza sativa
tccttctgatgctgtttgaagcgaatacggtcttctgcttggtatcgccctcctgaggttgattgccctttgctcggcctggagtaggtcggggagagacacaacttcttccatcgacgacaattctttgctaaggccgtcggtgcagagaatggttggtgctgaaggtattattgctatgtccatcgacccccgacttcatccatctccaatccgtgtacttttgtttatgactagactgagccacaaactaagccttacccactagacatgtggaagtacggtagtgctttgcaacagaggcccgaagaccggtccttaaacggccgaggtgctactatcaaaaccatgcaccccgagcccagcctaaaaccaatttaggggattttgaatagagggggcggtgtgaagccaattccacaataaaccaacaattccagagtatccaggtgatatgaatatttcccaaagtctatagttgtaaaaccacctaaggttacctaattagattgcgaagcatctacctaaaattgtactagggataccatgagtagagtgtccactagttgaggttttgtttgtctagggtgaacaaggtagtaataataacaataacaataataatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaattaaaaatcccatttattgcgtcagccgagggaggggacgcgcggaccgggtccatgggggtgggggcccacgcgtcagccgctcggtccacggtggaccgggcgcacgcggctggcggcggtcggcgccgtgggtcccgcgcgtcagcctcacccgcgggcgcgggcggctggcggccgggcccacttggcagccgcgagggcgcgc

SEQ ID NO: 75890 - DNA, 8327 bp, Oryza sativa
caaagtatttaatgaaattttatctggcccaattttatattggaatttattaattaaacttagatcttctcttcaagacttttaaaattatttctagaaattccaattaaacaacaatttatatattttgaattttcagggtgtgacagtcgccttcaaacttaaaatctgagaaacttcttgtgtaaaacttgggttttacaaaagacttggaaaacccgacacctgggtcggtgcttgcgaactaaatgaatttccaaaatcgcggaccgaggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgccaagagacatgtggattcgccggggtggtgtcggggaggacctctgggcttcctggcacagtatggtctgggacctaatctggtgttggtctaggacccctctcgttggcatatggtgaacctgtgttggctttcgaaatgccttgtcatgaaagccttaaggtctctagtcgtggccgttctgcacgggctggatgatccgggttagtaatgtcgtgtgggtaaagtgtacccccctctgcagaggttattaaaactgttcgaatagccgtgcccacggtcatgggcggatgtgaggtgattcctagcgtagtttttgtttgactactgccttgtgaaatttgctgttgtggaatgggtttgatgtttggaaaatctgcggctgatgggatcagccaggcctgggtggccgtttgaaagctgttggccgggtgccaatcttgatcaattcaaaagattgaatcattgcacatactccgaccggacgagacgcactgtctcatccgtgtcgtttgagaagcactcccttagttgtttcagaaaagagtttaaataaaatcaatcgcaaaaacaacggtctttctttgaagcttgcattaaacacttatttcccatggcttgctgagtactcctgtactcacccttgctctatataaataatccccccccagttgctgaagaagatgaagcggatcccgctgacgaggagttcttccaggagcaaaccggctacgatgagttttagggtttcggcctagttcccaagtcgcgcctgtgatgtttggtccaagtcttggcttccgcttcccttttgtaatgcagttgtgagctcgagatctgtccgcagcccaacatgactgtactcctactctataataaagagacctctgttgctgtgatattccgtcttcctgtgataccagcactgtttcctgggactggtatcggttaacaggttaatttggagcgtcacgggctagttccgctcgggactagttcggggcgtgacaagagatggtatcagagcacaggcttggccctagggcgaaacccaacgtttaggacgaccctaaggatactaagttcaaaactacttgcgaaaagctaaggcttcttttggtttccttattttcaatagtttgttgctaaaatggttactgatcttctctccctctttcaaaattgtagatggcagtgaacgccagcttcagttcccacggttttggtgagggtcaccacgtcgctcagcttcgtgacctcgcccgcttccttggcttctcgtgtcccgagtacacggggtactccgtggaccgtgttccccctcgctgtgagctctctgtgtacctttatcctcgtggaggtatacacggagctggcctttgcccacaccacttcactgtggccaggcccaccctccagatcgtgtaccaggacctctcctggactgcgctacgtcgcttggcccacgactacagccaccgtctcgggggctctgccttccggcagtttccacgccttccttctggccacgcagatgctaggtacccttgtccgtacagcgagtctcagccagtgctgactcgcatggttgagctttcggaggctcaggccactcagcacgacctactccttgaggcttaccgctcccttgcccgccgctacaccgctctggaggcccgttaggccgaggagggtgtcacctcagttgacactgtctcttgggactcaggctgcctctgccacgccagccacttgtcctcccacagctctcgcggctcagctcgcactcctagtggcgcgcgctcccccagctcgcgtgcgccgtactcaccagtgtactccccctacagacacccagttagcccatcctacacccccggacacaccccagttgcttcctcccgccgtggcccacgctttatccgcactgcgcggaagcgtgttgttggttcttccaccatgttccgcttcgactacccaactcccccaccgccagcggcccgtgccgctgccggccctcgacaggttccgccggtcccttcgcgtcagccgatcgacgtttcttcgactaaggagccgactacaggaggcagccaggtagacgaggagtggaggaggcagtcttcagcagccgcccgtgtgctaggccctttttttccgccgccaactcttttggagtcgtggcgaggtagggcgtgcgtgtgtttgatgtgggtgttgtttggtagtctggttctcctaggtggtgtgcgtacagtcaagctcggcgtagctctgtgacttgtccacacccgttgtattaggtgtttttatgatttggagaatccagtttatgcctagtgtgtgctatctgagttgttatttactttgctgcttgccctcctaagtgcttatctgattcttacctcgccctcttcggggagtttagatggctaaccgcccccgccgtgctgctcatgcaccagcccgcttcggttttgaggaaggtagagttgggccagaagcaaatcatgagtcggctaatgagcagtctcaccatagcaaccgttcacaccatactgcttcccgcaatgcagaaattgagcaaccccaccgcagcgatcgctcgcatcacacagcttcccgtattgcagaagtggaatagtctcaccgctcttaccgcactgccagtcacaattctggagaagaacgcatcccttccccacctcgtgtggaaaacaacatgcagcacttaatagcagtacagacacaaatcttgcaaggattagccgcagccatagccggttttcatcataatgcgcatggaaatggccaccctcacatgagcaacaatagatccaagctgacagactttctgaggtctcgttcgccagagttctctcagactgtcgagcccattgaggctgacgattggctgaaggatgttgatagaaaactcaacttagtgtagtgtactcctgttgagaagacgctctacgcctctcaccagctaagaggacctgctgcagattggtgtgagaattactgcaatgcacaccctgaacccactaacattgcttgggatgagtttgctacggctttccgtgcaactcatgtgcctgaaagcaccattgatatgaagaaagaggaatttaacaggcttaagcaaggcaacaacagtgtcaatgagtacctaagtcagttcaacaagttggctcggtacgcccctgaggaagtggacacagacaagaagaagatcaggaagttcttgaaagggatcgcggttggaatgagactccagttgcttgctcctgacttccccacttttcaacatatgatcaaaaaggcacttctacttaaggatgccagaaaagaggctaccgaagaatacaagaaacgcaagtctaaccatcagggaaattcttcccgagacgcacctcgccctcgctatggtcaacccatgcaatatcaccaatcggtcactcaggctaaccgccagccaagctacgcccctcgtcctcagatgaaccgtccggcacctcagccacagcagcgtgcccctagtggcaatactgcgccaaacagtgttacctctttcaagtcactgctaggaccgtcagcaattcagtgtttccggtgcaaccagatgggtcactatgccagacagtaccctcaaaatcctaccaacaccaactcagggcatgctaatggcagcactgccagaactcctactccagcggcagctcagtctcctcctagctctcaggcaagcggacaaggttctcgtgcttccaacaattttggtcgaggccgggtgaaccacattcaagctgagaccgctcagaacgctccagacgtcgtgatgggtatgttctctgtcaactccgtacccgcaatagttctgtttgattcaggagcttcccattctttcatatcacaagcttttgtgaaaagaaatggttggaaaacccaaaatttacgtgtaccaatgatagtacattcccctgggaggaatataagggcaactcaaatatgcccggaagttaaccttagaattgaggaagttgacttcctagccaaaccgatagtcctagactcgcaaagcttggacatcatcctagggatggattggttggctaagaacaaaggacaaatagattgtgccgaaaagtccatcaccttgcaaggacctggaggaaagcaagtccgctttacctctaacacccctaccgcaagtcggtctaacctaacctgtttacaagtcacctccttggagtcggtgcccatagtctgtgaatatcccgacgtatttccagaagaattaacgagtatgccaccagaccgagagattgagttcgccatagaactggcaccaggcaccgcaccaattgcaaaaagaccctaccgaatggcagctaatgagttagcagaagtcaaaagacaaatcgaagaattggagagtaaaggttatgtgcgacctagctcatccccttggggagccccagtgcttctggttaagaaaaaggatggctctgagagaatggtaatcgactatagagccctgaatgaagtaactataaagaacaagtacccattgccacggatcgacgatctgttcgatcaacttaaagggtcaagagttttctctaaaattgacttgagatcaggttaccaccaattgaaaatcagatctgaagatatcccaaagaccgctttctcaacgcgttatggtctatatgagttcacggtgatgtccttcggactcaccaatgctccagcattcttcatgaacttaatgaacaaaatcttcatggaatacctggaccagtttgtcgtggtgttcatcgatgacatcctgatatactccaagaatgaggaagaacatgctgaacacctgaggctgataatggaaaagctcagggatcatcaactattcgctaaattctcgaaatgcgaattctggttagaccgagtagcatttcttggacacgtgatctcctccagcggtgtcgaagtagatcccagcaaggttgaggctgtacttgcttggaacccgcccaagaatgtgtcagagatccgcagcttccttggcttagctggatattatcgaagattcattgaaggattctctaagctagccagacctatgaccgagttgttaaagaaggaaaagaaatttcaatggtctacagcctgtgaagacagctttcaagaaataaagaaaaggttgaccactgccccagttctcaccttgccagatatccgaaaagatttcgagatcttctgtgatgcatcaagacaaggcttaggatgtgtcctaatgcaagaacaaaaggttgtggcttatgcatccaggcagctcaggcctcatgaagtcaactatcccacccatgatctcgagttggcagccgtggttcatgctcttaagatctggaggcactatttaatcgggaacagatgtgaagtatacaccgatcacaaaagtcttaagtatatcttcacacagaccgagttaaatatgaggcagagaagatagttggaactaatcaaggattacgatcttggaattcattaccatcccggtaaagctaatgtggtcgctgatgcgctaagtcgcaagacctattgcaatgtagctcaaatatggcctgaccaagatcgcttgtgcagagaattggagaagttaaggctgaccgtggtacagtcaggtgtccctgccagcttgacagtgcagcctaccctagaatcgcaaatccgggaagctcagaaagatgaaaaagggataaaagaattaataaaaagaatacagaagaagaagggcaccgatttctccatagatgatcaaggcacagtttggtgtggtccacgcatctgtgtaccggccaagaaggagttaagagatctcatcctaaaggaagctcatgagtccgcctactccattcatccaggaagtacgaagatgtaccaggatatcaaggcatacttctggtgggctggaatgaagcgagatgtcgcagaatacgtagccctgtgtgacatttgccaaagagtcaaggcagagcatcagaggccagcgggtctgctgcaacccctaccgattcccgagtggaaatgggaagagatcggaatggatttcatcactggtttgccaagaacccctagcgggtacgactttatctgggtaatcgtggatcgactcacgaaatcagctcatttcgtgccagtgaaaaccacctttgatggaaagaaactagcagaactctacatgacccatgtcatatgtagatttggctatcccaagaagattgtgtcagaccgaggcactcagttcacctcaaggttctggaagcagttgcatgaagctctcggaaccgatctaaattttagtacagcttaccatccgcagaccgatggtcagacagaaagggtaaaccaaatcctagaagacatgctacgtgcgtgtgccctggatttcgaaagcacttgggatcattgtttgccttatgctgagttctcatacaacaacagttatcaggccagcattcagatgtcgccgaatgaggcaatgttcggaagaaagtgccgcactaccttgtgctggaatgaggtgggcgaagcactggtattcggtcctgacatgctcaaggcagcagaagaacaagttaagctgatccgagaacgtttaaagacagcgcagaaccgtcaaaagaattacgctgacaatcggagatcatgtgtacctgcgggtatcgcctctccgtggtatgaggaggtttgggatgtctggcaagttagcaccccgctacatcggcccctacctcacaaccgccagacgtggcgaagtggcttatcagtttgagttacctgaaggtctcacagatgtgcacaacgtgttccacgtatcccagttaaagaaatgtctttgagttccagaagaacaagttcccctgggtaatatcgagctagaaaagaatctgacctacaaggaaagaccgatcaaggttcttgaagaggtagaacgtcagacccgaaggaagactatcaagttctacaaggtccaatggagcaatcattctgaagatgaggcaacctgggagcgagaagatcttctccacgctgagttcccggagctgctcccttaggtactgaatctcggggtcgagattcttgttaggggggttggtctgtagcgcctgttctgtcgtggcgcctagcgggaaaactatctcttaaaaaccttatttgcgaaatccgtttctttgcttgttgtctagtgtccgtgccatctcagatctcaaatccccgatctatcgtcgaattcaatcccgaatccaaatccttcccaaatcaaatccctctgcaaaagtctattttgcctccctcgggtttgatgggccgaactcctctcggcccatctccccctccctccccggctctctctctctctctctccctctcccccgctctgcccgtgcgctgcgcacgcgtgcgtgtgagccgcgccgagccgagcgccctccgccctcgctgccgcttctcgccgcgccgcccgttgcttcccgcgcgcgcgcgccatggtggccgaccgcctggtcgccgccaccgtcagcgcctgcccgcgctagccgcccgtgtcgtcgctccgctccaaaccgccccgccgtcatcgccgtcatcatcgactcggccccgtctctccccgcgctagcctccaagggacggaggcagagctcctcctccctctgccgcgtcgccccatcccctcctccttttcccaaagtggcaaggggcaagccccctttcttccttcctttttccttttcccctcgccgccggcgtcatccgcctctgtcgccgttttggccgcgagcgccgagcgccagctcgcgccttgaccgcccaaggtcggtttccaaccgacatcatcgt

SEQ ID NO: 75891 - DNA, 1111 bp, Oryza sativa
gtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttc

SEQ ID NO: 75892 - DNA, 8939 bp, Oryza sativa
agggtgtgaaatagacttctaccattaaaaacgatataaaagtttgaattcatgagttggaaattagggttcccatggaaattcaaaatttttactagaaaagtttagaaagttcgagctgaaagtttgagtggtattgttgaaagttttacagtagattgctaaaggtaaaaaactcactgctcaattatccacagaaaataaaaaaacaatccctctatttatgtgttagcgatgctaaaaattaaggctgtcaaaagagaaactctaggctcgtgagccacttgagctcagctcattcaggcccagttcgggctcagctaaaacttcaaacaagcttaactttatatgacttacgctatttatttagcttgtttatttgttaattaaactaataggtaaaatatgtattagtactccctccgtttctaaatatttaacaccattgacttttttaaatatgtttgaccatacgtcttattcaaaaaataattaattattaatttttttcctatcatttgattcattgttaaatataatttatgtatacatatagttttacatatttcacaaaattttttttaataagacgaacagttaaacatgtgctaaaaagtcaacggtgtcaaatatttagaaacggaggaagtatatatgtacataatgattcagtttgtgtttgtaccatttttttattgatatgattagaaaaataattaattttatgaaaagcattcttaaaatatatgttatacacttatatactatatactacttactgcccagctcgactgcatgagctcaaattgagcctgcttaatagggaagtggattttttttcccttgagacaacatccccttgttttgtgcatggcgtttaaaaagttataaaaaattttaaaaaattatcaagatggatcaatatgtgatatatcttttcgcaaacatgcgagttaaaattaggcttatacaattcaaaacaaaaatgacaaatttgaccgtgaattacatgttctattaatagttaaatttgttatttttgtttctatttgtataagttaaatttgaatttgcatgtttataaaatgacatatcacattttgatctatcttattaattttttttatgaggagatatcttttttaagggatgaattgagttttaatagctccaatgcggaaataggccggacctagaactagggtttaatatttcgtttttttctccatttgtatcgaaggtgacaatattccaaaattatttttttaacaaaatttggtgaaatgtgaacaaataccgccaaattaaaaaaatcggttaaaataatatcattttttatgggggtggggttggggggaatttttttgaaaataatacgattttaatggaaaatcgcacaaatatatatcagtcagacaaaatcgcaagtttagcatcctatcgaacaaccgtggttcgacatggcacctatggaataaccacagttcgacaggtgataaaataatttttatgaaaggaaaaacactgtagcatcacacctatcgaacactacctgttcccttgttcgataggtccctaccgagtactgttgttcgacagtgtattaaacttgtaatttcctcccacccatctatatttgtgccattttccattagaatcgtattattttcaaaaaaaattcggggttggggggggggggggggtttgcggtgtgtggggtggtgaacttgctgacgagctggatcgagggcgccacgtggacagccctaccatcaacaaggcatcagcggcgtcacgtcatgctgaaaaaaacttgtgagccccatccccggaagcgacatttcactcgtagtactccgcaccaacacgcgcaagcatgaccaaagcatttttgtactcactatgcacaaggagctgatgagctggtcggggcactcctcggggtcctgcctctgcaccgacagcagcacgccgatcatgctcctcggcctcgccgccgccgccggcagctcacgcccgtcgccgtcgtgctccatctccttcctctggtcgtcgatcagcccctgcaggaacctcgtccggctctcgcgcagccgccacagccgccgccccacccctcccacgtccacccaccgcagcgccgccggcaggaagtcccacaccgtcgacgccccgctcagcgccatcgtctcctccaccatctccctgaaccacctcgcctcctcgctcacctcgccgtcgtcgtcgctgcacagagttataccagatccatggtggttaaccaaaagaacttacgagtcatgcatcatggtgatcttacgcgccgtagtaggtcttgtcgcagatcatggccatcatggtgttcatgagcagctcgaacagccgcgacttgagctccacccgcacgcgccctgcagccgccccggcgccgtggcgctggcgcgacgccgcgcggcagaggcgtcgcgccgtggcgcgcgcctcgcgggcgtgggcgccggcgaactgccgcacccggtgcgcggagaggatctcggcgacggcgacgcggcggacgtggcgccagtagggcccgtaggcggcggtgcccatggtggaccagccgtaggacaggatcccggccgacggcaggcgggggcggccggcgaacgcgacgtcgtgcgcgccgaggcactcctcggcggcgggcgcggacgacacgacgacggcgacgcggcgggatcccaggcggaggcggaacacggcgccgtggcgggcggcgaggcgcgccagggtgcggtggagcggcttcctgaagaggtgcaggtggccgacgagcgggaggcccggtggctccggcggcagccgcagccgcagcctcccgcttcgccggcgtcgtgcggtcagcagcagcaggaggaggacgagcgtgagagcgatgaggagagtggaggtgtccatggatctgggaactgacgattattgtagcagttgcagttgcagatgcggcaattttttcagccatgcagacacatcgtgcacaacccgccagacgaccccatgtggtgacctgccactaccggcttgattagaccagccaagcagcaaggcccaatgtccaatgtccaatgtggaccatgttctggttctaattttgtttatttctatttttttttaatttaaatagaaaaaatatccgtgcgttgcaacgggtgaagactattttaattgtattattgttagatttttttttgtctaaaaagtatatgggatttttattttgatatgatatccaattcgaaacccttgtatttttaaaagcaaacgaattttaaaaccaacttaaatacggacaacatactaaaactatcagcggaaacaacttcacagcggaaacaacttcagttttaataataaatcacttaatcctaaatggccgaacggaatcatatgttgaaaaaattatgttaaaaagaatcatgtgtagatgaatccttcacaaaataaacggacatgcatgcaagccacccatacaaaaattagtatgtttttcatttgcatgtgtacaaaattattgaaataacacaaacaaatctgtaataaatagtatgtaacatatgcttagaagataggcaatatttttcactgagacagctcgaaataggaagacagattgtgatagacgttgggcccttttacaattttaggcccatatgtgcaaaaacgtattggatgtgcagagaaaaaaaaaaaggaaacgtgaatatggtcaaaatgctaaaaacatatatgaatcggaacaagacggcttgttggaatgaagggacggcggacgaaaattcgatgagtataaaattatcttcaatttttataataggtaaaggttacgacggaaacattttgttctcttttgaagcatttttttgtttttttttgccttttattattttggatggatttttttcacggactggtggactgccttttttattgttgcatacaaaacaaatctttattttttgtttttttgaaggaacgaactttttttcgccgctctgggggaatcagacttttcttctgggggactttttcactcttttttaattttttttacggatggtttttcacctttcttagttcttacgaggaatcggacacgttttctttttaaggcggcccaattaattcgctcagatggaaacattaaattaaaacctatttaaacacgggtgacctactaaaatctcgataaaaacaccttaaatttttataatagtagagatagagataaagaagagatagagatatatggtttagttaagatgaaacacattgtgttaaattcgtttggatatatattttgttagaaaattatgagttgtaattagagtccaatcatctcaagttaacctgcgagttttttaaacagatttcttttacgattccttatatatttacaaaagcaaacgaacttaaaatcaactcaaatatgaatttgtatttataaaggcaaacgaatttaaaaccgactcatacacggatgacgtaccaaagtaccggcaaaaacctctttaatttttataatagtagagatttagagttttttcatctcatctctgaaatttcttttccctaacatttatttccttgttcatttttccttttagcgttcactcctacgcttggatatataatcctcatgtaccttgagatattacgtactccatctatcccaaaatatgagcagttttagctctaaatttaaacaataatatatttataggtaaaagttattatattttaggacgggcttagtagtcatggtcgatcataattgataagaagtactatcattaaaaatttacacatatcatcattggtatctaacagatatcattgttgataaattgatatttatcatcaccggtacctcacgtgtatcatcagtagtacgtacatgtatcatcgtatattcattggtgtttacatgtatcattaccagtacttcgcaagaatcattactgattcctacatttagagcgtccccagcagatctttcatccggtactccatccgaaatatagcgcatgagaggagaaaacggcgctccagcagatacggtatcaaggcctcaaaaaatagaggatgcaccaaatcagggagagttcggccaaatatggcgattctctctcctcacgccaaacctcatcgcccgcgctcctgcccacatccggagttccggatcaactttcctccatcgcaacctccctttcgtcgtcgcccggaggtatggaagtagagaggagagacttactggatctggcggcggaggctcggagtagaggcggaggcccgcccgcccgctcgccgccggctgccgttcctctgtcgcgacaccgccgcccgcgcccgtcactcctccgcccgcaaacccgccgcccgcgcctgcagccatgcggccgccgcccgtcgctcctccgcccgcaaggccgccgcccacgcccatcgctcctccacccgcgaccccgccgcctgcgcccacgaccccacggccgccgcccgtcgctcctctgcccgctccgccaccgcccgcgcccgtcgctcctccgcccgcgaccccgccgccgcgcctcgccgcccgaaaccctcgcccgtgaccccgctgcctccggttgtccgctgagggaagagaagaggagagcagtagtagagaagacaagaggagagcagaagaaaagagtagtagtagctgtacacgcggctgctatattgattttggaacgtttacaaacaaataacgattttacagtgtcccatatcattttatttgtgttgctatgattttttttttgctatgattcactcaattcaaatataccaattaaaaattaccagttaaaattatcactgttaaaattatcgtgataaatagcaccgcgttaaaatttagttgttcaaaatatatcccttaaaaatagaaatgtaaagttagttaaaagatattataaaaaattggatatggtatagatgatctgctggagtaggaaaggatacgagtgaggaatcttttttggatggctatccatatgggcatatggaggatgagatttggatgagctgctggagatgctcttatggtcattggtacctgcatgtatcattactcctacctacatgtactatctgttatccgatactactctgtcaaaaaaaaaacgaattcctagctatgaaccttgacacatataggattggtcttttttttaggacggaggggtaagcatcatcactcgtatttatatctatcagaatggatgttacggtatcatataggtgtcaccaccggtacctacaaacatcatcattggtatccgcaagtatgatcttctatatctatttatatcatcaccgatatttgacatacattattagacgacattgttagtgtatagaagtgcaaattttagggtcatatgtatcatcactttatataagcaaatgccatgatgtaggattgaatagtaagaactaagccaaccagaggggtggatgaatggatgtagtacctaaaaaccgaaacttttagcagaaataaaagttaccatcgaattcaatggagagctcgacgtaatcggtctaaccgccagatctactccaatctgactgcagtgccgccgctggtctgactgccgcattgtcgccgattggattgccttcctgccgccgcctcctcgctggttagaccgcctgtattacttcagtcaaaccgtcgggacctaggaaagcacgtatcgatgaaatacttaaaagtagatcaactttattgcatcaatatgtgtttacgaagtacaccaacaacactcatcaccaaaatctcgactaaactcgaaaccctaacttttctctcaactcaactctctcaaaaaccaatcccaagaggccacaccctccgtctctatttatatccaatataggcagcctaaagctacgaaccaaccttgtacaagacatcctaatccactagaaaacatgtccgtaaaaaaaaattaaactttactaactcgaattgtatcaaatttggacaccctccaaattcaactccgctttccatacgcacacaacaccacatgtattccatatggaaaccttcacctccacgtgcattcttctctagattgaacattccgcgtgatatccttgaccgcccggacctcaacctcccgatcctcccccaagcctagtcccgatccatcaccgactatactcccatggcctcaagcaacacttgcacatgaacaacaactaaactccatatccgagtacaagttcgcactacttgactcacatcagcacataatagcatcacatacaaaaagaaaccaactagaaatcatatccatgaagcaatctagaaatcccacgagaacaacccgaaattgattcccacctagagtctgccggtctaaccgtcgggcaacacgatcagatcgctccaacactaccggtctaaccggcggcacctgcccggtctaatcggccacacaaagtcgagaaacgaaaacactattcaccttatttttataaaataattacttttgacaattgttcatcaccatgattaaatcattacatgactctacaatccctccgtgatgaacacattggcaaaatcctcaaaatgcaatttggtgtttttaaaaaatgaaaaacaaaaacaaataaaaaaaacacaaacaactcaaaaatcacaaaagcaaaaaagaaaaactctctcctttttcaaaagaaagaatttcttcccatattggcaaacaaagcacaaaatcgactattttttaaaagcaaaacaattcaaatccccccggtgacttggtaacaaaaaaaaattcaaatctccccctttgaaagcatgcattttgtatatttctccccctttgacaatgatttcatcatgcatttgcattttaattagtaatgttcaagagcttagcatcatacatagagcaattcatgttatgtgttgtaatagaaagaagatgaacccatcaattaaatagcaggcatgcactagagtataatcatgaatcaaagatattactatcaagttcaaatcaacaatcaatattcataatttcaaataatttataatgcaatatattcacaagcacataggtttaaaagtcaagcctacacatatctttctcaatattagctctagcacaaaacaaccaatagaatttgtaacatttatttgagcctttttgttttactcatttttttctctcatttattctggaaacgtccttgtcatcaagactatttttgaggattcggcacccattattttcgctcacatcgaatacgtccttgttgtcaagactgtttccaaggattcagtattcattttttttctctcatagaaattattttattctcttgcacgatgagaaaataaagagcaatttgaggaataacaattcaacaatcatatacataagcattcatcatccaaactatgtactagcttcaacattgcatttttttcttaattcaagtaaaagaattagtgccatgcaccatctcacttaaaagcaatatctaagcctcataaaaacactaaaatgcatacacaagaatatacaaaatacatggcaaaatattatgaaccttcataatattgctagcatgcacaagaatatacaaaatgcataagacaaagctctccttttcttaattttttttgttattttcagatttgcttgataacaccaagagcaaccccccctctcaaattaaccttcaattttccccggacaaaaatcaagaaggaaacaaagcttttgaaaaagacacccaattgccaacaatatcaccaaggttctcatgaattgatatgtatctacttgtattaaccaaaactactacctcaaacactagcatacgaaaagctaataatcaag

SEQ ID NO: 75893 - DNA, 1716 bp, Oryza sativa
  unsure (1)..(1716): unsure at all n locations
attgatacattgtagttcacatgcaccgataaaaataaaagtattgtaatcgttgctttataattcatcaaataaacgtaaattggtattttattacattataacaaaacgcataatgtgtttttctgaattggtaattctagaaaattgttgtctaaaatccaaaattttctgaacctagacatccatgatccccaaatttatggatctgaaccatggtgtccatgtcgttgatagctataggttggcacctcctttcgatttgacattcaatattctgatgaacataaccatgccagctgcaatacagaactgggagtttacagaaaatgcaaaatgctaagaaggaaagtacatatatacagtaaaataagtttgcagttttgggattgtgctacctacttggctacttctctcttggaactggtcagatgagaagcacttatgcttgtttccatagagttgctaaactcatcagaaacaatccgtaagcttgcttcagaaatttttgtagctcgaacttttccataaaacattagaagtaactatctgtatcaccagtgaaaaagaacaatccatgaatggattatgctgctgatttgatacaaaagacaactgagacatgttaagagaacaattcgtcaagctatttattcagctcaatttgggaagcacagtggaatatccaagtattgaatacaataaagcaaacatctgtttgctgccatcttcttttttaatgcttcaacctgctgcacctagagttcaggtttattgtgtaaacaaagcaacggagttgtatatatcgataaaattttgccaaaccaagattatagcacttgtgcacgactcaccttttttcctaaaagcgagatttttatttactattcaccgtgtttcagttgcagccttgcttccttttgcacaagacacattgcggctgtcaggattaagctggaaatttaatcncaatctttgatatcaaaggaatgcatgcaataattctctatttctcttcctgaaatgattaaaaaatatatgttgatagggttgaccccctgagaacctggatgatctccaaggctggaaacaaaaggggatccattattatttaaacaactcctaataacaaagtgcatagctttttgacaacacagtgcataatttcctggcttactcaagctgaggactacataaaacagaagcaatgattcgccttcagatacaaaattcagaagcaagcatcagcagacacacaattcagaaacaaaattgagagtgaactgaaaggtgtacatttgagtcccagtaatacctatacaaagaatttgcacttttgaaatttaatggatggaaggttaggcacacataacaagaggaaaatgcacccagcagttgctaggaaactcaacaaatttctttgttcagagaccatagtactactatgcagtttcagttattaacttccctttttcccctttttagataaaaatccattaaacttctataagtggtgttagctgtgatcaatggtattagctgtgaactaatcaaatcatcaatctgaggaacttgcatctgacagcaattcaaaaatttccaagaccctagtcaataaatactctatatacagaattaggtgcagatgatatactccctcgataatggcaagatggaattaaggtactcgccacaaatgaaatggtgaggctgcat

SEQ ID NO: 75894 - DNA, 685 bp, Oryza sativa
agctagagactgaactatgaagaaataaaagttcaatcaagcttaagataacaaccatataaaatgcacctgatatcatcttttactctgtgagaccatgtggtgagccttgacttgcactgccttaacagcattcttagaggaatccacgatgcctttagtaaaagagccaaaaacgccagattgtgctgttgttggggttgtgctgccttcagcactctcatcttgctaaggagcttttggagacaagcgcaacccaaggccactcgtgaggcgagaaaatgtattcttccccgttggtgattcttgacctgaagaaggctgtggtattttcaggttttttgcccaggaggataagccagatgtagaaaatatggaggattgtgcctcgcgccctgcagcatcttgtattggaacagcatttggaacaggtgcaggtgaaggggctacatggaatgtactggcaaactgggtggcagaatcatttgaagtagcctgagaaacagggtcaggagttctgacaggaggtgcggttgaatcctggctgtccaccggagtagcaggtggtggatgtgaatcagagggctttacttgctgttctaccatgatcgggtaacagatttaataaacctctttgaagcactagtaaaatttgcaaaaatcattatatacagatataaaacat

SEQ ID NO: 75895 - DNA, 731 bp, Oryza sativa
caaggaagtcatctcaatcgggccgaaaagtgcccgactgatatatggtcgcacagacatgttagatgggtataaaacttaagcccgtcacggatgatacccatcagtgacgggccacaactttaggcccgtttgagatatggaatgttatctcaatcgggcctaaagttgtggcccgtcactgataggtatcatccgtgacgggcttaagttttatacccatctaacatgtctgtgcgaccatatctcaatcgggcacttttcggcccgattgagatgacttccttgtgacggcccgctatttctaagcatattagagcccgtcacagatagaaggatctgtactagtgtggcaaggacgagcagtcgagtagaatggccttgttccagcctgccctgcgctggcgaggttgcaaacctttaatgttattactacggtcgtcgccttcatctgaattacgcagaaccgccgatgcatcgtcccttctaaccgccgcctcgtcaagtgcctcctaatcgactgatttagtctcgtttgtccaacaaattttacctattaaatgacatgcaatttgtttcctaatttacttctccaccgcggtggtttcccctctcaggcatgggggaggtggagttttcgccggcggtggggagtggcggcggcgagggatcccagctagacgccgtcgccggatctagacggtgcgtcggtggcggtgtcgtggggcggc

SEQ ID NO: 75896 - DNA, 693 bp, Oryza sativa
gccgccgtcctcctgcatctctcctcgagctcgaacaaaaaaccaccgcggacgctatcatctccaccacgtccctctctttctccgcctcctctcgtcggcgaccaaagtaaaaaaaaaaaaaatacagaagcaccaccgcgcgtctccacgtcccagaagaaaccgcatcagcctgcgtcgccggaattggctaactcgaagaaccttagcttctagccgccagcatcatcaatcatgaaattcgccaccacagtgaccactcgttctcaattgaaggtgccagcctcttctacgtgttcttccctcaccttccccgccgagatagctgtcagaactctccagcactgccccatcgccttcctgctctgttcagccgccgtcggcctgcacggtgtccggccgctccatgcccaaccacggccaccaccacgctcccctccccttgaaacacaacgacccccaccaccctcaccgaggatcatcagagccgccgccgccatggacaacaccacctttctggctttctccattgctcgttgtcgtcagcttcgccgccgtgtgcccatgaggcaaatttttcgtccgaaggaggtacgtagctagatgataaacagaactgtttatttgacgcgcgccacgggcgatgatggacgaaatcggactgtgaaatacaaatttatggacgacgat

SEQ ID NO: 75897 - DNA, 1751 bp, Oryza sativa
ggtgataacttgactgagaaggcaccgaatccgttgagaggtttactggtatataattaaagcgctcacacattagctaccgaggaagatattcctatgctctatcttatatcgattgattggttaaactattgcaattgcctcattcatcctattatcatattaacaaagtacggagattgaaaaaagattagccacctagtttttttggtcagaacgaaatgcagtcaactctggtgaaactcagaagtcggtaacatagctatgtgtggttttgttcactactagaaaaaccatttttccaggtgatgatatatttttgccaaacggataggcctctcggaaccaaatgatcgcctatgaaaatgtaaatgggggttgagactgtcatccgcctacgaaaatagatttttgcaggcggatgatataagctgccatctgcggtaatcattttcataggcggactagataaggcatccgctaatcgcagggcggatgccttatgttgtccgcctccgaaaatcgtgcctgtaactcaccctaaaataatatctaagtcatcttatcctttcctccaccatcatcctctccatcaccatcatcctctccaccactcatttctctccaccacccttctctctctcgcgcacggctcagagggcaaaggcggcgtcggcttcgaggaggagtggctgggggaggggcgccgttgacggtggctccgacgaacagtggcgacggcaacagcgacggcacggccagaggagggagggtggcagcgggtgagtggtgtttttttttgttcgccgataacattttcataggcgggtggctatagcgcatgcgaagatggagatgccgcctgcgaaaatcatttttgcaggcgggacaaatgtccgcctgcaaaaatcatgtattttcacaggccttgaagtgcgggggaagtagatggccacctggaaaattcgttttggcctgtttatgttttttctagtagtggttgtgggctaaatttctgaattggctgaatcttttgggagacctgaacttactagggacatcatgcttaaattttggcagaaaccagatgaccctaacctgaaggttaacgcactgatggtgattttgatgataacacccgctcaaggtggctggggttttgttgttagggatactgatggccaggtggttgaagcagatgctggaatggaagcttatcgcacggctcttttttatgcttccgaagttggcaggggcgtgttaccttaaggtaatggcctacaaagctctatgcttggggcgttatttagagaggctaaatatctcgtatcaacatgatttatagaagtataaaggcttcactcctaaagaactgatctttgatcggatgccaaaaatcatatttttagccacgattcaatagctgttagctcatgtcaggctatatttagtccaggttggtgttaccaacccggactaaagatgcctctagggttagtttaaaaagaaaacatcgccatctaagttagatgtgtgtagtaggtaggatggtaacgcacgtaagggttgagatgagagatctttagttcgaattctacatcccacacatttttttgacttaatatgcatctttagtcccgattatttcaaccgggactaaagatgggcggattatgcatccaaaaaacggttgcgaaccaggactaaagtccctttctccacagtgcttactgtaatgctagattatgttt

SEQ ID NO: 75898 - DNA, 8549 bp, Oryza sativa
ctgcagcccgttatctactgcaatggtagtaagtacacatttcatgcaaaaaaaacaaaacagcccaagttaagctaaaagtttgaaggaagatgacaccatgtgaatctctatcagcatgagttttagatatcagtagtaggtgtgcacggttttatgaaatcttatacctggtgcttggtgaggcggcggcggatggcgcgggtcttcttggggcggaggtcgagggggaggaggctcttcttcttgtacgcctcacgcagcgccgccctctgcttctgcgagatcaccgtcagcacccgcgcgatcgacgtgcgcaccaccttgctgcaaaaccacagagattcaatcaatcacaagggcacacagaaagaggagagaatgagcgcgagcgcgagcgcgaagcgcgtacatcttggagagcttgttgggggcgccgccggtgaccttggcgacgcggaggagggagagctccgccttgaggtccttgagctgggcctgcagctccgccttgttcttcccccgtagctcgtcgaccttgatccgggctgcaccacacacgcacggttagatccgcaggcgagcgggaggagagaagaacggaatgttgtagcttacccatggcgacggaggcggcgcggcgggcggcggcggcggcggcggcggcggcggtgctaggaaggggaagaggtgaggaggcggcggcggaggcttatatatagaggagagagagacagcgagacgccgcggagtggaaaaaaaccctaggctgagttgagatgggctttcatgggccttgttgggctttatgatagatggctgggcccattgactgtttaaggtgagttgaaatgggcttcccataaggattcgaggatttggatttgtcggttttgatgttaacagctcggagatgacagtttaatgcaaaatttaagttttagcttgagtttttatatacttgaccggattttagtgaacttttagcttgagccggagcaataaagctgatgatacctgtggttttcgagcagttatcatcggttttgtgaatgtcgtatttcacgactatgctcgcactatcagaattgtactattgaagtacttacttgacaaatgaattgtggagatcatggataccccatacatacacggcatgtatagtttgactgggtatggagtgctatatatagatagaatatctttaaaatgacttgggttaaattctaaacttgtatgtcaaggtaatacccaagatcctagtcggttacgattgtattttatttgtaactacctattccgttagggatatggactgtattttgtaatacggaccccttcttctatataagaaagggtccaggtgcctctaggggcacgttttttcacccagatcatacgatcaataatatactcggcagatcaatccccggacatgagtagggtactacttcttgattaaaaaggcctgaacctgtataaaattccttgtctcttaaaccatccacttttccagtttgatagccaccccctttagtattgtcgaaatcttgttttgacagttggcgcgccaagtaggggtagtgtcaagtacttcgccgactaatgcgatgggtttcgtttccgacatcgacgacttcgtcttccctcctaggcaggcgttccggttcggcagcctcgacttcatcaccaacgacctcgtcaagatttctctcctcgactcggattcgaaccagtcgggaagaagccagatctccgccccgttcggtatcccaaactcggccaagatctaccccaagatcgtctccaccgagtcggcttcaaaccactcgaacgagatccaatctactccaacacgactcgatcaagacgatggggcctatccgccaatcctgatgaaactccccgatgatttggctgctgtcttcaccacaagggcatcttctccccgtagatctaggcgggatccggcctctaccccgatccagcttagcaccagagaagtcggcatcatactccagcctctcagcacggtttcgacggaacaactggatggctacctcagctcccccggcgtcgactcacggccaacggagatcattgagtacaacgacttcggctgccgctacgactaccgcaacctcgacgacttcgacgaagactttgaagataactacacgcctctctacttcggcatcttcatggctgacaacgagatggaagaacagcgtaaagcccaagaagcagaagaacaacgcgtgcaacaggaagccgaacgacgccgactggaagaggagcgccaagcacaagagcaagaataggctgcaaaagaggctgaggaccggcgatagcgcgctttggatgccgggtgacgagcacgagaacttatcgggcaacaagacgttgacggaacggcggtttttcgcacccctcaacagaacgcagttgcaacgatcaccctcctcgacaccctcctcaaggaagacgcactcaatcaagccaatcacgtcgtcaacatcttgaaccagaccaagatcatgatcgccgtctcggtcccggttaactctgcaagcgtccgcacgccgactggcagccgagttccccctcttcgatctcaagactatcaccaaccaagcctcagtgtcgtcggcgcgggatctagtcgcaggagcaggggtcacgacgagcgatctgtccactcgcctcctgaacgacacagggagcgtcgagttgaacgacctcgctccccacatcgcaggcgccctgtcgatcttcgcgatattatcaaccagcgccgcgcggcaagaggatacgttccccaccattcaccagatcgctacgacgacgacgtggatggagttgctgccttcacaagtgaactgcgtcgagtggattggccagccggcttcaagccgactggaatcgagaagtatgacggcaccactaacccggaatcttggctcaccgtctatggtctcgcaattcacgcagcaggaggagacagcaaagccatgacaaactatttgcctgtggccctagcggactctgcccgatcctggcttcacgagttaccccgtggcacaatcggatcttgggcggaacttcgcgaccacttcatcgccaacttccagggtatctttgaacgccctagtacacagtttgatctctacaatgttgttcagaagtctagagaatcccttcgagattacatcagacgcttttccgagcaacgcaacaagatctccgacatcaccgacgacgtcatcatcgctgccttcaccaagggcattcgccacgatgacctagtcggcaagctcgggcgcaagcctcccaggacggtcaagcagatgttcgaaaaagccaatgagtacgccaaagccgaagatgccattaccgcgtccaagcagtcgggcaccacttggaagccgaagaaagatacgccgactacaggggggagtggaagtaccaatcacaaggatcgcaagcccgaggaacttgtggcaactactacaccatcctcccggcaacattcacgggtcaacacttttgacaagatcatgaactcccaatgtccgcatcatccaaactccaatcacgcggccaaagattgcttcgtctatcaacagttcgcagaacaatacgccaagaatgcacgcaaggcctctgacggagatcaaagcacgtcaaagaagaaggatgatgaagacaacgccccgactggttttcaagaccatcgcaaggaactcaaccacatctttggcggacccctggcttatgaatccaagagaaagcaaaagctaaccgaacgggagatcaacgctgttcagcccgacacgccccaatatcttcggtggtcagagacaacaattaagtttgaccgctcggatcatcctgaccgagtggtccacccggggcggtaccccctggtactagacccagtggttcgcaacgtcaagcttcgcagatccctcatcgatggtggcagtgcactcaacatccttttcgccaagactctggacgacatgcagatccctcgcacggaattaaagccgagtaatgtgccctttcacggagtcatcccagggctatctactacaccactcggccagatcattcttccggttactttcggcactcgggagaacttccgcacagagaacatttgtttcaaggtcgctgatttcgagacagcgtatcacgccatactcggacgcccagcgttagccaagttcatggctgtcccgcattatacctacatgatgatgaagatgcctggtcctcgaggagtcatatccctgcggagtgacatcaagcaagccgtcacgtgtgacaaggaaagctgcgagatggcccagacctgcgagatcacgctcgcccgagaagaaatccaactggctgcgtccacagcaagcgaaggagaagtgcctgcgaccaagatgccaaagagcggggaaagcgacaccaagaccaagaagattcctctagatccctctgatcctactaagacagctgtaataggcgctgagttagattgtaaataggaaagcgcgctcatcacctttcttcaaaataataaagatatctttgtgtggaaaccatctgatatgcctggtattcctagagaggtgattgagcactctttacatgttaaggatgacgctaaaccaataaagcaatgactccgccgtttcgcacaggataggaaggatgcgatcaaggaagaattgaccaagctgttagcagcgggcttcatcaaggaagtccttcatcccgactggctagccaacccagttctggttcggaagaagacggggcaatggcgcatgtgtgttgattacaccgacctcaacaagtcttgtcccaaagatccatttgggttacctcgcgttgaccaggtagttgactcaacggccagctgcgagctactcagttttttggattgctactcgggatatcatcagatccgactaaaggaatccgactgcttaaagacttcattcatcacgccctttgaggcctactgctacatcaccatgccttttggattaaagaacgcaggagcaacttatcaacgcatgatccagagatgtttttcaactcagatcggccgcaacgttgaagcatccgcgcttttaggatgaaattaaatcctgaaaagtgcatcttcggagtaccgtcagggaagctgcttggatttatggtgtcccatagaggcatacaagctaacccggagaaaatcaatgccatcctcaacatgaaaccgctgagctcctagaaagacgttcaaaagttaactggctgcatggcggtgctcagccggttcgtctcacgactcggcgagcgggggatgccttttttcaagctgttaaagaaaaccaacaatttccagtggggacccgaagcacaaaaagcctttgagtacttcaaaaaacttctcactactccaccagtcttagcttcaccacatccgcaagagccgttgttgttatacgtgtcggcaacttcccaggttgtaagcacagtcctggttgttgagcgtgaagaagaaggccatgttcaaaaattccaacaaccaatctacttcgttagcgaggttttggctgactccaagacaagataccctcaggttcaaaagctattatatggtgttttaattaccgtcaggaaattatctcactacttccaaggtcactcgattacggtggttacatcgtttccactcggggacatacttcacaatcgcgaagcaaatgggcggatcgcaaaatggaccttagaattgatgtctttggatatatctttcaagccgcgaacttcgatcaagtctcaagctttagctgacttcgtcgccgagtggactgagtgccaagaagacatgcccgtggagaagatggagtattggactatgcattttgacgggtcgaagaggctttcaggcactggagcgggagttattctaatttccccgactggagagaggctgagctacgtattgtggatacatttttctgcgtttcacaacgtggcggaatatgaggcgcttcttcacggactaaggattgcaatctccttgggaattcggcgtctgatagtttgtggagattctcagtcggttattaatcaagtcatgaaagagtggtcctgccttgatgataacatgactgcttaccggcaggaggtacgcaagttggaagacaaattcgatggacttgagctcacccatgttcttcgacacaataatgaggcaaccgatagactggctaattttggttcaaaacgagaagcagctccttccgacgtgtttgttgaacatctctacgagccatccgtaccaaggaaagaaacaatcgaggccacggacactcaagacataagcatgattgaagtcgactggagagagcccctcataagatttttgacaaaacaagaactccctcaagataaagatgaagccgagaggatctccaggtgcagcagactttatgtcatacatgagaccgagctgtacaagaaaagtccatcaggaatcctgcaacgctgtgtgtctttagaggagggaagacaattgataaaggatatacattcaggcatctgtggcaatcacgctaccgcacgaaccatcgttggcaaggcttaccggcaaggttttttctggcccacagccgtgtccgacgctgacaaaattgtgcgaacatgtgagggttgtcaatttttcgcctgacaaactcatctaccggctcaggagttgcaaaccatcccgttgtcttggccgttcgcggtttgggggctcgacatggtcggcccgtttaaaaaggtagtcggtggttatactcatctctttgtagctgttgacaagttttccaagtggattgaagccaaaccggttatcacaatcacgacagacaaggctagagatttcttcatcaacattgtgcaccagtttggggtacccaatcggatcattactgataacgacactcaattcacgggcggagtatttaaagatttctgtgaggacttcggcatcaaaatttgatatgcctctgtagcgcaccccatgagcaatggacaagtcgaacgcgctaatggtatggtacttcaaggaataaaagcacgagttttcgaccgactgcatccgtatgctggcaagtgggtagaacagctgtcattcgtactttggtccctgcgcaccactctgagtcgggctacgggccagtcgccgttattcctagtctatggagcagaagcgatgttgccaagtgaggtggaatttgaatctctacgatttcgtaacttcagcgaggagcgctacggagaataccgagtagatgatctcaaccgactagaagaagcccatgaagcagccttaattcagtcggctcggtacttacaagggatgcgccgttattacaatcgcaatgttcgatctcgagcttttttagtcggcgacctggttctgagaaaaattcaaactacacaggatcggcacaagttatctcccttgtgggaaggaccgttcataatttttgaagtcactcggccaagttcttaccgactcaagcgtgaagacggtactcatatcgacaactcttggaatattgaacatcttcgtcgtttttatgcttaggcattacttttgtatcttcctctttgactgttaacatcaagttgtcccttgatttatcagtcgggggctactataataataatggagtgtgatttttatcaattcaatttgcttacttgatttatcattgccttgtttgattttttggcttagccaatgaggactggaagtttttaaaaaaacttttgcgggttctaggctcaataaggtttgacaaaaacttttaagaaatctggagctaagtttaaatcatcaagcacagcataaatttatcagtattgcacaaattgtgcctccatcatcatcatcattatcatcagaatacacaatcaattagactcagttctttcatcatcagaattatcagactcagtcggcttaagattgttgtcctggaatctctcaactacatcagcggctatcttgtcagcagccttttgcgcatcactgatgaggtcaagggcggcctcttcacttgtcccgtctgcaaagccgtcaacagcatcaatatcaattttcgggtataaggacttggtcatcgccagcgctaggcctcctcccatactcccagcttctttgatgttcttaaaatatgtatccggagtagctctcagcttgtcgaagatttcgacagcatcaagtgaactcagaccgttgttattgaaaaacatcgcctggacgagtggcgtagcggcattggcgacttcatctctggctccttcaagcttcttaattttgttaaccaagacgttgaactgagcctgggatttgattttgcgatctgcgcaaataaattcacattaaggactgggcatgaagatgagagtggtttttgaggtttcgactaccagtaccttcgacatctttcagagctgagtccctctgttttgccaattcggccttgtctttctccggagcttgg

SEQ ID NO: 75899 - DNA, 734 bp, Oryza sativa
agacagtaaagagggtgggtgaaggaaaaaataattcttccgcctccatcaattctccattttctttgccaggcatagtctcagaatatttcgttatttttaaatggacaacaattgttaggaaagtatcttatttccggtcagcattatgctatatagtcacgcttctaaaatttttttaaaaaaagacctctgtggtactgatatatggtataaacaggcatataacacctgaataattgaggcgaggcaatcgtgggagagaggcaattctgtacccctgtgcccttatcgttttgaaaagaagcaatttttgtagggtggcaataacatacagcactcgttataactcagtgatacttcaggcaagaaaaccaataggagaaattgtacatcaagtaggagacattaactgtacaacaaattgtacaccagtaaagtatataaccaattgctaaagggacgttaaccgtataactaataggagaaattgtggttacctttggttcctgtccgaactgtttgggaggacccaaagggtaattgggatttgaagaatgaagcatggtgtcgaccaactctggaatttcagttgttcgctaatacttctgctaggtgatggcgatggtccataaaacaaatgctatgccacatacactcaaacaatattaccatttgacaccacttaagaaaaaaaaaacgaagggggaggagaactgcgtcttacactgagc

SEQ ID NO: 75900 - DNA, 720 bp, Oryza sativa
tttgaccgattagtctctcctgcatgcatgcatatatgtatgtatatactttatatacatacgtatgtatataaagtatatatgtgtatatataggtaaattaactggtgctacatagagtatgggttccaaaattcaaattgagaatatacctaatttgaatgagtatgaaagttttttaaatgtttagatatgaacattaacttctttactaacaagttttttagattttggttctaggtatataacatttaaacatataattcgttaggtatgtaataatgaattgtgaaataaagttgagtttgagttattttgttgttaggtatttgtatgaatcaaattcatatacctaatatacctaggtatatactcacaatttaaaaatttttaaaaatttgagagaatttgtgtgttttataccttggagcccgagcaccatggagtcccatatgggtatcatatatatatatatatatatatatatatatatatatatatatatatatatatatatatatatatatatatatatatatatatatatatatataaagtatatatatatgtgtgtgtatatatattgtatatatatatttttatgtaaaaaaatatgtacatatatacaaaattcaaaatatatatatacaaattttgtatatgtacatatgaaaaacacatatacaaactttgtatacgtgtatataaaggttttatacg

SEQ ID NO: 75901 - DNA, 2834 bp, Oryza sativa
tagcatgtgtagccccccagtagctagccggcgccgccctgactgctgccgtcgctcgccgtgtgctcgccgccgtcaccgcccgagctcggaagcgcctctcgtcgccggcctccctcgatgcgattcctcctaatccggcgcaaggggtggattcccgtagccgcgtagatgctctcaccgccgagaatcggcccctcgtgacctcgtcgccgtttcccccttttctctccaccggttgccgccgccgcaatccgccgccgtcgagcatcccccggcgaatccgagccattggctcgtctccccttgtcctgcgcaacatcccggtgtgctcgccttcgcctgtatcgccatggtttgctccgccgcttgccgctgtcgaccgccgtccgttccagccggcgtcgtcgtctacctcccgccggcccgcgtggcagccacgtaggcgccacgtcggcgccacctcagccgcgaccgggtcaagtagaccccggtccgccgcttccctccgcaccgcgtcctccgcgaaccgcgcgcatgcgccgcgcctccctccccaaaccctagcacgccccgcgtgcacctcgctcacggtgagccgagtcgtcgacaagcgggtcccacccgggaccacgcgggatggacccgacccactggctctctctctcccctccccgcccgagccgccccattctctcgggccgcgccctcaaatctcgagatgtatctaatggcacgcttagaggtcaataataaggctttattttcgccatttgctgagttgtcccgtttcgcgtgtagtttcggagcccgaagacccgcagtgcgaggatttcgaggatcaagctcaagatctcgagcgaggcaagccacctttgaacatcttgagcctatatttgaacttaattatattgcttgaaaaatattatgcattgataggatcgcacttaatctgcttgtcccgtctgcaaggcagattggcggacctacctaatttgttgcatttgacccttccattgtaattattataccatgttcccttgtatccacctagttgcgcctcggtaatcgtgcactcggcacgggtatcgacggtcgccttcaaacttaaaatctgagaaacttcttgtgtaaaacttgggttttacaaaagacttggaaaacccgacacctgggtcggtgcttgcgaactaaatgaatttccaaaatcgcggaccgaggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgccaagagacatgtggattcgccggggtggtgtcggggaggacctctgggcttcctggcacagtatggtctgggacctaatctggtgttggtctaggacccctctcgttggcatatggtgaacctgtgttggctttcgaaatgccttgtcatgaaagccttaaggtctctagtcgtggccgttctgcacgggctggatgatccgggttagtaatgtcgtgtgggtaaagtgtacccccctctgcagaggttattaaaactgttcgaatagccgtgcccacggtcatgggcggatgtgaggtgattcctagcgtagtttttgtttgactactgccttgtgaaatttgctgttgtggaatgggtttgatgtttggaaaatctgcggctgatgggatcagccaggcctgggtggccgtttgaaagctgttggccgggtgccaatcttgatcaattcaaaagattgaatcattgcacatactccgaccggacgagacgcactgtctcatccgtgtcgtttgagaagcactcccttagttgtttcagaaaagagtttaaataaaatcaatcgcaaaaacaacagcctttctttgaagcctgcattaaacacttatttcccatggcttgctgagtactcctgtactcacccttgctctatataaataatccccccccccagttgctgaagaagatgaagcggatcccgctgatgaggagttcttccaggagcaagccggctacgataagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattccgtcttcctatgataccagcactgtttcctgggactggtatcggttaacaggttaatttggagcgtcacgggctagttccgcccgggactagttcggggcgtgacaagcactccttacaaaattttgactaaagtcgaaaccctaactcaaaactcaactcaattgctctctaaaaacgatactggaaagccttacgctccccctctatttatacccgaggtaagcagcttaaagccacgaaccaaactcatactaagagtcctaaacaccttaggaaaccctctagtacaagaaagaaactttacataaccaatcgtaccaaatttggactccttccaaattcgactccgcatcccacacgcacacaatacctccatcgtatgccatatagaatctccatcaaccacgtgcatcaactctagcctaagtatcccgcatgatctctgaccaccacggacgtcgtcttatccccaagccgactcccggtccatcaccgcaaatactcttccgaggcatcgagtcacctacacatgaaataaacaaagaaaccatattccgagac

SEQ ID NO: 75902 - DNA, 1937 bp, Oryza sativa
taccctcgaaatcgacggagatcggtctgaccgagattgatctggatcgaagcgtagccgccggtctgaccggtgttgaatctctggtctgaccgccgaaatcacctgccgcgcctgctgccgtcgctggtctgaccgcccgtatgccaccggtctgaccgccgcttgccgccggtctgaccgcctgtatatcgccggttagaccgtcgaaacccggtgaaacacaaatcgaagaactcttaaagtagatgacgactttattgattctctctgtgtttacaaagtgcaccaacagcactccttataaaatttcgactaaactcgaaaccctaactcaaaactcaactcaattgctctccaaaaacgataccggaaagcctcacgctctccctctatttatacccgaggtaggcagcctaaagccacgaaccaaactcatactaagagtcctaaacaccttaggaaaccctctagtacaagaaagaaactttacataaccaatcgtaccaaatttggactccttccaaattcgactccgcatcccatacacatacaatacctccatcgtatgccatatagaatctccatcaaccacgtgcatcaactctagcctaggtatctcgcatgatctctgaccaccacggacgtcgtcttgtccccaagccgactcccggtccatcaccgcaaatactctcccgaggcatcgagtcacctacacattaaataaacaaagaaaccatattccgagaccaagctttctccaacttgactcattagtagcaaacaacagtattatatacgtaaggtatccatctagaagtcataatcacgaaataatcacggatatccaaacaaacaacccgaaaccgaaactgacacagagtcagccggtcagaccgcgggctgcgccggtccgaccgctcgatcaccgccggtctgaccggcatacacagtccagtttgaccggtcacataaaatgatagaatcctgcgatcacctgtgaattcaatcatctccaaaaccacttcatgaataaattccaaataacaaaaccaataatctccgatgcccaattgttcatcacagaataataatcaaaaacacctttgattttacaatctcctccttgatgaacacattggcaaacccatcaaaaatgttttggtgttcggaaaaataaaaacaaaagtggtaaaaagcacacttcgtacaaacgtatacatcgtgctcgaaaaatccaaaagaaaacttctcccccttttcaaaagaaagaaattctcaattgaaccaaaaacatgctcttctcaacaactctcctaaaattcaccttgcttctccaacaatccaaaaattttcatattacttatcccccttttgacaatgatttcatcatgcatagaaattatgttcattaatgttcaagagcttagcatatatatagcatatcaagtcatgtgttgcaataaaaagaagatgaacccatctataatataacatgcatgcattaaagtataaccatgaatcaaagattttacaattaagcttgaatcaacaatcaaaattcatgatttcatacgatttataataaacactaaacacatatacttattgcatttatcactctttctcaaataaactttagcacaaaataaccaagagaaaaatttttttcaactttttcttttcttgagcctttttgctcatatttttctcttttattccgggtacgtccctgtcgtcaagtctgtttctagggattcggcacccattattttgctcacatcgaatacgtcattgtcgtcaagactgtttccaaggattcggtattcattttttcatattttttattctcttttcacaataagcaattaaagctatttgaggaataacaagtcaataaagcatatatataaagcatttatagatcaaaccatatg

SEQ ID NO: 75903 - DNA, 8280 bp, Oryza sativa
attccacattttagttcttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctacctacggccggaacccccgggacaggcaggcaggattgagctccctagcagcaggacaccagccctgtgccatgacatctcgactaccgggccgcagctcgtgtagccttcatttgtcctagagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtatccaaatgatatgagatttcccaaagtctaaagttataaaaccacctaatgttgcctaattatccagcgaagcatctacctaagttcatactagtggaaccataaatagagtacccactagttggggttttattttcctagggtgaacaaggtaataataacaatagcaacaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgctttgggaacctccggaacgatgaaagctacgcgaagcacacaagcaaagctacaagcctataaagaagcaataacaatacataaaaacaaagcacagggttctttaggttataacaaacattaagagacttgaacggatcgattcggagttcgtatgaccaagatatgatcatccgaagtttaatgctgttatatggggatttgcggattattataattaagctttgcaactataaaacatgtgtaagcgctagcctggaaaagacaggaaggctgcgccgttgacatgcggaccccacatgtcaacctaaaggaccgcggtagaccgagtacacagaggcggtccccgggtcgacggaagcagaccccgtgtgtcaaccgaggcgagtggccgacaaacggactccattaaacaacacacggcctgcacacgtggaaaccacgcggctaccgagcgggcacactaacacggacactacacggtcaccacccgcacgcgtgaacgactaccgacaccggtacacgggtaccggggtcgacgaccgcacaactggtacggggcgacaccggaagaacaaggacggggcagcgagaggggagaccttaccaccactcgacgaggcgagggaacgacaacgacgaacgggcgcggcggaggcggccgggaactacggagacgaacggcgaggggacgacttcggcggcgatcctaggacgaaggcgagacgcggccggcacgaggcttgacgacgcggagccgtggacgaagacgaggacggggctgcagcggctcgcttgacgaacgcggacgacggacgagaacggctcgacggagggacgaacgccacgacgaccgggaacgacgagaggacgacgacgacgacgacgaccgggaccggcgaggaggcgacgaggacagccggcagcggctgcacggggacgaggacggcgtggaacacgccgcagcgatgatgatgacggaggcggcgccgcgagacgacgagccgggcgaccgacgggacgtcgatcggcgaggacgaacggtgacgaggaaacgatgatggcaggcagcagcggctgagcggaggaggggacggcgtggaacgcgctgctgcgatgttggagaaggtggtggtgcagcggggcgacgagccgacgaggaggaatgggtggccgaaaggacgccggcgacgaagaggatggagaggccggcgcggcgacggcgttctggcgaaaccgaggagcagccggggtggagggcggcgtcgcggagccgagggaggtggtggcgatgtcggccggctcacgggaaacgcgacagtggcggccggaggtggaacagtggcggcaacgccactgttttgccggcgaggacgcgtctctggtgctttccccgcgaaacggagggctgaccgagggagaggaggtggctgcgaggccgagggagaagacggcgcggccggacggtgctccggcgaggagggagaggcggctggaggcggccggcgcggaggaaagagaagggcgacggcgggaacgcgcctccggcggtcaccgcgcgaaacggagggcaggccggggtggaggaggtggcggcgacgctggaggaggcgacggcgcggccggccggcgcacggtcgaggcggcacaggcggcttgtcgcgtcccaaatcgactctaaaattcaccctcgaaattgtgcaaaagaataagtaaaattcaatgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagtggaaaaggtttataaaaagaaaatcctaaaagaagtctgcttttcccccccctttttccctcttgggccggctcggcccattccctccctctccctctctctctctctccttccccgcggcccatcggcctccccgcgcgcgcgcgccgctgacaggcgggcccgcccgccgctctcgctgacgggtggggcccacctgtcatcttcctcctcccgccgcgcccgccgccagcgcccgtgccctagcgccgccgccgccgcggattccgccgcatcccgccttccccgcgcgccataatgaggggggaattattccccgcgtttccctctcccgattccccctcttttccctctctctctccctcggattcgttcgaatcaagcccgtaatcctcgccggcgtattcaatggagccgagatccccgcgcccgtttcctctctctccggccgctctttccttcccccggcgctataaaaacgttgcccgaactccgctctttcgtttccgccgcttgccgctcgctctcgccgtcggaatcgtgctagcgccgtgctcctctctctccgccgtcgccgtcgaccttcggttagccgccgccgtcgctccgctcttcttcccggctcggcgacccctccttcggcatcgccgcatcgccgccgaccccgtccgccgctccgcttcgcccgccgaccgccggagcaccgtcgtcatcatcttcccgaaccgcgccgccgtcttcctccgctccggccgccgttctcgtcgtcgtcgttgtcccggggtgagccaaggaccgccgttcgccttccccctttcctcctctctctcgggtgccactccgccgcgccgttggtcgccggcggcgaccatcggggcgcgggtgcacgccgctcccgtcggccgcgccggcgaggccgcccttgggcgcgccctcgcggctgccaagtgggcccggccgtcagccgcccgcgcccgcgggtgcggctgacgcgcgggacccacggcgccgacagccgccagccgcgtgcgcccggtccaccgtggaccgagcggctgacgcgtgggccccacttcccgtggacccggtccgcgcgcccgcccctcggctgacgcaataatccgtgtttttaattgaaaattaaatgaagaaattcgcaaatattcatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgagtgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattattaccttgttcgctctaggcaaacaaaacctcaactagtggactctctactcatgacaccactagtttaattttaggtagatgcttcgcaatctaattaggtaaccttaggtggttttataactttagacttgggaaatattcatatcacctggatactctggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccaggacaaatgaaggctacacgagctgcggcccggtagtcgagatgtcatacggcggagggttggtgcccaatgctaggggctcagttctgcctgcctgtcccgggtatcccggccgtaggcggaattgggtcggtactcttgtctaaggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaaataaaatgtggaatggttggcctgggttggcttgggacgagctgggacccagggtcgggttgccagttcggtctgaatcatcgtaggccttgggttaaggcaggttcgtgtgggttcacgaccttgattaataatactgtgtagctctaggatcgtctttataaaatagctttgggcaaataagtgacttttaaatgctgtttactgcaaccctaaccccttatgttataattcctttgtactcccttgcaattattctgcatttgtgggtgtgtcttgttgagtacggtggttgtactcagtcttgctcaattttttccccaagcccagatgaggagttccttgaagatgaaggctttggtgtctagctcgtgcctgccgtcaagcgcctgtggtcgtcgccctagtcttccgctgtttctcgttgtctttgagtgtgctgggccttcgttgcccgtgtaataattttatttacgcttccgcttgttaaactctgaattgtatcaacttttggtgtaccttgcctcctgggacaaggaataatacacgcacgtcaggaatgcctgttgggtgatttccggtcgtgacacggctggaggcggccggcggcgtgggagagagaggagggcggcggggagatggctagggaccacggggaggctcgggagggggctaaaacgagagaacgggggatgaggatcccattttatatgagagaagagggagccggccacgggggaggtcggaacggcggcgggaatggcggccgacggccatggaaagcggccggacttggcgcgtccgttcccggggattgaagacacgaatcaagggggaatttgggggcaattgaagaggattcaatggggattaaaaccccccaattaattttggaattggccaattgaatcaagcggatttggaggagggagcgagctaggtttccgggagagagagagaggtggccgggcggctggaggagggagacgacgcgcctaacgcgtgggccccacgcggtcgggcgcgcggtcagcgcgcggcaacggcgcgcacgcgcgcgcacgcgcgcgcacgcgcgcgcacgtgcgcggcacgggcgggagggcgccgctcgggttgggctgggcggccggcccaggaggagaggagggggaggcggcttgcgccgggcaggccgggaggggggggagagacagcccgggagagagagggaggagggagctgggccgaggggaagggggcccaagaggagggagagaaggagagggagagaaagagagggaggaaagggagacttcggccgcgggccgaggggagagagggaggactttgggccagacttggcccaaaggaggaaggagggttatttttaggtttttctttttaataaactttgttaattgtttttgttgcttaataattatttccggtgctataaaaattcaagtaaaatttgagggctccttttagaccaaggagaatttaacaaaaattctccgggccacatttgaatttttcttgcacgtattttagtgtttgccaatttctttccgaattttaattaattctattattccttttagaaaatgatttttaattcgggatgaatttatcaggacgtgacattgcactcttgctggaccaacagtgtccatatgtaatagctgtctcggtgcatccgtcatcacagaaacaataggagtatatgaagaagcaaccatcttagcatgacgacacggtgtacaaaccaaatcaagatctttcttaagtttaggcaaaccacgaacaagatccaaaccacttaacctagtgagatgatcaaaaccaacatgttcaagtctaagatgccaaaacatcacatctttatcaaacctagcaaccaaacatgttataataggtgaaacaggattttcaaaatcagctttaaacacacttccatagcgagaaatattcaacacaaaatcaccacaagaatcaaaaactttacttccagttttcttaaagtgaacctcaaaattttcatcaacaatttgtgaaaccgaaagcaaattgtattttaagtcctcaaccaaagctacattcttcaattcaaaattttcatttaccttaaccaaacatgtaccgagaacggcacttgtagaaccatcaccaaagataatcgattcagtcttagatgcctttttgagagaggagaatcagtttttatcaccggtcatgtgctgcgaataaccggaatccacgagccacacgttctccttccttgccaccaaagcctacacacaagcagaagtcgaagcctcagtactggggttagatgataataaaaatttaggaaaccagtactgagacacacgaccagaagatccaataggcatatatccacgtgcaaaatcaattttagaattttcagaaaaattcctccgaggccggtctaaccgaggtacagtggccggtctgaccgcctctgtactgccggtctgaccggtcgccggtctaaccgcgggacccactgcggtctgaccggtttcctcgagggaaaactgtcacgtcctgataaattcatcccaaaataaaaatcatcttctaaaaggaataatagaattaattaaaattcgaaaagaaattggcaaacattaaaatacgtacaagaaaaattcaaatgtgacccggagaatttttgttaaattctccttggtctaaaaggagccctcaaattttagtggaattttcagagcacaaataataattgaaaagaaataaacaaagtgaaaaggttttataaaaagaaaatcctaaaagaagtctgtttcccccctttttttccctcttgggccggctcggcccattccctccctctccctctctctctctctcctcccccgcggcccatcggcctcccccgtgcgcgcgccgctgacaggcgggcccgcccgccgctctcgctgacgggtggggcccacctgtcatccccttcctcccgccgcgcccgccgccgcgcccgtgccctagcgccgccgccgc

SEQ ID NO: 75904 - DNA, 853 bp, Oryza sativa
aggatcgtctttataaaatggctttgggcaactaagtgacttttaaatgctgtttactgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcggaaaaaggcaattttcccggttgcgacaagctggtgtcagagccatcccgactgtaggttaagccaaatggataaaacctaaggacatattttataaataaaactatttgcgaaagttccttttttctccttcccctaatgctatttgcaaaaggtttactccgtttttccttcttcggactttcaactagtactagatggttagttttgcgaagaagaagatggcgtcaattgtccgtcaaaactccagaagactgttggatcccttagcgaagcaaaggaagcagtgaagccagatgtgaagcaagagtgaagatcttgggaacccatcgcagaacctaagccaccctctagtgtttcgtttgtcgtgtgtttccttgcttgcgtgtgtagcgcgtggtttgcatcagtgggttgtgatgtaaccatgcta

SEQ ID NO: 75905 - DNA, 6754 bp, Oryza sativa
tctagaagttatatccataaagcaatctaaaaatcccacgaatccaacccgaaacctactcccacctagagtctgtcggttttctcatgtgatttggatcgaacgatgtatgcactagcgttgggacgtatccaaggtgtattgagaggcgtatcgtcgagtatcctgaattaatttttttttcaaaaatccagaaaaatacggatacatataggatacgtatcggagcatatctgatacgtattcgtatccgttcacgtatttgacacggatatgcaccttccatgacatatccaggtaacgtaggtgatcgaagaagagcatcaccaacacccaacggcttgtggcaagggatgaaataggagtaactggactgctcatttctgtattctacgtacagatttttcatgtaatctggaccacaatttggtcagattttgaaaatttcgatcaaatcagacattggtgttttcctttttataaaaaaaaatccaaaagaatttcttgggtctactatcactgccttgtgcacgcccttaattaagctccagcggcgctcatactcatttggatatgttttcacaaatccatgcatattttaaagctaaataaaatagatctgggtgccatgacgaagtgttgtgattcacgtttgtggaatcttggtagatcttggtgccatgacgaatgagtgattaagcatatatgccgtgtgaatcgaaatgacgaaccgaaaaaagtaaaagaaaatgtggatagatagaccacgcacccagcttcctatcgagaaaatttgagatacggacaaggagttgtcgtcgtagcaaggtcaatcacaaacaactagtcagtccagcaactcagggcttcaatcaatcgttactatctccccgggaagataatacttgtacttttagacaaggatcaggttaaactttaaaatctttgattataaattatttttaaaatatttatttttcaaatatgattactacatgtataaattagtgttaacacttttatacatattataatagaaaataatggtcaaagttattttttagaccgtgcttttatctaaaacgacaagtattatcaacccggcgagagtatatatgtggaatcgattggcaaatgcaaatctgcagggatcaggttctggtggagtctttagtgtgactactacaatttaaacagtcacgttgagactactgacacagtcacattgagactactgaaacgattgagatcgtttaagcactgttcatgaaaaaaaaaaacaccaggcatctactatgggagatggcgctatgccgctataacacttaatctacacctaggaaaatgaatggatgagatcacatgcagtgattaacttacggtcttgtgattgcattcgatctcaatccaatctgcagctaccagtacatcctactacgcaagtttcaaaatgattgaaaaacgagaggagtcacaggtaggtgtgttttaagaggaggaaaagagaaatgtagagaaggtactgaaaacaatatgatttattagcacatgattaattaactgttaattattttaaatttaaaataattaatatggttttaaagtaactcttttatatatatatatatatatatatatatatatatatttaaaaaaatactatttaatcgttaaaaaatgtacacgcaaaaaccgaggatcttttcactactacataacaccacatcaatgccagttgggaaccccacacaggaaccggcacaaaagaggcggcactgatgtgaatactcaaagatgccggtttaggtcccaagaatccaaaaaaaaaaaagggctcaatgcatcggctcgaacattgagtcgttccccttcaccccgagacccgtcaccccgagagatccaaagcaaatcacagatccctcaacaatttcatagaaacaatcaccgttgccgccacgtcgccggatccgtcgcgggagccaccgccgccactgctccgcccgccgatgccgatcccagatgcggctccgcccgccgttgccaccccagccacctcggctcgatttgggtgtcggttttttaattaaccgacacctataacatattataggtgctgatttttttaaaaaaccgacacaatatataataggtgtcggtttttattataattgcttaaaggtgtcagtttttttgcgatttcaacccgcggaggtaggaaaatgcctatatgccggttttaacactatcgacacctatagtggcgacacctatttaatgttttgtagtagtgtttcttgtctatcgacagtctcaaacaagtggtgaagaaaatgttacagaagtggcagggtgattataccggtcaaggtttaaatcacgtacacccaacatcctaattatttttatattttaacacagtattcaaaatgttactttgagcaaatttcacaaaacttcatatattttaaccaaactattgcaaaactatagatttaaagtgatacatcacaaaattacatatacaaatttatggtagagtatcgtaaaattacagatctagtaacaaagcaattacaaaactacatgtttattatcaactaaatcacaaaacttaaatgtttataactcaaacataatattaatattagtgctaaggatttaaacatactagtacgaagatagatagatagtacgtataagagtatagtgtacattatgctgcatgtttcatgcaattgaaagaagagatgattgggaaacaccattaatagggtggtaaaattatgagtccacgactccacctactattaggaaacaacttatcaggtttaaatcttggtgtctataaatattatgcacgtgcgagtgcgttttcaatggaaatttagtgaagtcaaaaatttatcgctggtcttcgtctcgttaagagcattgtgtgtgtctgattgcggtgtgcgtgtgtcatccgtgcaatgaaaaaataacaaggaaagagagaagattgggaaaattgacaagtttcaaagttcaaactggcataccgtctacccatgtcccgcctaccgtcttcctccccgtcctcgttgcctccgcccgcccaagcacccatcggccatcgcagccttcaaaacaaacccgcgacggacgacgcccccgcccatggccccacacatctcccaccaaaccacccaccccaacgccacctacaatctagctcctcgctccgatcgaccatccatggggaccatcaccgccgccaaagcagccgcggcggcggccgtcttccagtctccgtgctcccctgcgcctgcggccagcttccccgcccgcagcgtccggccggatcgccgccgcgccgtctcgctctcagtctcaggtaatgaccgttttgatttaacgccttattattattgatgatgaaagcagagaccatatgacccacttgtcgtcgtggcatcaacatgatgggataatggcaaactgtgactcactcaagcagtgctatgactatgtctatgttggcaattctctgaaaatgtaggtgtgttcgtgataattctattaagtttttgtgttgtggaaaacgcaccgattatacggccgttaatacgttgacagtgattagtccgtcacgtttttgcaaaacggtcttcactaatcgtttcacaacgaaaaaaatctcgtcattgccgattaatcttcccgtttgtgtctaatcggccgcataattggcctgatcaaaaggctgaaccaacccacaacgactaccctatcccatttgttgttttctctagtaggagtataaagctagctataccagtacgtgaattcctctagagtatctgatgccgctgcaacctggtctaggatgtgcacgcctaaagtttctctctgaagaacataagataatccatgcaaaatatttttccaatgcactaatactagacagatttctatatctgtataatagctctcatggttttcaccttttcctaattgtagcatattatatatgtagtgaatttccaatatatgagtctacaatatgcataacaatatttacatattcacaaccgttaaatttccgtcaaattccgattaatcgtccgtattccgattaatcgtttggcggtacccactctgtccaacatccgcattccgtcttccacaacactagttttgattatgttttcttgtaaggtttttttctatgaaattttctaggtttctcttgtgatgaaacttatattttgtatcattggtgatcattaccattaaaaagatgtgaacattagagaatgacctaatatcaaataattagtaattagaaggggtgaggcttcgaacccaggtcgtttagcccaccaccttgtggagctagccggaagacccccgggtgtttctcaatgatcattaccattcaacatcatggttcaaaattttcgaatttggattttcccacgcccaacagggattacctctggttgaaaaattttagtcgcttgaatttagcgggaatttgttcaaagtcagcaaaaatctgttcgaattttaaaatacagcactgaagtattttgccgagtcaaacactgtccaaatgcccacatgttcatgatacgacattatttttagttttaccttttgttctttttatcttttaccaacttcgacaacttcctttttgcttgtcaatactagttattcactcttacgaatatgaaggaaaagttgaatggtttgacatgccacaaatttgcttttaaatgtttaaccaatcgtaacttcctatttctcgtagaacttggctacattgcagttagcttaatttaatttcgtttaggttcggttggtgcttaaagtggagttgcgtgggaaatgtgaactggtaatggtagttcacatatactatatatatctgttattagacagcataaacttatcttgttgttttgtattttggaatatgtaatgcttaagatttatatttatactgtttcagttaatcttcttttgcgaaccaaaaaaaaaaagtgttactcacctaaactatgccgtttgcaggtgtaagaactcatgttgcagctgttgaacaagcagtggtacaagatgctattgcacagtcagaggctccagttgttgttgttacaggtgcttccaggggaattgggaaagccattgcattggcttttggaaaagccggctgcaaggttaacacttagtaattgatttatgcttatacatctatagaaattttatcaaaagggctgatgcttatctgagccactgcaactggcttatctgagttacagcaggctggaaacttaaatggttaatttatatattcaataggatcataggagtatcccaaatgactgttattgacaatctgaatagatgaattgatgaaaactttagttgcatgctaccctgtgaaagaaatttaccttttatttaccttcaagtttcatgattgtgaatcatgtaggtgcatctagaacaatacaaagaggattgtatctggaaaattgggttcaaatatttatctgttgcctagttgttatgctgaactagaataatttccctgagtataacacaagttttacaatcaaaggggaaaaaaaaactctacttacctttcaggtcttagtgaattatgctcggtcttcaacagatgctgaagaagtctgcaaagaggtaaagctttgtgttgactagttactttgttcatattttttttaaagcagcataacgtagatgatttgtaatacgagaataccacgaagcattaatttaaactaaaactgcgttatgttcttatctaaagtaaagagtaaatttcacaaaaccataaataatcaaaggaaaatacaattgaatgttgtttccggggtgcatgtgttttgaaaattttgttctgttgttctgccttaaatagatggaagaagatactgaggtttccgtattttacagattgaaggatttggtggtcaggcaattaccttccgaggagatgtttctaatgaagccgatgtggattctatgattaaagcagtaagcatagtccattcgtgatactctgtgatactggttttctctcttcaaatttctgaccacgattaatcatccaggctgttgatacatggggtacaattgatgtacttgtaaacaatgcaggtactcctagtggaatattatatcttttttttacacaaaaaaaacaatttattttacttttaagttttaaccctgaccattctgatattcaggaatcacacgggatacattgttgctgagaatgaagaaatctcagtggcaagatgtagttgatcttaatcttacgggcgtattcctttgcacacaggtactaatcacacattttctcatattttgtacttaaaatgctttatgcatcatactgcaaatgttttttttgcaggctgcgacaaaagtaatgatgaagaagaaaaaggtactccatatagttcatttctttaccagattgatatttgattgttttttaatatttttatattttttttcacgctgttctgtactgaacttcaatacggcaaatttgcaatatagggaagagttatcaacatagcatcagttgttggccttactggcaatcttggccaagttaattatgctgctgccaaggctgcagttattgggttaacaaaaacaactgctagggaatttgcaagcagaaatattacagtgagcacattttctttcattttattggttcaaa

SEQ ID NO: 75906 - DNA, 667 bp, Oryza sativa
gacacgtgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgatgcggccaaacgagatagatttccgagatgaggctggatccgttggaaggaggacttcgagagctttccgtcaagtactcacgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcagacgacgacagtagtcggtgccggatatgtcgccttggaggaaggtgtagaactcggcggcgaggtggatggcgcgaagctcggagttgccgaggaactggtgctcgaggttgcgctagacgacgcacgcgtacgacgttggggacaggacttcctggaagaggtcggcggagatgctcccagagag

SEQ ID NO: 75907 - DNA, 6196 bp, Oryza sativa
cctcgatatgaaccgacttagggcggccatgcagccggtgacgcattgcacatccctaagcttgctggggggggcgcatccgctctatagctcgtatcttctcggggatggcctcgatgccttgggcagagatcaagaacccgagatgcttgcccgcaggcacgccgaacacgcacttgtcggggttcagctttatgcgggcggagcggagactttcgaaagtttccgctagatctgagagtaaggtctcttggttgcgcgtcttcacaatcaagtcatcaacataggcctcaacattacgtcctatttggctacccaaagaaattcgagtagtacgttgaaaagtaggacctgcattctttaacccgaaaggcattgtcgtataacaataagttcctatgggggtaatgaatgcagttttttcctcatcctccctagccatgcaaatctgatgataaccagagtatgcatctagaaaacacaaaaggtcgcaccccgcggtggagtctacaatctgatctatgcgtggcagggggtaagggtccataggacatgccttgttaaggtcggtgtagtcgatgcacatccgaagcttgctgttcgccttgggaacgacgaccgggttcgccagccactccggatggatgacctcacggatgaatccggcctccagaagtcgcgccacctcctcgcggatgaaggcttgacgctccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgatcatccgctgcctcggggcggctagaacggaggtgctgagcctctcgtcgccacccgcgggcttggacaccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtttacccgctccgtgcggaagttggcggaaccaccgaaggtgatcgggaggtcgatatgacctagtggccaagtgtgccccggcgtcacaccgatgatcggctgggacggccggagcaccatccccggggccttgatggcgtcaaaggccgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctccccatcgacggtggcgacggtggccccaggctcctggaaccccaggtcatcgtcgccatcgtcgacgtcctcggcggtggccttctgcttggcctcacctcgccggttgccggcgggagccgccggggccttgccctcacggcgctcctgcctcctctcctcctcccacttcctcgtccgctcagccaaacttttgaccgcgcggcagtccgcgaggtcgtggagggaggtgttgtgtacggaacaccacttgccggtcgggcgcttcctgctgggagcgccggcctcctttttgtcgctcgcaggcctcccctttcaggtggcccgcgaagcgccctcgatggcgaggacatgaccctcattgtcggaatgggccgacctcttcttccttctcctgtcccgccgccctgaccgagcgacggacccgggggcggccggagctgccacaccggaaccggaggagttccaggtccaggcctcctccttgcgagccacacggtccgcgagctaaaaaagctccgcggtggtctggggctccttggaggcgatcttctcgagcatgcggttgtgccgcacgccccccctgaacgcgtagatcaccgcgtgtgcggggatgcatggtatggtgttgcggacttgacagaaccgctgaatgtacgagcgaagagactcatcgtcccttcgctgtaccgcatgcaagtccgcttcttcacctgggcgcggatatgtgccctggaagttcatggtgaactgctggcacaaatcctcctaagggtggaccgacgcgggtggcaagttcattagccaaccccgcgcctgacctttcagggccatgggtaagaaattcgacatgaccctgtcgtcaccccccgcggcctcgatcccggtcgtgtagatctggagaaactcggcggggttgacgcttccgtcgtatttttcggtgatagtgggccggaaccttgggggccaacggacgttccgaaggctcgccacaaaggctcgacagccagcaccgccaaccggggactcggggggctggcccccgtgcccggaccgaagtggcgctctggacgaggaagcgccctccgttgcgtgggcagcacgacgaccattgcgccggcgctcgatattgaggcgggcatccggccccccacgcacatcttcttgggtcggaggcgttgatgagggaatggcggacgaacggcggataacggccgccgctcgccgcgccctccgcctcgacgacacggagtcggcggtagcagcgccagaggccttggtggcggaggaccgcccgccggcgcctagacgctgctgcgccgtcatgaccaagttggccacgtcatccagccaacgtcgagctggagtctctggatcggggacgacgggcgggtgacgcaggagcgcgcccgcagcttggagcgcgccctgaggcgtgctgccatcgccgtagacgaggaggcgacgctccccatctcgccgtccttctccatcgcccgcgggcgtcgaagtcgcggatctttcgacctcctcgagcgcctcctcccgcccaagacttcggcgagagggggacggtggagtacgagctcgacggcgcgggttctgctccccgtcgtcaccgctagcgctcggagagaggttgtgcgccactgcccgttcggccattgggctgagcgggagaagcttggcgcacacgaaagaggacgagggcttagaaagacacacgcgccctctacctggcgcgccagatgacagagcgtggggctcctcaccgggagaccgcgcaggcccccctttgccggttcggccgggggcgctaagcgagtttcttcgccctcgatctgtggaatgttcgcgagagagcaaatgcacgagacacgggcgatgtagacaggttcgggctactgagaagcgtaataccctactcctgtgttctggtggatctgtgtgtgaaggagttacagagagccggagagcaagagagttcaggctctagaacccctcttcctctttctctcctctacgagctcaggtattctccgagttgtcttcttttttctttttttgctttggtgggcaaggtcctccttctatatctcaaggggataccacatgcaccacttctacctactcttcttttgggtggggacccaccctatcttgaccaaaacttggcttgcgccttcccctggaagctaaatcacagcttgtccttgagtgaggcccagcgccgtcactcgcctgacacaggggatatccctgtcattccttcattaatgtgtggagatttgcaatggccgctgtcccaatgaccctccgatgggatgggtcatacctacctccactccgccggaagcagatgcaacgtgggagcacggttgtctgccgatgacgtgaccggcgtcagaccagtcacagatcgatcattcttgtccaccacgcgtcagtttagcatgccgcacgtctgcccttcttcatacaatgacttccttgcaatggttgcgatgaagcctggcatgaatctggcggggactgacgtgttaactccaggagttagcacgccggctccggcttagagacgagtgcctggaggctctcatcattccgacgggacagggcgaggcgtgtgacaagccgcctgttgccacctaacccgtgatctgaccggtctgtgaccggtcacacactgcgaccggtcacggaccggataagcgtgcgctgcgctgcattaaatgcggcgtggcgcgctcgtccaacccgcaataaatgcggttaggtgagccccgctgtgctcacctaacccatacacgtggcgccaaaatcatagggggtcggggcaccccagccctcggggccaaaacgggagcggcccgacccctcggggagacagagggaggggtggcctcgtcaccctcgggcccgacccccccgagggggtcaggccacgtgggtgacagcggctgcccaagcctctagtcatgatacctccggtcccatgtcaccgacaaagacctacagagagcaagaatattattttggaagaaagtagcctaagtacagaaaacatgaattaaagactgagtgcatagggataaagcctgtcttgagctcgtagaccgaggcaggtttgggttgcaaattccatctttgttatgtgctatctcaagaactaagaattactgacgaaaaacatggaaaatttgattaaggggaattgttgatcacacaaaaagaactgccagcggcctgtatgtatgattccaattcatgcagcaaataggactcaccatgagatgcaactccaacaattctgaagaacaaccaacggcccaaatcagacttttcaggcataaatcaaatcgcgcgcccggggggggggggtcagaatccaaacaaagcattgctattccatctgacaatctctcgtacatctatctcgaaaccacttagaaatctgcacattttgaggatctgaccaaaggaaatccagtgagggttgtcacggcaccacaaactttcgtgtcagaataatttcaaaaccatcatgaactaatcaaaagaaccatgaaccataacaagcaaacctccaccaccccgattcatcatgaatataactaataatcaaagcaaccatgaacctggaccataataatcaaacctccatcaattcggttcatctcaacaggcactctccttcctgcatcatctagaggagcacaaacacataccacaagccagatcagcggttacaaataacaatcaacccagggtatcgaatcacctcgtgtaaggactgatagaaaccgatgatcatccatccatcgattgaaggttgtaatcaaccactcaaatctgaaatcaatcaccgaacccaagtgactaaatcaaacgaccggactgtagacgggaaactgacctcttccttgagacctcgacttgggaacttccaatcaaatccgctccagcaacaaccgaacacggcgaaaggacgaccacgggaaacaacatatagaacacaaaaaaaaacaaaaccaacaaaggatcggattgaatttgaatcaaatcaccggggacaaaaaaaatcaaacacgtcacaagcgggcggatgcaggtgaaattcagggcgacgaaggatccatggctccgatggcggcggttgcaggcggagtagggtaccggccggcggcgaggagttgaggaggcggcggggggaagtgcggctcagcggtgaggtgaggcgggcggcgcggcggcgtggcttcggtggtgtggggaggtccgtggagatggcggcgtgggggagggcggcggcggtgagttcaggcgggcggagcagtggcgtccggcggccggcgcggcgtgggttaggtccggcgggcgtacgcgttatttgtttttcgcagcgtttccttttttttttggggtgcgagcggtgcggtttctttattaaggatgacaggtgggtcccacgcaatagtggacctgatgaattgcaggattagagatgaactcgtactttttatattagtatagatataaaatacaccaattcatcaaactccttagatct

SEQ ID NO: 75908 - DNA, 3941 bp, Oryza sativa
ccaatgataagtagatgccatactctgaactgtctacctgtaagcaatctaactcaacataaagaaagacaatcaaagcaggatatgaagattgatagatcagtcctcaccatccaccaacagtatgtccccaacttcaacatcgtttatgaagtcatcgtaattcacactgacggtgtctttggtgctcacccctcttttaatagtaaaattgaactcttgaccttcctcgagcatgattggttctggaacatccccacttctcacttctggaccctgcatcactgaagttcgatcatcacagctcatttgctgcagcattcaaaatttcatgtgttcaacggcagtataccttggtatccagcataatagcaatgacattgccatcagtattcttcgcattgtactccttcaccaaatcaatcaccttctggtgcgactggtggtcaccatgggacatattcatgcgtgcgacgttcattccagtctcagcaagtttccatatcatctcgcgtgtgttggttgaggggcctatggtgcaaacaatctttgtcttcctacgggaattcgcagagaccacttgcgaagtagcgtcagcggtattctcagcaatgttctgcatgcaaagaaaggaatgagctaaccactttattgtatcggaagacaatctgaattaaaatgatggaaaatgtaaaaattcaagaataaggagaggtaaatcttgcgccgaaatactgaaccaactgtatggcatcacctgggttccacaaccatctatacatttctaagtaagcacatagcaaagcatttttgaagtttttagctggtgattcaggctagccttacaccgatcagaataaaaggaagaacagccgcaatttcccaaacacggagggttggaaatgacatgtatattttttttcctagcgaaaacttgcacccccacagtttccctccatttgagtgtgccagctctggatcaaaaggcctcttactacatagtagcaagcatgcagcaactactccagtactctacaatgtcattcacccaagcaggcaaatctaagcacgaggaaacgacgaattaatcctagcgcttgggatccaatcgcctcaacgtggtacgatacagtgacgaatccgccaaaaaaacaaccgctagtcaccaagcgcgcaaggggagaaagagagagagagacctgagcggagagggagccgttgctcccgagcgcgagatccgccgccaccctgtcggaggtggaggtcctgagggagcgcgccgccacggccctcctcggctgcgggggcgccgccgccgccgccgccgcgggcggagccggcctcactgccggcgccgccatgcgcgccgccgcggaccccacgatctcagccgccgccgccgccattggagggagagggcgcgtgtggaggcgagggtttctcgtctcttctcttctctctcttctctccttggtgtttgggggcgcgggcgaggcgacgccgcgtgcgcccggtgtttatacgccgggatgaggggagggagaccctgcaggtggggcccaccgcctgccacgtacgcgatgcgtttcctcggttccaccgcccgcctcatgggaggcggagacggtagtagtagtggcacaaagcccacgcctgcctggcactggcaggaaccagttgtgggtgggcccacctgtcagtgggcgtcgggcgctgaccgggcgggcccacggcgcggtacggaggagaaaaaatcgcgccggcggagaggaatataccacgagatgatcgacgagaggagacggagacggagggggacgtggggagttggaagttggcgagggaggctgtgggcggacggaggcagcgatgggtcggcgtcagcaatggcgccccaggcccagcccaccgtgggcgagcgcgaccagacgttcgcgtggaggcaggaggcgacaacgatgcgttttcgccatgagagctgcgtgcctcacgtgtaccttgtcgcccatgtgtgatgcgtctatctcattctcatcgctttgcagactgaaatggcctctgcttcatgctgccggccactataacaaggagaaagccgagcttctcaggcccatgcaaacatgctgaaacctggcaaaatctgcaatggcggctgtccaaaattcagcaaaccgcacctccaccaacgacgcacaaggcggaatgcagtattaccacatgcgggagaaagacttgctggcagaaacaactggagatgctaggtcagacccaaatgccaacatgactgacaacactgagtagtgtggagtagtagtaaaaaaccgagtgtgatgttatagaagacaatcaacttgtttcagactcgttattctgatgtatactactaggtcaaaaaccttgtcctcccgcgattacaagagaagaacccacaaaaccaaaggtgtgatctctcctagggggttgggttcttgggtggggaaaaggaaaaggacagggcaacggcacttgttaatgttacagattttcagtgttcccatgcgacaatatgcttcatttcaactctatcgagtatcgactggaaggagaagacgctcaccaccacaaaggtaacactcgtgtttcaagaagtgactccgcaaggaagaagtgcagccgcgactggcctcccctcttcattcagaatgttatatgttgaagccgcattcctctgccatacaacagaaggattagacatgtgcaaaagactaaacattgtaggtagagaacaaactacaaatatctgctacattgaagtttacaaacacaagtgatgatgttgtaaataaggaacatttggtcttttaccgaatcaactgcttccagcttcatcccagttgaccgaatgaatttgcggagctcaggactgattggttggatgtgtctaccacaaccaagaatcagaatctctggagaagcatggcacacaaaatgatgtcaacccacaaacggtgcttttgaatcagaaatacaaaaaactactcaaccatgagggtgcaatatcctggaacacatcttgagccccagtaggagaaagatgcttggacaattaaactattcagttaattcaaggaaggtttgcattgactgtgttctaccctgaaattcttaaaaatatttgtgcaccaattcagtgcacagctttgtagattgataaacagccaatgcctgttttagcttcctaatgaagctgcaccatgagattgatttttaaaagaaaaacagccatatggacatttcaaacatgggtgacagaatggctaagtccaatcaagataaagggagcgtatcctatgcacacaggccctcgcgtgtacacaccgtgtacaccaactaaaaattatcacaaaaaattctaggaaaattcatacatgtactttcaatagtattacatctacgtgcaaagtcgcatattcaaattcattctacatagagaataacaaaaaagataaaattctgacaaaattgcaaccttaaaactgtcagattttttgttttttttgttacggctaaaatataatgaatttgacgttaagattttaaccctaggtgtaatacaattgaaagtatgtgtatgattttttctagattttttggtgacattttttagttggtgtgcacgtgtgtacacgtgagggcctatgtgcataggatatgttgcctaagataaaatgcctaaaaatgttgaccaatagcagaattacctgggatagggtgcactactttgaagattgataaactgcattattgaatgaagatgcattgttagtcaaaaaaggataaattggaagcaatgcaaattcaatacttccagaaacctgattcaagcatgaatcctacctttcagctgttatctctgcaaatgatttgggtgcccatgtcattatcttgttttctactatcaa

SEQ ID NO: 75909 - DNA, 7385 bp, Oryza sativa
acaaatatgaacttttatgtccaaatcattatagtaggatggatctattcatattcagagtctataattaggtttatccaattttgatattaagcgctgcactagttagctattatctccgtccaaaatataacaattttttagctattacctccgccacttttgtccaaatttatagttaaaaatgcttatattttgggacggagggagtagctctttatcatcatagtatttatgtagctaaatgatcaccatatgccatcagtggcggaggcagcgtgggggcttggggtctttagaccccccccccccaccccctaatgaatcattagagtccctattaagaccccccctaaaatttaaatccatatatctattgcaagggggctaaaatatactttgtctgagattgttagaaggcccaaaaggctgaggagctcccactataattttatcctgactctgccactatatgccatacattatgtattacagttcatggtaccaagctgttgattatgagtacctacacttacaaaagctagttaattaattagccaggaatataattgaagaagaattagggcttattcgattaatcccacctataaagatattaagagagattactgaggtgtaaaattaatatccttcaatccctttcctttggattaaccaaacaaggtataaggtgatcgatgtatgcacatcatgctgatgtgtgtgtgcgtttggttaggcgttgctttcggatagactgatggagacgagatggctgcttgctccaggcagtaccatatagcgatagcccacttggagaaatgagtagtgttgtgttagtagtactagtactccacattgtaactgaacactgcagcttattttgacaatttaaacatgtagaaatgcatagtccctcctattttaacgtttaagacaaagttgagattaaacttttataacttaaactctcaatgatttttaaaatatttagtttaaaggcaatagaacaacgtatatatagatttatcttacaaactactaataaaaataataaaaaaagtatttattctatgtattatgatagaaaacatagtcaaacatatgtttttgataccagagggagtagtactacttatacgtactagcaagtacactcttcgttttaaaaagaaatcccaagtgagggttcattgtctgttatatacaaatctcaatttacattaggtttttcttgtacgaagcaagtatatagaagaagatataaaagtgggatagttctatggaaatgcatgctcctatagcttagcttctgaaattaaatgtaaagagaatggagtacgtagtactaatacatggaaaggctgaaactggttgaacacgtgggtcaattagtgagactatatgatgtgtcatgtgtggctgagaatgggatagagggagtgcatgcatgtgttgttagatgcgcatgatctcactttcactaatactcctacttaattagtgctaaaagtaaataaaggagaagaaaagggctgtggcatcggcctgccaggtttatttctctcttttctttttttttcttttcctttttttttgtagacgactctatttcgatcttttggcaacaaaaatgaatgcagacaaacggagtgctaaaaaattgattacttaatttaatctggagagtcgtgttgcagccagggtcttagttagagcagatacaataacaagctataaaccggctataaacatattttaaagagataaaaaaagagagagaaaagcagtgggtcacagatttgtaataggaccagatattaattgtatagtaagtaactattatatgaattagctatagatgatttggaactagtagttagctatactattaaacttgctcttatctcataagcaggaggcgcccatgcagatgcaggacaatgaggaaaataggccggctccatttgatgagtattacaatataatttcaaacactatatgtatattagacccaacgtagaattaaacccaccctctcatcataatatttaggagttgttgcagagaaaaaaattggttgtagtatctcctgactccaggtatacctggtctgctggtgcatgtcaaatatttaacgtgcgtactgtacgtcgtttagtagttactctctccgtttcataatataatagattttaacattttacttacactgtttaaccatttatcttatttaaaaaagtttagaattattattcttttacttactttattatctaaaatactttatgtataatttttcgtttttttatttgtacaaattttttaaataagatgagtggtcaaacagtataagcaaaatgtcaaaaactcttatattatgacacggatggagtaaaaattaaagcccttgatatgtaagtagtactacgattaatctttgaccatgctagtacaattcatgggaattaatcctttactgtagtagtagtagtgcaagatatgcctccatgaccattaattaattcatccccgggccagcatccaagtgtggaattcttgagtctcgtcttgattcaaccaaccagccattggatatatcgacatcaggcattcataattcaaccaaactaactaattaaccagacagtgcgtacgtactcctactccctccgctctagagagacaaaccctgaattttcgtgtccaactttgactgtccgtcttatataaaatttttttataattcgtatttttattgttgttagatgataaaacatgattaatattttatgcgtgacttgtctttttatttttttttaataatttttttaaataagacggacgatcaaatgttgggcacggaaaccagggtttgtctttttttgacggagggagtacgtctcagctcagattaacgtgttccacgcgctcgctcgctacgtccactaccaagtcgatcgtacggtaatactagtatgtaggagtacatactactccatactcatgaaagaagtcgtttaggataatgtttaagtcaaactttaggaatataaatcatgaataactcttaagttattgagtttgaaaatgtaaaaaattatatgtatagatttgttttaaaaaatactttcataaaagtatacatatatcacttttcaataaatatgttttatagaaataagaagtcaaagttatattttggagaccgtgtcgctgttctaaacgactttctttagagcaagaataataatatagccaactccatactattagcccatcttaaagctaacatatataatagattagctataaggttggctacaattttcttctcatgtctctatctctcacttatatatttaatgtatttgtcttagagcttgtgataagctagctcttgcataagagctaacacccttaatttttcactacctctctcctccacttaagcttatagctcactattatacttattcttaggagtatggagggagtatagtatacttaattaattcaccccctttttcccgtttggttgagaggtactagtgtgtgtgtatatatatgtgtacacacactactcgtatagtatacttcaacaacattttaggattaaattagatacatatagatatagcagataatttatctagattcataatataaatagtaaattctgtttaaccatttattatattgctatgttttaaaaagagatacaatacggagcaatgctactggaagcggctggaacacgtgcggaaattttgggtgacaagagacgaaagcacccagcacagcagtcaatctaatcatctcatctcatctgatttcatctgattagatacaactggagtgagatatttttaactatatatttgtcactcttataaatagtaggactaagcccttgtttagttcctattttttcttcaaactttcaacttttcgaacacatctaaatttttttctaaacacataaactttcaatatttttcttcaaacttacaattttagcaagggagtgttatttaactaaggataatattgaagcacataatttttatatatactaatatgttatataaattaaagcacataatattgattttgaaatttttaattggtttttatgtaaacttaatatatttattcatattattttcgatccatcttattttaaatattattttgtaagattgtgtggaaattaatagtaaggttgagatgctatgaaaattaagatactagatgggatcagtattgtttcggcctgttaagatcatagtatcgtaaaataataggataaggatcgagatactaacaaccttactactcgttatttagctataggtatataatagaattacttaccgatataactatctaagcctcgaaatacatgtaattgtgggatgtaggtagtagttatacggtgtagtattatgtgcagctgccacgaggggaaacactttcaattccttaaggggacgttgaaattaaagaaaaacgtacggaagagcatttgtcgattaatcccgaactaacaattaagatgaaatttctatatagaaagttctttttaaagaaatatatcatataacaattaaaaaaaatgctcacagaatagaggtagtagccaaattgagaagttgtttaaacgcagccgtagtattccttccgttgcataaaaaaccaacctacgatggaatgggacagtgtcgacaggatacccataaaccggatataaagggtatatattggggtccgttggtacgagaatttacgtagtacgacatcaagcaaacaaaagataaggattatactgattcagactccttggtaggtaataatccagttgatatgggattatatgatggaaaccacagattacaaatgaaataacagaactcgatgataccgacgagaccgtagtcgagttgattcgactagatctcccagcgactcggctcctgcgcgcttcgtaagctgtggtgggtgtgttggcagtgatattcgatgccttaggtcctgctcagggggtccctcatataccacgggtcaattgatccctaaataggactcggagatatcggacccctcacgatatggtatagaccagtcttgtccgagtaggactcctcccatccgtagataccatatctatcacgtgatagattgtaacgtcccgcctcgcccaggccgggcccacttggcccacttacatctgatagctttcataggtcatagacttccaacacatatccaggccaagcacgcttaaccctggagttctttggagattgacttccggaaaagaagttgcaatttgttgatatgagtattctattaatcctattaagccctaggccgggatgttacaccctcacccccttaagagtattaatcctattaagccctaggccgggatgttacaccctcaccctcttaagagagattgacgccccctaagccctaggccgggatgttacaccctcacccccttaagagagattgacgcccccgtcgatcaaccttaggccaggaacgtccttccaacacatatccaggccaagcacgcttaaccctggagttctttggagattgacttttccgccctaggccgggatgttacaccctcacccccttaagagagattgacgcccccgtcgatcaaccttaggccaggaacgtccttccaacacatatccaggccaagcacgcttaaccctggagttctttggagattgacttccggaaaagaagttgcaacttgttgatattctattaatcctattaagccctaggccgggatgttacacactcacccccttaagagtattaatcctattaagccctaggccgggatgttacaccctcacccccttaagagagattgagagattgacttccggaaaagaagttgcaacttgttgatattctattgagagattgacgcccccgtcgatcaaccctaggctaggaacgtcctctcttggccacgtccatgtgtccagtgccagcgcatgtgccatgctgtgtaaccactcccggtctacaccagccatgcgcaccatgcctgcgcaactgcgacacatgtgtgcacccgggaagaatttcccggtcggtcacccatctcaaattgctccaggccaagcacgcttaaccctggagttctttggagattgacttccggaaaaaaagttgcaacttgttgatatgagtattctattaattctattaagccctaggccgggatgttacatagatttccttaacgcatacggaaactatctgtatacgcgcggatataccgtatcagtatacaacgtacatctaaaatatagcgcttactttatccgtaaccctgacagacagactgagtatataaaagcggcgcttgttgtgcaggtggccggtcgatgcgtccgctagatggatgcacaacaagaattttcatttcaactaaaccaaccgagagattggaacacgctccacgcatgcatatatgcgacgactaacatcattttctcaatcaggtctgttagtttccaagttacgtgagggattagtattatgcagtgtttaacgactgagcagcaagtggcgacaaaacaatgaaagctaacggtgagagtatgtataactcatccaaaattccttatattttaagactaaaaagatatattttagtccatagaaaaacaaccctaaccatgaatctgaatacctgatttatatagttaaaaatatctcttttattgtcagggttacggataaggtataccctcatatacgctatacatcgatatggtttatctgtgcgtattaaatgtagaaaaaaaagagaaattacgagacgaatctttatgcctaattacgctatgatttaataatgtggtgctacagtaaatatttgctaataacggattaattaggcttaataaatttgtatcgcagtttcatgacggaatatataatttattttattattagactacgtttaatactttaaatgtgttttttatatccgatgtgatatgcaggtgtaaaattttttaacaactaaacaggcctatagctccagcagtactaccagtacgatcaaacaaaataaaagcaagaaatcaggaaggggaggagaaaaaaaataaaaaaaaaaagaaggagaaggaagcgcgtgcgtgctgccactgggtaacgaggttcacatggtgtttgacgtttggtgggtgcgaagggccacaccacgtgacgacaacgcacactgactgacactgccagcggagcgtcagccaggggcccacgccacaataaaaataatctaatctaatactccctccgtttcgaaatgtttgacgccgttgactttttagcatatg

SEQ ID NO: 75910 - DNA, 1308 bp, Oryza sativa
  unsure (1)..(1308): unsure at all n locations
tattaatatctggtccctatcatacacacattacgtcctagagtctgtgctgcagctggctatagatctatagctcgttgctcttctctcttcctttatctcgtaaaatatctttatagctggctatagcctgctattgtacctgctctaagggcttcttcgaattgtaggaactttagaggatccatttcctataggatttaagtatttttcacttattcggtttggaggaattgggcatgtgaaaaattggaggatttttccttcgcctgtgatttcatataattccatagggaactgaatgttggacgtccttttcattttcctatgtgccgaacaatatgttgtggagatgcatttgatagtgcaaacaatatgttgtggagatgcatttgatagtgcagtgatgtgcggtttaacccggaggtctctattcaatcccctaacacccctataatttcttcttagaaattgtttggagagatgtctctctctccaatctcttttttttttggaataatgtgttgcgtatttttcatgtgttttnnatcctatatttaccatatgtaccctagcctatttctacctattcctatgatttttgcattcctatgttccaaataagccctaagactgtaagtggggtgggccacgccgctaacccgctgggctaacccgccccaccaacccgctagcctacttaggctagcccgctgaagctgatgtgggtttatgcagcaaacccacaccgtccagtgacgctgcaaccaaggtgcatgactgatgcacgcaaaaaaaaatttcatcccgattagtttgttgcttccatggcatccaccatgaagacgtcgagccggccggtcttcgccaggtgccaccgctaatcactgcaaaggtacacgcccatcgtcctattccccaatggcaggttgtggcaccttgcgccgtccacaacctgctcggcacatgcgtcgctggcgaagcagtggacgataaagcttcctctaacacagttgacatcgtcgacgacgtcgaggaccacggcgaatgttggagcaggaacaaacctcgacccctaagcagtatgtcttcaagctaataagaggcttcccgccatggcaccgttgtaggccatcatgatcaattcattatggcgtgatgtgggctaacgtgcgatcaaatgcgaggactaggtgagcagccgagcagccatggcattgaccgatcgtcatacatgatgcagactaacttgtgggtttcaacgggaatccacaataacccagcggttcatacgtgggttcatgcatt

SEQ ID NO: 75911 - DNA, 1111 bp, Oryza sativa
ttgatatggatttggttttccgcacgctttttactgttttccatgagtgatgtattaattatgataacataaagtcacccttaaatatataattttattacaataccgtatgattttttattttcaagatatgccggcttatccattaaagatgtatatcttagaaactatacggtatgcgtatatgtgtttaaggggtgagtatatgtgttatgattgttcgtgtttgtagcatatttctaaaataatacacccatttttcaataatcaaataatataaaaataagatcacacgactaaaacatttgaccatttaaattttctggagaagatgggacgtctgatttgaagtttcttccattttcgtcacttcccaaatcccccgaaaaaaaaatctccagctgccaaagtcctccgtcactggatcgcatgactcgcgtctcgtcgccccttccttccgcttcagagttgggctgtgtttagttctacactaaaattataagtttgaagaaattgaaatgatatgatagaaaagttgaaagtttgtgtgcaggaaaatttgatgtgacgaaaaagttagaagtttgtgtaggaaagttagaatctacacagggcaggcacacacaacccacatcaaacacggcggccacctgctgccgcacaagaccacaaagcccccaaccacgacaccgcaccacatccccgccgcacaccgccagtacaggtgtccggtggtgtcccctccctcctccggtcagccatccccccacgcacgcacccgccaactacttgacggcttgacgcccgacctttcccccacaacgaccaactactttgcagccttgcaggcagcgcgagggagggaggagaggcgggggccattgccagccgctccagcaacggcgggcgccaccacaatctccctgtccctgcagggggtagggggggtttggatcacagcgaggataatcggagggtgtcggggcctgatccgtttgctgccgagatctcacaagagcagcgagaaacaccccatggtgagcctcctcacctgattctttttaaattggtttgttcgatgggggaaggcttttcatttgtcctagtgctg

SEQ ID NO: 75912 - DNA, 7018 bp, Oryza sativa
gccaaaaggtgcaccctggtccaagtcaggtgaagagaagattccatccgcaacaggaggtcaagccaagcagttccgagtggtaaagttttgctggaagttcgtcaagacgcaacggaagaagtcagacaagaagagaagaccgcccaacctatcctcttgctagcctcctcgaatctcggggacgagattcttgtaaggggggtggatttgtcacgtcctgataaattcatcccaaaataaaaatcatcttctaaaaggaataatagaattaattaaaattcgaaaagaaattggcaaacattaaaatacgtacaagaaaaattcaaatgtgacccggagaatttttgttaaattctccttggtctaaaaggagccctcaaattttagtggaattttcagagcacaaataataattgaaaagaaataaacaaagtgaaaaggttttataaaaagaaaatcctaaaagaagtctgtttcccccctttttttccctcttgggccggctcggcccattccctccctctccctctctctctctctcctcccccgcggcccatcggcctcccccgtgcgcgcgccgctgacaggcgggcccgcccgccgctctcgctgacgggtggggcccacctgtcatccccaaccccgcgccgcgcccgccgccgcgtccgtgccctagcgccgccgccgccgcgaatcccgccgctcccgtccaccccgcgtgcaatcaagaggggggaattaatccccgcgttcccctcccccgtttccccctctttcccctctctctctccctcggattcgttcgaatcaagcccgtaatcatcgccggcgcaatcaatggcggccgaaatctccgcggccggtttccttcctccccggccgccttctctcccttccgacgctataaaaacgttgcccgagctccgctctttcgtttccgccgctcgccgctcactctcgccgtcgaaatcgtgctcgcgccgtgctcctccctctccgccatcgccgccgagctccgttccgccgccgccgccgctccggacttcctcctactcggcgacccctccgtccgcttcgccgcgacgccgtcgatcccgtccgccgctccgcttcgcccgtcgaccgccggagcaccgtcgtcatcgtcatcccgagccgcgccgccgtcttcctccgctccgtccgccgtttccaccgccttcgccgtcttggggtgagccgtggaccgctccgttcgtttcccccttccctcctctctcttgggtgccgctccgccgcgccgttggtcgccggcggcgaccatcggggcgcgggcgcgctcctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataatccgattttttttaattgaaaattaaatgaagaaattcgcaaatatccatttaaagagcatataaacttcaaatggccatatcttggccgtttgaactcggaattggaccgttcaagtctctaatttttccttaagaagtaaagaacccatttttgtgctttgtttatgctgttatttggagtttattagagtaaaagccttttcttttccgtcggtcgtgtagacgctgcagcttcggaagatccgctcttcgtggaagttgaagccggtgtttgggaaagcgagcaaggcaagtcacatcatccttgagcatattgaatcccagtttgtaaaattatgttgatttaaattattgcattatcgctttatttaaattcccgcgttatcactgttttatttagccatgcctatttacctttgttacgaccatattattattgttattgttattattattaccttgttcaccctagattaaacaaaaccccatctagtggacactctatttatggttccactagtttaaatttaggtagatgcttcgcaatttaattaggcaacattaggtggttttataattttagactttgggagttctcatatcttttggacaccatggaatggttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagccgagcaatgtacccaagtcagtgttctaattcttaaaatttgctcaacactaaaatgtggaatggttggcctgggttggcttgggacgagctggaacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctggagcgcctttgtaataatgtaaatactatcgatgtaataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagctcctctttttctccttcccctaatgctatttgcaaaaggtttactcccttcttccttcttcagatttcaactagtactagatggtcagctttgcgaagaagaagatgtcgtcaattgtttgccgaagctccagaagactgcaggatccgctagcgaagtggaggaagcagtgaagccagctgagaagcaggagtgaagatcttggagaacccgtcgcagaacctaagccgccctctagggtagagtcgttagtcgtgtgtttccttgtttgtgtgtgtagcgcgtggtttgcatcagtggggtgtgatgtaaccatgctaggttgtttgcttaatcaacttgcagaataagtgaaacaaacaacacatcagcaagaagagttagttcctttaaggtcctatccttagtttctaatctgtctctcccctttgttttccctctctccctctccaaacctttgcaacagatggctgacaatgagaagggcaataaggtcagaagtcaggacattggtacctcaagctcccgagtgaatgaagcaccagacaccagttgtgtagcagtggtccaacacctgattaaccagaacaaattgcttatagagatactacagcagcatcggatgccaattttgaacccgagtcggatgcaacctcaagtacagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgaccagacgtcagagaagaaataccttccgaggtgcaccacagttgacagaacatcttttagctaatggaggtagagtgtctgatagtgaagattcagatcaagtctcctcagatgatgaagatgaaatggaacgtaaggcatgctctcgttgtggagaaatcggtcatgtcgccagctcatgtgccactatatgcgttcattgcgaggaagaccatccacccgacaggtgtccaacgagcaggatcacttgtttcttttgtgaaggaactgatcatgtaccaaaagattgtcaattcagttttctgctgacgaagaagatggctaaccaacccgccagttccaacggagagaagcatcaaggcaacaccaatcctcgccaagattacagttccagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgacagtccacgcaactccctgcaatcagaagcttgctcctcaacgaattgtcatccatgcatcccgaagcagtcctatagcccgcgttgcaacagctccaattccaatgaatgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccgaaaactgtccccaaccaaggcaaaatcgacctccacattaccgccaatttacacgaagcagacattccaatcgtattgtggtcactggagcaaacgccgtacccgtaaggcctcgtgataatcagaacccatagcagaaacaatgcaccaatgctcctcctgctgcacctgactcggcaataaatcatagcaaccattctctgcatcgacagcctcagcaaagaattgtcgtagatggaagaagttgtgtctctccccgacctactccaggccgagccaagggcaatcaacctccggagggcgatacccagcagaagaccgtcatccgcttcaaccagcaatcagaaggaagcttctcctgtgaatgatagcattatgcagtcctatcacatcatcacagaaccaatcaaggatgcagtcactagaacaatgccagctatatctctccggaatcaaaatgagcagccatgtttgtggttttcagttcgctacttatcatggtgtaatcgaaagtttgcagcaataatgcaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcttttggaagatgcgaatatgtgattatgtgtataattgcttactgataaaggagacctagggtctcatttcaaaggaactatgttctaacctcgagttaataaccaacctgttgatggaaaagaaaaccaattaaactgtgttgggttaaaaagccaatgagacagtagttggggaacaggagtttggatacgcctgttacagatcaagataaggattgttgaatgaaacccataagtgtacccgccatgcctctacattgataagttcggatatacctgcaaacagttaagaagatccaggagacatcaatattctagaacataatagtcgatggttggtaattagtcgatcaggtatcagaaaagggtcaaaggtgatatggcagaagaacaatatggatgctccccatctcgaggaagcactaaaccctagtggcatagatacagatagcaagcaatgtatttccctgaaggtagtcagtgcagctttttgacgaaccacatcaaggtttcactgaaaggcagcaagccaaaggacctcatcgtccccagaagcgtccgcaatccacattaaagaataccacctgttagagataagccgaaagatgattgataaaaagagattggcaaagatgttctctagcatgaaagaagtaggccgaaaggtgattgataaacagaaacatgctctgcatcgctcaaggaagacccctgattgtaattgccccgcaacagtcaccttgtcattaagtcagcaagatgacctaggtaaaagtgtttctatgaaggcaaagagtgaaatcttccactcggtatcagatgctacacggagtgaaaaatgcaagcaccggttaccaggcgacgccacgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagatagtctgcagaggtcagtttaaaatcaaaagtaacagcgaagcct

SEQ ID NO: 75913 - DNA, 5525 bp, Oryza sativa
tgaaaagccttcctgagattctctatcttcctcccttgggatgaactcttcggctgttgttgttggtcttctcaccatctttgtcttctcttttgcctctcccaagcttaggacaatgcgaacgaagatgatcaattgaaccacgcattcaaagcaacgatttggaccacctcttttcatgttcctggcattattcatagctcgagaaattctgttagcaaccaaagccaaatcctcctcctcgatctgttcgagttgatcatcggatgtggcattaaaaacagcaagaaaataaggcttatatgaagaagcatgaacatccgaagaagaagaaaaagaaaccaaagcacttgacttagaatcaactttccgagaaagaacattcatctcatgtgttttcaattttgtataaagtgaatccaaagtcatccaaagcttctccaggtttcatctcaaatttaatgtactcctttttgaaaaatatcacgacgaagttctttaatgttattcgttccttgatgaaagttactcaaagcattccaaatttcatgagcagctcaaaaatgcgcaacacgatcataatccgaacgagaaataccactcaaaagaatgttgtgagctttgcaattttgttcaaaagcagttttttcagcagcagtattaatagcttcaggaatcacatagggacgagaaacttttctccaaatatcataaacatgaggcttagttgaaaacctagcaggagtagccatggcaaaaactctagatcgataaaaatccaaagaagaaaacaaggctctgataccacttgtaggatcgaatcacaataactaagccaaccagagggggggtgaatggttggtatacccaaaaaccataaacttttagcggaaataaaagttaccctcgaaatcgacggagatcggtttgaccgagattgatctgctggtctgaccgaagcgtagccgccggtctgaccggtgttgaatctccggtccgaccgccgcttgccgccggtatatcgccggttagaccgtcgaaacccggtgaaacacaaatcgaagaactcttaaagtagatgatgactttattgattctctctgtgtttgcaaagtgcaccaacagcactgtagcgcccgttccgtcgtggcgcttagcgggaaaactatctcttaaaaaccctatttgcgaaatccgtttctttgcttgttgtctagtgtccgtgccatctcagatctcaaatccccgatctatcgtcgagttcaatcccgaatccaaatccttcccaaatcaaatccctccgcaaaagtctattttgcctccctcgggttcgatgggccaaactcctctcggcccatctcctactccctccccggctctctctctctctctctctccctctcccccgctctgcccgtgcgctgcgcacgcgtgcgcatgagccgcgccgagccgagcgtcctccgccctcgctgccgcttctcgccgcgccgcccgttgcttcccgcgcgcgcgcgccatggtggccgaccgcctggtcgccgccgccgtcagcgcctgcccgcgccagccgcccgtgtcgtcgctccgctccaaaccgccccgccgtcatcgccgtcgtcatcgactcggccccgcctctccccgcgctagcctccaagggacggaggcagagctcctcctccctctgccgcgtcgccccatcccctcctccttttcccaaagtggcaaggggcaagccccctttctcccttcctttttccttttcccctccccgccggcgtcatccgcctctgtcgccgttttggccgcgagcgccgagcgccagctagcgccttgaccgcccaaggtcggtttccaaaccgacatcgtcgtcctataaaccaaggcgccctcccatccattcctcctcccgtttcgctcgccgccaccgcgccattgccgcccctctgtctcacctccgccgttcatcgccaagcaccgggagagccagtgcgttcgtggacgcggaaggggactccgggcgctcgccttcttcctcttccccggcccgaggccggagagatcactcccgtgccgtcggcctctcgtcacagcgccccgcctcatctcggtagtgcatctccccgttctccctcctcaatccatctcttccccttagttttcggtagtagcatgtgtagcccccccgtagctagacagcgccgccccgactgctgccgtcgctcgccgtgtgctcgccgccgttgccgcccgagctcggaagcgcctctcatcgccggcctccctcgatgcgattcctcctaatccggcgcaaggggtggattcccgtagccgcgtagatgctctcaccgccgggaatcggcccctcgtgaccttgtcgctgtttcccccttttctctccgccggttgccgccgccgtaatccgccgccgtcgaacatcccggtgtgctcgccttcgcctgtatcaccatggtttgctccgccgcttgccgctgtcgaccgccgtccgttccagccggcgtcgtcgtcttcctcccgccggcccgcgtggcagccacgtaggcgccacgtcggcgccacctcagccgcgaccgggtcaagtagaccccggtccgccgcttccctccgccccctcgcgggcgtggtccatcgcgagccgtgaggctccgcgtgggcccgccgcaccgcgtcctccgcgaaccgcgcgcatgcgccgcgcctccctccctaaaccctagcacgccccgcgtgcacctcgctcacggtgagccgagtcgccgacaagcgggtccaaccggggaccacgcgggatggacccggcccaccggctctctctctcccctccgcacccgagccgccccattctctcgggccgcgccctcaaatctcgagatctatctaatggcacgcttagaggtcaataataaggctttattttcgccgtttgctgagttgtcccgtttcgcgtgtagtttcggagcccgaagacccgcagtgcgaggatttcgaggatcaagctcaagatctcgagcgaggcaagccacctttgaacatcttgagcctatatttgaacttaattatattgtgtggatattatgggtaccccatacccatacggcatggttatccgactagtcataggggataacttatatctatggaatatgtaatagatcatgactcgggtattacgtttccttatatattacggaacagtctaaagtcctggtttgataatattgtaaagtagatttaggaaaccgataccgtattggttaaggtttctatcttgtaatcctgccccccaccctatataaggtgggcgggaggccctctagagggcatgacacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggtaaacgccgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaatgaggatgccatggtgttgcaagatggatctacaaacacgaagcatgccaaaaccaatctaatcggatgcataggagacggctgcagccacgccgatgccttcctgccgtccagcgtcgtgctgatggacaccaacgccgctcgcgactgcgacctccgcctcctccgctccgtttcggagtcagtcgaagagatcaatctcggcgagttttttccttttaatttccgacttcgccgggttttttccttttcaacttattgttgtttattagattgatctctaaatgtcagattaatctctcttggtattttctgctgtttgcatgtaacgccgcggcactactcttgccgactggtgtttccgtctgcatggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccaccggcctgcctccatcgccgccgactggtgcctccgcctacacggtcggttggtcacaccaccgttgatgggcatcgtcatcttcaccgccggcctgcctccgtcgccgccgattggtgcctccacctacacggctggcctattatgccgccgctgttgggcgtctacgacttcaccgccggcctgcctccgttgccgccgagtggtgcctccgtctgcatggctggcctattaagccgccgctgttgggcgtctacgacttcaccaccggcctgcctccgtcgccgccgactggtgtccccgcctatacggtcggttggtcacaccaccgttgatgggcatcgtcatcttcaccgccggcctgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttgcattgagtagtgagtcgggggctacagatgttatatcatattttttataatatttatcttgattgcttgcgacataatctgagtacaaaagtacctatcgagttatggagttctatcttcctctgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctaatccgtgaaactttgttccattaatgacgaactcatatcactcatatgcatgtttgggaagtgcctaggccgactcccgatgcttggtggttatgactagtcggacagagtgtttaaacgtacagagtcatctgctcggagaaatcaaaattgacaagaggagaaatacatatttataaatattttaaaatacttgattttttctcgagtattatatttatatcagatactactcatcctatatgtttgttctgcaggatccagatccagatatgcataaaagggattcatggcttt

SEQ ID NO: 75914 - DNA, 1885 bp, Oryza sativa
ccgcctcgtccgccgccgactggtgtttccgcctgctcgctggcctattatgccgccgttgttgggcgtctacgtcttcaccgaccggcttgccttcgccgctgccgactggtgtttccgcctgcacggctggcctattatgccgccgttgttgggtgtctacgtcttcaccgaccggcttgccttcgccgccgccgactggtgtttccgcctgcacggctggcctattatgccgccgttgttgggcgtctacgactccaccaccgacctgcctccgtcgccgccgactggtgtcctcgcctaaacggttggttggtcacaccaccgttcatgggcatccacgtcttcaccgaccggccacctcgtccgccgccgactggtgtttccgcctgctcgctggcctattatgccgccgttgttgggcgtctacgtcttccccgaccggcttgccttcgccgctgccgactggtgtttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgctggtgtcaccgcttgcacggctggcctgttataacgccaactgatgctatcttcttcacggctggctacatcgctgtcactactaataggcatcagtatcttcaacacaagctgcctacgtttgccatggctgccgactgttttcttcacttccatggctgcatgattctgccagtgttgattggccttaccatcttcatcgccggtcgtctcgtctgctgctgactagtgccctcgcttctacatctggtttatacagctatcactactgatgaacatcatcgtcttccgtcgccgactggttatgttgtcgccgactagtgcttttattttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacatcaactctcctccaagtgaagcatctacaacagctataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattatcattggttgccacactgctattggctggatcaccgacatcgtcatcttcatcatgtcggttgcgtttgttgtcgtcaactacacaactttatcgctgagcgccttcatattcattgctggctgacctgactgccgccgactggtttcttcgcctccatggctatgtgacttcagtacttttgattggtatcactatcttcac

SEQ ID NO: 75915 - DNA, 1104 bp, Oryza sativa
ttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcgggaggccctctagggggcatgacacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacatattgcttgaaaaatattatgcattgataggatcgcacttaatctgcttgtcccgtctgcaaggcagattggcggacctacctaatttgttgcatttgacccttccattgtaattattataccatgttcccttgtatccacctagttgcgcctcggtaatcgtgcactcggcacgggtatcgacggtcgctgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgaagaactcttcctttgatgaatgattgcaaggtgagtatatgacatactcagcaagccacgcagcaaatatgcaagtgcacaggataacaaaggatggcataatagggttccatttgcaaaagcagcatttagcaaacatttgagaatttaacaaaacagttaagtaataattaagcaatattaaaccaacgctatacaacataccctgttgtataggcccaaccattctgaacaacca

SEQ ID NO: 75916 - DNA, 6284 bp, Oryza sativa
cggcgagaagagaagagcacggggatccttttaaaggggctcggaggcgacggcggaggcccacggcgacggcaacggcgaaggaaactcgcggcttggagagaggaaagccgatccgattcgaactcgaatccatcgatttccaaaccgatttagccgaagtttccaaaggagaaaaggtagaggagatcccgaagatcatttcccctctatcaattcagccggaaacggaaaggagcggccggattggaaagcggcggcgacggcagctcggcggcgcgaaactagggtttcggcccgaggaggacgacgggcctgacaggtgggacccacctgtcagcggctgcgagggcgcgcgcgcgcgcgggcggctgcggactgggccggctgggccgaggagagagaagagaggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattaaacttagatcttctcttcaagacttttaaaattatttctagaaattccaattaaacaacaatttatatattttgaattttcagggtgtgacaaacctaccccccttaaacagaatctcgtcctcgagattcggaagaactggcgaacagaagcggatgagctgacttcaattcatcttctcgttcccaagttgattcttcttccgagtgattactccattggactttgcaaaaacggataactcgattcctggttcttctctcacttgtttccaggatacggattggtttctcaacataagtcaaatcctcttggacttctatctggtcaatattagctccttcggtaggtacccttaaacactttttcaattgcgacacatggaacacattatggactcctgccaaagattgaggtaactccaactgataagcgacctctcctcttctactgacaatcttataaggtcccacaaaacgcggtgccaattttcccttggtatgaaaacgatgaactcctcgaagaggcgtgacacgaagatacacataatctccctcttcaaaactcaaatctctgcggcgattgtcggcataactcttatgtcgagactgagccactcgcaatctttcttgaatgatctttaccttttcttctgcttcccttaggatatccgttccgaaaacctgacgttctcccgtttgatcccacaaaagcggagtgcggcacttccgaccatacagtgcttcgtacggagccatctgtagactagcttgataactgttgttgtatgaaaattctgcataaggtaaattcttatcccaacttccaccgaaatctaaagcacaagctctcaacatgtcttccaaaatctgattcaccctttcggtttgtccgtctgtctgtggatgataagcagtactaaagttcagcttagaacccatctcttcctgaagtttcttccaaaaatttgaagtaaattgactgcctcgatcagacactattttcttagggacaccatgcaaacacacaatccttgccatatacaattccgctaagcgacttccggaataagttgtctttaccggaatgaaatgagccactttggtaagtctgtcgactatcacccaaatagaatcatggcccgatgacgttctgggtaaaccagtgataaaatccataccgatttcttcccatttccattcaggaatcttcaaaggctgcaacaaaccggctggtttctgatgttctgccttgactcgctgacaaacatcacatactgctacgtattctgcgatttcacgcttcatacttgcccaccaaaatctttccttaagatcctggtacatcttagtactaccagggtgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatctggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcaaaacacaacctaacccaagtttggatgcatcgcaatacacttggaaacccttctttggatcaggcaaagtcaaaataggagctgatactaagcgattcttcaactcttgaaaactctgctcacattcttccgaccacttgtacttcacatctttctgaagcagtcgtgtcatgggcttagcaatcttggaaaaattctctataaacctccgataatatccggcaaggcctaggaaactgcgaatctctgaaactgtctttggttgcttccaattggttacggattccacattactaggatcgacggcaactcctcctgctgagatgacgtgaccaaggaatttcacttcagacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggaaaaaaacagtggcacctttaagttgatcaaacagatcatcaatcctgggtagtggatacttattcttgatagtcacatcgtttagtgcacgatagtccacacacattctctgagtatggtctttcttttccacaaaaataaccggagctccccatggtgatgaactcggtctaatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctagaatgacatcaaggtctttggattttaacaagataagattggccagaaatggtactccttgaatttatattctgacagaggggctacgttgcaaagagagtgcttgatcacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagcagcgacatgatttacacgagccttggatgctggtacagcagagttattctgggtagggacaaccttcacgcgtcggggcttcggacacttgtcagcataatgtcctggatctccacagttgaaacacaccacgggcttgctgccttgctccctcttggcaggttgttgctgtgctggagctgcaacaggacgtggagcttgattacggatgttgttgccagcattgttgttgaagaactgacgttgcggacgaacaacagacgaagaacctccctgtggcatggactggggtcctaaagtaagacgcggcttctgattattcccctgttgtgtcttgaattgagcaatccgacgtttcttctgctccatgcgattgtacttgtcctcctgacgaatagccttatccactaatttctggaaatcagggtaatctccaaccatgagtgggtaagaaagctcatcattaagtcctcccaaaaacttctcctggcgctcttcatcattgcgcacatcttctggagcataacgagcaagacgattgaactcgtgcagatactccgtaacagagcgagatccctgagtaagcgacctgaactccttcttcttgagagacactactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgaaaccttctcctgatcagtacactgaagtaaatccaacttcttctctatggcatgcagccaatcactagcttcaacaggattagtggtactagagaaaacaggcggcctcacacgaagaaattctgctaacttgttttggggaggtgcatgattattccctggttttgctgattctgaaattgctgcatcatcatgttcataagctgtgtctgttgagcaagaacttgggccagagtaggattctctccattgttgttattggggttgttgggaccattcccattgctgcgagtgttcaccatctggcatggacagggcacaagaagagaaaacgggggaaactacttaggatagagaattactttgacttttattgatcttaactgagtttcattattacaaactgaagactctcacaccactaaactcaccaacttcctaacactcaaaagcaaacaaacacatgcaattacatcccaccactgatgtaaatcacatgcaagacccacacacacacaagcaaacttaaaacaagcaaactaacacaacgatctaagacaacggcttaacaagtcactctagttcttccaagcatcggaggtcgattgaaggctcgttcggctcatcttcctcatctttgatagctacccactcaaacttggaattgttgcgcttgggttcttcttcttcatcactacttatgatgatgaccggaggatccgcttgagctggggcaacttctttctccaccacacgaacctttggcgccagttgatagcgagggacaaataaagctctcttccttgcggtaagacgaatcctggccttctgcggcggtgcttctcccttcaatgcggctaattccttttccaaacgatccaccttgtcttctaacttgcaaatcttaccacgattccgatcttcacgatcttgagctgctaacacagtctccgcacgactttcatccatagcccacaacatctcaaccaaatgtttcgtggtaacatcattctcaattccttcagtctcaaggtaactgccacggtcacttccctgaggttggcgaggatggtagcgatactcagtgtcggccaattgatcactgtagcgatcacggagctctcctatggcgatccttgccacctcctgacatgcatggatgtagtttcttcctccagcttcaaacattactgaggggacctcttcactattgctgttcaaggtgactttgactcggcacttctcttcatgacgatcatgaggaatctgggtataaaaaggggcagtcccgaatccaatgacaaaggacatcatacgcaactcctggacaaaaccctcaacaccaaacaggtactcaggcttgtaacgcggcatctaaagacaagtgaaaggagggagttaagacctttatccaattaatagcacagtttttggattaatttgaataa

SEQ ID NO: 75917 - DNA, 680 bp, Oryza sativa
aaggttcccttgttaagctaggtactcacccaggggtgtcccattccacccatgtggtcgtacttgtcttatgttcggatgaaattccaaggaaacggtccttagtgcaagagcgggaaacgtacacccggtacgttccccggtccgcggttttggaaattcatttagttcgcaagcaccgaccaggtgtcgggttttccaagtcttttataaaacccaagttttacccaagatgtttttcagattttaagtttgaaggcggccgtcgatactcgtgcagagcgaagggtcctgacacggcctctttccggtatgtcgtggtggcatatcggcacacgggaacgtgttgtggggctgtgtcttgtgggtacaattgtacacctctgatcagagtaaaactattcgaatagctgtgcccgcgttatgggcgatcgaccagattcaccgtgattagtctcaccctagtttagtctaatggaattgattagttcaaatggatgtttgggcctgttgcaacgtggtgtagcattggacagtggatagttaatattgattaattactataaccgttttactgctttcaactactgtttataaatgccagcttgatgcaaaggatcccctttagccttcctttggttatattgcatcataccctccgttccggtatgacttgctga

SEQ ID NO: 75918 - DNA, 16507 bp, Oryza sativa
tttgcttgatcaatcaactctattatctcatcagcactttaatgtttagcaactgcaagcaaggagatgaggaggaatggtggttggttggttggatggatagttattcatcctgttcatgtcctgccatagcccgtaatgatccatctcttcttcaacggagagcagcacggagaagacgacctgcacacacatgatggggacatggtcttgcagcacatgtgagttgggtgggtagatctcgccatcacaaacaggcagtagcacagtacgattagcgaccgagggagaactgagaagcaagcaaaaagcaaagtaggagctgctcttcttggcttggcagcacaaaaacgaaacagaccaaaacaaagctggatgtgcgtgtgaatgatagatcatcaaagctaggtttagggcacccgcaatggttatctatatgctctctacaagatacccatgtcagcatattttcctatatggaagagattaaatgaagagagagagcaaatctatctactaacttgaagatagtctatagaaaaacgaggcaatgcattagatagctatagatacctatgtagatatactattgaggtggtttattattaatttaatttattatttaggtatatatgttttatggaaagcaccttagtgatgagagataaaatgaacgttgacatgaaggacatggcaggccaggaccaaccaaccaacccacctcatccatccatccatccatccatccaacaaaacaaagcaaatcaaacgcaacaagagagatactgtactagtacagcaaaataatgataattgattttttaatttggtccgtgggatggggcagaaaaatgcgtgggtggcgtgcggcttttgttatcgcgcatgtgactcgtgaacaaacgggccatcggtgtcgacaaaagtaagtatctggccccagctcgctcactcatcactattcgctctaatctccacatgcgtttcaacatgtcttgctccagtagctccttttcttatttttatttttttattaaaattctttgcctgttgaattctcgtaagcaaacagcaaagactagaaaactcctgttgtttatgcttgtttcgggttgatgattacgcacgttttcgttaacagtaaaattaaacaagtaattaatactaattctctcaaataacaagcaccagtggtctagtggtagaatagtaccctgccacggtacagacccgggttcgattcccggctggtgcaaattcgtcttttttgccacgatttcagtacaagcttcgctcaattattggtatgagcatgtgacaatcagctaatcttgtctgcttccatctccagaaaagaaagccgccatcaatttggcacccactgttgatgccagactgatatctttgtaaagaatgacggttagtgtattaaaatcctataaattcgtttagactttttggattagcatttcagcatgacattgactggtacccctaaatgtcaaccgacaaccggcacaatttgattaagcatccatcaattcatttctcttctaaaaaggagaaggcaaaccgcacccaaaatgaatcgatacacattttcagcttgcatattctatggacaggtatgttacagtgtaaaaaaaaacaaaacaacaatatgctttacattctcaagaaactagcatgaactcgacctctatgtaatggaaaactgtacaggctatgtactggcactgcaacgcaggcctcctgccccaagttgcgagtaatgtatgggtgaaactgtattttgctgttgtagcaagtcccctttgtggcgctctggcctgtgtgcgaaattgctaggccaaccaagccaaagaataaaacttgaaatgatcacaccgctaatgatctgagcttaacgtggttcatttcgcacgctatgaatgctgataagaatgccgcccactgggatttgcaggagccgatggtagcgctggagctgtagaaggtagccggaccaaggcaggctgaggtggtggtgcagtaagggcgtaggtcagtcttgacgatgagctctcaatgagccctgcaactccagcagcagaagactgtgcattggatgggaggaataaatcgtgcttctggtccttgtaagcactccatacctaagaaagaacacattgttattttactcacgtctagtgctcattttcatttagtgctgttacttctaatgatcccaacttcgaatatgaactacggagtactcgagatggatgaactcatcagtaagttacttacatcagaagaattcagaatttcacgaactttagcacagtgtgcgccttccgttgcaaaagcatgaagcacctgcataatttaagaaaaaaaaatataaaacaaggggccagcagacgtacaagcagaagaggccaaatcaaactaccaaaacacatcatttaaccacaatgagataaaacaattgcatcctcttttaaccattcatcaaaatatcatatctatgccctgaaaacccttgttttttcattctaaatttaatttatgaaattatttctcaaacgcttcatgcattttcaggttttcaatctttcagggctagtgtaaactcctggtttagtttgatggatacaagtcagtccatctaggtactgaaaacaagcataaaaggatgactggttcttagttaaggacacttcctaacttatggctatcatctgcctaaataacatatatgatcaattcaactttgttttgattgcaccaagctgatgcggaagtcccatgataactgagaaaaatggcttaagacggtgcttacctccactgccaaaacacgcccaattgaagcctctgattcattccacttcatttggttacacagtccctgcctgccaccagctcgccaatcaagaataccaagcagtacttcaacaaggccaaccctgttttcaatcatagttgatgaatatgtgttaattttttgcaagacacatgattccatgcaaaaactaggatgaatgaacgtaagccttgttatcatttgttttgcctcagaaggactgaacacatcagatatgctgatttaatttaaacaaaagattactagcttttccattttcactcagcagaaataaaaagagattcagtacaatagaatttctttggtcatgttagaagtacagaaacctttttttttttggagagatcctacatagtgccaaaattttcgtgttaaaatcaaacaacattgattccttaagttatccctacatatgtatgatttgaacagcttactttagcccctgtgcaacaagtgcatctctagcccgattgccagcaccaacaacacgctttagtgtctctagtgccagtatacttccaccttgccatccaattgctttcataagcaatggaacaacctgcaaacagttgaagcaagaaaatatttaggtaggtctttatatgccattcatgaaataatgtgctatgcgtcaattggataggacttcatttttggtttctcctccaatcaattgtgagaaaagagaagtaacaagttattggaagtcaatattcaaaagaccttgactaataaagacattgaaatagagccaacatgactattcaaagttgtaggttttgcactaaatcaataaatcattcaagaaatggaatcttctcaggccaaaacatttgaacactacagggccaaatgtaataattacattgccatgaatgcattctagatgaccaggttcacactaaacttaagtgccatcatgtcactaaaaactgtactaagtcaaaccacaaaccatactgttggataagcaaagaaattagtgtgtaaaaaaaaaatcaatacgcaagtaccaagaaaattaaaacagaaaaaacaagggttgcaattcaatacctgaggagttcctgcacttgtggctgccatagcttctgcacaagtagtgctggaagccagctgatgcagcactcgcaaacaactaagccggacacgttcttgtggagtctgcacggtagagtccgccgagttctcttgattgctaggttccgcttgcaacctacttgtggtttgtccggatgccatagtgtcccgtctaccctcatatgccatagctgaaaccagctttggaacataacctaggtaaccaacatggtctgcaagggctggatgaacacgcaacaatgaaaccaatgcagcagaaagcagcaacggaagctctggatcaacagcattcgcctcatagtgtgtggcagcaactgatgagacatactgatctagcagcccttctaggaaccttttagggtttctcaatggaaacttgggatcctttaggaagagtctcacataaatacctccaacctgaaatttgcacagcatgagaacatatagcccaatttcaggaaatgaaaataataggatgattctagactaaacactacctgtggctcatccttcattacatgctggccagatgcttgttcaggcacatcccaatcaacaacacgccctttcatctgctcttggtagaggtctgtggccatggttgacaactgcgcagaaagagaagctgccattgcgggtgtccatacaagttcaggggtttctgtggtctgttcaagacatgaaacaacagcttcaccaggcccatctctaattgcagaaaccaaaccatcaggtaagaatctagcaagtgtgattgccaccctgggaccatgcattggctgcccaacaagtttgcccaataatgatgcagctgcagctctttgctgcatagggatttcctctacacaacataaaaaaaagtaagtaatatgttgcaaagaagtagatctaaagtattgggagtaagttaaaacatgaaatgatgaatacaagtgaaaagcagtaaaaacaaagcaactctgtcgaatgttcagaaactttactggaattgagtctggcaatgtaaacatgagaagttttttggatttttttaaaaatggaataattagaggagaaattatgcataaaagcatcagcttgtaaagaatgctagaaacatgtaaaaacattaagtgtttgaaataatgacaataagcagatcatcagctcatagactcaaaatctcatatgaaacaaaacacgctaaagtaaatattatcaccttcaagtggtaacataagttctagaatgtacactacaccaccatgcttggcagcagcccaggccagctccggtgtgctggctaaagaatagaggacagtaagggctccatccctgcaagaacgattgcagtgcagtatctggaaaagcaaaatgagacttgttctttctgcaaccatggcttccaaacaaggcgcatgcttcgtcaggagagaaagaacgcttaggcaaatttgtgggatgttgctttcaggaggaacaggtagcgcaagacattcaaaaagaggtgtcaaccgttccttggaagcaaaaacagcagccaatcctggattactggttagaagattctgcagtaaaaaaataaaatgcattttaaaatgtgcctcataggtataacacataaaacttacaaaacttctcctgaaatggtacctgtagtgatgttagcccacttcggaggttcataatcacttcagaatctccatctgttactcctctattgtgtttttccaatgaatcttcttcttttccttcattcgttgaaccactgatatcaccattttcagtgactgatgtctcaatagctgtaccacattgatgcatcatattttcatccaaacttaatgaattccacttctgtactagctctgctataaatttaagcagcgcgatgcaaaaaccttcctggtcacttatttcataatctggttggttgttgtaaactctcaagtacacattaccaacattcagttcttttgataaagcttggtatgtgaaacaatgtgattccgtcaaatcatatgaaccatcaggtccttggctagcacgctgctggtctacaaatttgaggagctcgcctctggtggaagaattccatatgatctgcaacaaggagagttattaagctaaacatcacatgcatacattcatctaatagtattatattattgttagataaaagtggtgttgcatacagaacttataattataatttctcattgtcacatacaataaaatagtactagattattgtgaaatattacctccgccccaaaatataaggagttttaaggttggacacagttattaagaaagttggtggaattgaatggaggaaggttgtgattggttgagaaaagaaggtaggtagagaatttgaatggtggaaagttgtgattggttgaaacgagaacgtaggtggagaagttatattttgggaaaatttttgaaagctagaagtagttatattttgggacagagggagtaactacattgagcagaaggagaagaacttatagttgccccatataaagcaaatattgatgaagcaacttataatcaagaacatgataaatattgatgaagcaaattgtatggataaatgaattagtcggtcttatgttcatttcacaaagagaaaaacaagagtgccatgcccagtcaggagtaatctgagaatgtgtattcaactatcatcgctacgatttttagcatgtcgaaaaaaaatccactctaatgataattccctaaattgagcttaacacgctcttgcatgtgtttgtctgcacataacaatcacagatgatgcaggttatggtgaggaacaaaatgcaaaaatttcaaagatatactaatgacaatgatcattggattgatggaacactccaggcatgtaatacaaatgaaatttaatctattacctctggtgactccaaatttgcattcagatttgacaacagttctttaggtgggtggtttctcagcatatcagcaagcttcggagtaagaagcgctcttagtgcatcaaaagcagattgattagatgggcttattccatcaccaccaagaccacaaagccttgacagagcctgagttgcatgtacagcatgcagatttttagcaatctgcacccttgcaccaacaccatgtgcttcacttgttgcattctcttctgctgttgaatcgtactgaagcaatagaggcaacacatacctgcgagtaaatcttaattagatatatcattcacataacttgggatttcagtatgccattccctaatctatctatccagattaataatagtaattgcaattaggatagcaaggcattaccataaaaatccagccgcgagcagagaactttgcaattctgatgacactgatatattagcagctgtttgcagtgcagcatccacagccgatggaacaaattcaagttctgtactgtgcacaatatcctcaacaaggccaccaaacttaagaatctcagcccttcctgactcaaactggctgagaaccgcaaatgtatgcattatgttggtgactattcttgctgccggttcatttgctggggttgtgggctgaacaatgcacatgcaacgagaaagaagtgttgccaacaatgggataccaccatcccgtatgagctcttcgccatttaatgaagatgatgcgcatctaacaaagcatgaagcacataatccagttgatattcaatcaaagtaaacattatcttaaaaaaacataggtaaagtcagtttgtcttcacttacgtcagccaaattagctctgaagcagctatcaaaagaggggctctctcagatgaaagaaaattgctatcatccttatctacagtgactgcatttagcaacattggataaccagcatacttgaatggttccaagacatgtccatatctcttgtacaagatgcactgtgccctgagtaagagtagcagcctccaaacttgtggtccctgcagtccctgcatacttgcctgcatgtagataatatatttagtgattacccagcagtgtaaaaccatatgttaaaagggtgcattgaaaagaaaaaaaaaacttaagggactctcctttttcacataaaaaccaagagttccaactgcattcatttgtagttaagcttagctaatcaataagataattcaactttaactaaaaaaatgagtatgtgaaagattgcaggatatcatccgaggaagaaatgagtatacctgcaatcgttcgtaagccttttgcacagcaacaaacttttctcttccctcaggattcttatctggatggtattttattgccagcttacggtattggcgcttaagcttctcttcgtcaatgttttcaatgttgtttgtcaaattgcccgaacttaactcagatgactgcttgctactgccgttctcaccaaggacaagatcatcaagagagatctccagtatcttacaagcatcttcttcagatagatccattggacgacgagttaactcttcacgccacattgccaacaatgactgcaaaaactctacatgttcaacaatgggccagttaggaaacctaatctcgtcacataggttccggaggtagtatcggtggcaccacatctcatctttcagattcgggtaggtcacaggtggcataggagcataatcatacaatgaatgacaatgttgagccaatttctgaggaaagtcaccgagatgctgcaggacctgagaaagccagtcgtatggacagaacaatttgaaaattagattaaaaactcatgatctcaaagtaaacattttaacaaataactagggtggtaaatacctgacgaattagatgctccgcccgcatcttgtgggtccatataatctctggcgtgtcagaatcagacaccattgcggcagcaaaagctgaaggtccactgcgttctaagacatacaacaatgattctgggagcagtccacctagtacactgcgctttgccaaaggcaatgatgaagatactgctgcctcttcaccaccatgaaatgcctgatgagtatgtgtggctgaaaagagttgtgcgatcgataggagatttgaaccgggatatgccaatgcaaagtaaaaggcaccggtactatatagtcgaatcatagctttggggtttcttgtgacaatagccttaagtaatgaggcagctgcttcaacaatgcttggttccccagtaagcatagcctataccatttcaaatttatcatttcctgtcagtgttcgataatagaagtagacaaaaataaaactatccaaaagcaagaaagaaataatatgaaagaatgaacagaacattgaggagttaaagcatgaaatttatacatgtaagaacagcttgtcgagaatataaccaagtctccttgggactattggttgtctggcagtgccaatgaactataatttattgtttgactgcaaatttgtaaattctgtaaattacaatatatatacacacactataggagactgtcctacagtaattttccaaaaaaaaaaaaaggagctataattttcagcactgttgtattaaggaaagatacttcatcagcatatcttaattgttgcattatgcttaacatccatgcttctaaccatagcctaagctatcagttgtaaattaagggtatgaaagctcttcttatacacatggccaaataataatatagctaggtcatcatacacaaactagtccccgcatgataggggaagcaaatttggaactaagtacctgagcaacatgaggaaggcatcttggacttgacaatatacgtttcaccctaggagttggtgtcactatctctcctgcatcatcaagatcagaatgtgcagatgccatactgtgtaatatagacaatgcagcatccccaatctgtaaatagaaatacattttgcataagtgttaattgatgagtaaaataaaattgtcgtgcatgtttgcatgtcggtttgataccaggctgtagattcaatacctgactaggagtaagaacaggcactttaacagcaagtgcccaacggagttcccggatatcacgtaatcttttccagtcagacataccagaagcccaacatttggtggtccaatcaattgacttctttgaccatagccttctgatagcatccttttctagagggccaacttgtttaccgtctttgtcaatatacatccactctttcagaggttccataaatgcagttgccgcgatcaggttagactgcaaaggaatagctgtccgctcagatgcttcatgagcgacagttaacatatcaacagccaaaacacatcctccaaccaaaacacacacttcaacatttgaaaggtcgttcatcaaggcctacaaaaacatgaagaaacttactcaggcagatttctcagaaaaaaagtatgttaggtcagcaaaatcatattagttttttatagtagtctgaagtcatgaacatgttctagagctatatcatcgcgtttatgaattctggacttctggtgtacgtgcagcaaagtccacatgaatagaacttgtcgacattcccatatctagtatacttatgcccatcttatttgctgatacaaaagaaaatgggagaagtgcaaagaggtaattcagctagagtacaaccaacctttaacagtagtagcaagcgatgtcttaatgccctatcatctgttctgtccaagagaacagtaatatgtgctgtgccatcgaaaggtccaataactttgttatgttgttcataaactatagccattgcccttgaacaaagttctcttacagaagaacctcctcccccaccaaaaccatccaatcttcccaagtcacaccaatcatcagatgaacccagttcatcagggactgcaccatccacagtaagaccaatgtctgcatcgcacaagaagcggtgatacagagctctaaaaaaggcaacaggatcacgcagtgggaaatcctgtgctcggtaattgcttccactttcaagaagaagccgcagatagtattggcccacacagacttctttggacaagctagggtagctaactgaaaactcaacataattccatgaaattcgtggtaaggtttcactatcactggcatcctcagtgactgaacttccagggacaatgtcatcagttcgttctttctcaacatcaaggctatgaacttcagcttgcaatgcctcccttaattcttgtctagtgcgttcattccatatcaagtctgctctattgtgatcaagactgaatgctctccaaaatccataccagttgcacagtagcctgccagatccaacaggtgtgttttccaccacaacctgtgcagggactgaaaaatctaaatgtgcagagttagcaaggtcaccattgccattggagtccactaaataagcatgtgaatccagctgtggtgccccagtttgatgattattttcatagaaggcctcaggtacaaaaccatgtggaactgcctgagaaggatcaatacttatgcctggagaaggggtatatgcagtagggtactgattagcatgcctctgatggacatctgctccaaagggaccaacattggtgtgcccaaaaaaatccccttcattgttatttgagggcatcccttgttctggtacagccatactcttgccaccacgggacctcctctgctgaagtatccgtttctgccttctgcttaatggtacttcatcatactggttctgagaatcttcatctgatcgtgtgtgaagataagcaacaagtccagggggaagtattcttgacagcaaatccagtgcaggttgataagaatcagcccagagagcaacaagctgtcgactaacatcacgtcgctcaccagcagggtagaagaaagcattcagtaaatgcctcagaagagcaccatccttcaaggcagcatcacgcatggactctgctgctattgcatcttcttcagcaattgtacgcataataacagaaacagtctccctcacactttcagcaggatgggcaaataatgcaaacaaacgacggcgcaaaccagcgacttgacgtagtagctcaacaaatgtagcatgttgggttgtttcaccatggggttcacaaagcatagcttcaaggacttccacaatggacaatgacagtaatggtgaaactgatagtggccttaatctgttaacaaggattggaacatagactggttgtgagaacagtacagactttgcatgcatgtaagtagcatgtgactctccccttgtatccgttaacatggatgtatcaccaggaccaccaccaattagcatagccacaagtccagcagcctcagctgctactccctctgaaccatttctaagcaaacccattattctccctacagccacaggaaatgccatcacgtgtgctgacacacttcttgatgtgaggagcctccgtaagcatgcgacaaatcccattattgtcgctgctgcttttggtgatggaggtggaagaggaggagcatcagcaggaaggttctgcggtgtagctgggagaagactaattagagccattaggaccacttcaggtacttcaatattgacgggcactccagtatagggtatgcatgcattgaactcccttattctacgccacaatctgatttttgctccaggaacagtgtcggatgaaactacagcctctttagcaacagtagctaaatgttttatgtgcatgctagcagcttccatatcaacagtgtgatgggatatgtgaacacgggctactccacagggtggatctatgcgatgaccaggcatggtcaaccttggtagcactggaatggcacactggctctgagtaaggagattaaaaaagaatgtgaggtgccaatgtgagcatggtaatggtagcaaacaaatgcaagatgagcatggcctaataagtaagcaaggtgaatattttgctatcaagaagtcattatggtcgcagtcttcagagcagctttgctcaagtacaattctgagtcagtatacaatcccctaaaagaaactaagaaacagttatacaattacatattacatataggaaatagcaggattaaataagcactcattacaaaggggacatatatggtgtttatctcattacactgttcagtaaatttctggctttgacaaattagatgtgtcatgtaaattgtactcttacatacaacttctgaggtgtaactgaaattgtcgaacagaaactatgacttaaatgctgaccggaatatgtgccttcatcttctattttttaaaaaagtgcatcactaaatccatggtgaagtacaaataagacagtcatgctcgccacacaccataaatttgagcattaaaatacatcaaggtggacctcagtcattttgtatctttgcaattccatattgaactcaagtgatataaactgactaagatcgaagtcatacctggttttgtaaaacatcaagaactgttgcaagtaaactatcacgggatgtacttgcatatacctgagtgaggaaacagccaagaattaggaggcattcgtggtattgtgcatagagactatgcatgcatacttacatgaatcgggcaaccatcattgaattcgaatgcaaacatctgcggttcttctgcaaatcgcacaagggcacttactgttgagagaggtcgaacaatgatagcctgaaaagaaaatattcagagcaaagaagttagaaccctaacatgctaaagataaagggagcaaggaaggagaagcggtcttgcaaaagaaactccagaggagacaaccatgtagagggtgcaacaaaagacttacccatggcccatgggcctcatcccttgaaactacaattactagtaagttgatttggcaaggggtgtagaaagttgatgcatgttcatatgtaatcgaaattttacgaatagtttgtatgagaacaggtgaaaagaagccaacatctacctcataattctccggtcgtctttcgacaagtgaagtgtttgtaagaacaagctgtcgagaaacggaatcaccatgatctccaagtcccccccttggtccaatacccaagctcaagctctcaatgctagcagtgccatgtgcagcaggacgcaatcttgttactgaccattctccatgccgagtttcagcagctccaacagcctcgtttgctgggaaaagaagttacaccagtttaagtttctgctccctttagcgcaatagatacgggattatggagctcatacatgacatatacatggaattcattgacagttgaaggtgacatttcatactgagtcagttcgtaatgatttggaaccataaccccagttaaggtgttgcctagcatcaaaatcatatgaatggcaaggtgccatacgaagatgatgcacgacagtcacataaataggtgtagaaaaatggtagcaccaaggtgaagcttatcgttgcaagagattcaaagcctacctctctttgctatgaagtcagtagctgtcattgactgtgaattgtccacatgtagtgatactccaaccatcgagttggctgtttttgtctgtaagataaccggcattaggatgttacatcaatatgtgtaatctgcatatcatgtagaaaggaatggaacgattggacaatgggatgacagaagggtgtaccaaatatgatataatcagagtgtttgtactgcctgaagcagccataaatgctttggacttcctcccataaagggggcatagcacaaaacctcctccttcagcagtcctcttcccatagctatcccccaagagaatgatagcaggagaatccatatctctaaagtccaagcaccagcgcagatcaccagaatgtccttcaaggagctcaatgcccactgaagtaaccttgagtttctatagagagtagatcaaaaccaggaaccaagaatcagaaaccaacaactggtgattaaacaacagtatattcctttgaaacagctttgagtgagtacatttcattggagatatgctgaaagtagctatctcatctaactatgcatcaagttaataaattgttggctgcagatttcaaatatttctagttttctaccagctagttatagaactcagttttaattaataggtgttgcagcacctgattccgaaaaaaaaggtgccatagataagactataacaaaccaggaaaggaagattattgtaaaggcacattgctttgtttctaatagtagtccaattggtagcatgttaaccaaatttggtgctgtgacagtatacagcgatttgtaacacaaggacatatcataagcaaccaatttgggcataagcttaaggcttcagttcagagcgatgaaaccgctctgtttgccattccactttgtttcactaattagccagttcagctacatgaggtagcctttaattataataaatatgaggataatgcagttaatagcactgctgtggatccgaaaactagagagaggattgggctctctgaagcatgaatcattcagcgcagagtgtgatgcagaaatatttgtaagggattgaaccttgcattgcaatagtagtgcaaataatacacaagacagcagaggtgagagtacgaaggaagatcagatttgggataagacgatggaggagagcttacgaagggcgcccactcgtgggtgcggcggcggaggtggaggacggggaagtcgaggacggggtggacggggcgcaggcggtggagctcggtgaggatcccggcacggagcggcgaggagaagcgcagggccttgaacttgccgcgggcgtcggtgcggagggtgagcgtgaactcggtggcgttgccctcgggcgcggcgcggtcgaagccgtaggaggcgtcgtaggagttggtgacggcgagggtggccgggtcgagggtgacgaggccggaggaggcgatgcagaggatccgcctgtacctgcccctccacgagtgcttgacgacgaagtacctggcgaggtactcgggctcctcggcggcggcggaggaggaggaggaggcagaggaggcgcggggcgaggaaggggaagacgcgtcgggcgccggcggcggggcggaggcggcgtggcggctggcgaagtccatggtggagaagtctatgcggcggcgagcattagggttccaccagtggaaggggaagaaggctccgggcggcgggggctgcgccggggagtggcgcgagtgattcgcccccagcgcggccgatctgagcgacgagatcccccacccgatcctggccggcgatcgcccgttgggtgggtcggtcggtgcccccgctctccggcggcggcggcggagagattatcctcttctcggctttgatcgatcggattgattgcgttttcctcctcttcttcttcgtgcgatctcgtctcgtctcgtctcaggtagaaatcctttctttgttttttttttaatttaacaaaaacacatgcgccggcttggctaatgcccttctccttcgtgttggtgtcgtgtcgtgtcgtagccaggaaggaaggagaaa

SEQ ID NO: 75919 - DNA, 8404 bp, Oryza sativa
gtcatttttttctttttactcgagagaaaaatgttttttttatttttttcgagagacatttattttattcttaaaaacattttttctgttcaccaaacttttatctaagcaaaactcatacagggctgagataaagttacataacatagcagagaagcatttggcaatatacgtaccatgcaccttgagaggtgatatgtttctcctttgcctgttttggcaattgatttgttcctggcccttgacttacctccagtgtgactcgtgcttaagaactcacccatcaaattgaaaagttttcctataggggttagtacatgaagggtatacatccgaagtccatgaaagtactatctctacggttcatttaagcaaacttgacaccacgtcaactttgattaaagcaagctatttatcctaagcatcatgcttaatttaaaaagcctatgaatgtcgacgaccacccaaaccatagcatacgaaaatagaccgaggacgcataaccatgcatgatcaagctagactcaactagagataagtatgaataaaagtaatggtgaatcttttgttgtatacctgagtgtgcttaccgccggcatgatgtatatgttgaaatctctagagcggtggcacggtcaaatgtgattgtcgatctttcctccgtcttgatgcgggttgtggcggaggaaggcactttgattatgccaactcaggcaagtggttcggttatgcacacatctcgggtgcaagaaccttatgccttgaaggcatgttccgtcggcataatgctgaagagacgtaggatgcatctcttttcgggcaagtatgcaagtgccaactggagtagagcagcaaacacctagaaaagaagagggcatttcctgttgcttgtatgcatgtaggtgttgtgggagcgacaagttgtccacacctaggagtggatgaaggctaagtcaaggcggcacatgagctcaagagaggggctgggtgtagcctagcagcatggttgctaatagcaaggtgtatagccatattttaaagactcgcagatatctattgaaacattccaatcatattcctttgttccaaaagataacataggaaatcctttccaagcattccaattcttaaaaatatcctttaaagttccttcaatgcgagcccttcgcggagccaaatttaggcatgttcaaggagcttatggtagtcacaacttcttctagaatctacatctctccaaacaatgacaatataaaagtaagaaatacgtgagtggtaccaaacgactctccaacacgtgtcctcggctccaccatgctacaccccacgcttgctcgccttgctagtttcaactctcccatctctctctatttacatgttgatggagggggtggtggaagggataaggctggctcatggagccgtatggtgttgggtcggtcatgctattaccaatctggctagtcatgggagctagataatgttgttgtatgtttttttcttcttaaccagagattgggttttcgtcacccattgccatttttcatcctcatgcgcacagtggaaaaaactagaccagaccgacgatccaaccagaaaaaatggaaaaattgttatcctcggtttggttttttcgtcactcatcaccactcatcgtccttggaccttagcttctttactccgacaccagcatcgcctatggctttatctccatcttgccgccttgcacatcatcggcttgatcacccgatcaagtgcctagctacaacgatgatttcctcaactggtcgtgttcaagaacgagcgtcatctgtcactaagcttcagggtgcctacccatggatcacacccattgttttgtcactaagatgtgccctttttagcatggcctcaccgcttgtggacttcttgtcactgcttttacatggaacgttgctcgccgtagctgttttgttctactcggactttagtgtcaccactctcttcatcttgatcgccgttcacacgacatcctcgttgtctgcatcggtctacatcacccacttgaggtcttcttcacctacttcaagtatcgctgccacatcttcttctaacggacattgttgctactttagcacggtggtccagttgcccttgaattagccaccgacattgcggtttggctttctcatcatttttatccctgactttggctacatcgaccacgactgctttacacaactcgctcaaccacagcttcttcgtgcccttagatttgggtacctcgacaacatcacaaggattatcgttatcgagcactctcattagtttattctccaatgacatggatttggtgccccacccaaaaaggagacccaactcctaataaccctgttaagtgataattcaatagcataatactccctctatttctaaatgtttgacaccgttgactttttaacacgtgtttgaccgtcgtcttatttaaaaaaatttgtgaaatatgtaaaactatatgtatacatgaaagtatatttaacaataaatcaaatgataggaaaagaattaataattacttaatttttttaataagatgaatggtcaaatatgtttaaaagaaatcaacagcatcgaatatttagaaacggtgggagtatcttactataccattcaaggctagtgtggttggagtatagtctggatgtacgggcgaagctaaatacctgagcacgagcacgtacataactcataagtggtttcgcaggttcgttatttggagtgagcgaagcattttttttttccgaccgaaatgaaaaaaataaaaacagcttgcatgtgctcggcataaatcaaatataaattaaacaacactcgaattattattcattttgaatagcggtgttgatcgatcattccagtagggaagggcgtggatagggacctgtccggcacgccggccacgctacacccaccacctcccatgtcgcgattttatttgattcaaatcacggggattaatttaaaaaagcacaaggggcaaaagcacgcttctgccctcgctaaacacgtgaacatggacggcccagattttctggcaggttttaaatgataagatcgatccccaactagcacagtagtttatcattcctgtcactgcctcgtgggcctcacctgcctttcctgcacgtggcccaactcatcgatcgggtcaacggtcaaatcgggcggctgggtcacttgctgctagcgacgacgaggctagagtatttatataagcaacccaaatcgttgttatatctactctctgcagccacatttattagcccagtagttacagtgacctgagtaacaccttaaaatcctaattttaagtgaattttagattggattatttgggagctaaattccgtacttcataggctaagtttttaatttaaaattactgtatatatccagttggatgtagaggcacacttctcttaaaaaactctctgcaaccacatgtgctaagctagcttaattagcactaataccactctacttacacatgcaaacatgtttatattaatacaccgtactatttatatactcactccgttcgtaaatatttgacgccgttgactttttaaaacatattggaccgtttgtcttatttaaaaatttaagaaattattaattatttttctatcatttgatttattgttaaatatactactactattcaagtttttgaataatatttacaaaagttttaaataaaataaacggtcaaacatgtttgaaatggccaacagggtcaaacgggagggagggtatagtagcacaacttgtgtgttacggccctcgtggacgcacatgtacaaatatcttcatcatgcacgggcacgataaaaaaggtgcttactaggaacaatttacttattttttattcttccttttgcacacaaatttttccccccaacttgtctaatgtactttgttggaagatatacaatacatatgtatggtatgagttaaatatgcgcctaaatttgcccacgtcagaatgtggaatggtgtaactaatgacttgtgatggtgaaacaaattaacaacccctattagataatagtactagtgtactacaatgaaaatgaacttttaccactcttacatcgatctctttaagagcatttatgcgccgtaattcctttccatcttagagcaaggaacaaggataatagcgagttataagtctactataattttacgtgaagaaggtatatagaaaaaaaaaggttagctctcatacaagagatagttctaacacgtgccctaacacaaatacattaaatgtatcattgagataaagacaaagagaaaaattaaagctataaccttataactaatctattatatgtgttggttttaacttttaatatggactattttttccatttcaaattgatcatcatcttacgtagatgtaccaagaccaaaggaagcttctctcgtcctatatttactccagtaacaaacttggtgtatgcatcatccccattattcttagatgcataaatcaatatccatttactctaatgcacaaaaacgaatatacttaatgaatgaatgcaaatatgatatcatttagaaataacatcaataaaattatatgatgatcaatttaaaacggatggagtaacaggtagcagtgagttatacttatgaaacttgctcttatgaaaataacattgctgtcagtcaattgatcttttttttatgacaatagtacaaaactgcccgcaagttaaggaaggggaaaatagccttaaggcttgagtaactcttgataatgatagaattcgtcttaaacttaaccataggaccgcatgaaccttctgggagaagcacacgtgattttatatttttcttcaaaggaatacgatgtgatccacaaagtcctaaaaagatttagtagtagtataaaacattgtcaaaattcggatcgagcgaaacatatgctccaccactgcctcctaacatgtaatgtaaaatctacaaagataagggatcgtaaaacacttcccacgagaggaaagcagggagagagagcatggtatggaggggaggacgctgacatgtgggatcgagcgagagcggaggctgattacccggagggaggttacacaaacaggagataggagggtggttgcggcggctaggcgagcgatcccataggcccaagccaccatgtgagcgcaccgatgatccgaaaatcgctctttcaaattctattttttaatatatatttttagattatcattattttataactatttttactataaattatactagataaattcatcctaaagatgtcaaaatcttttataaatttttttaagataattataaaaaaaatttatttaaaaaaccttctgtttttttaaataaaggtctatatataaattcacgatatacaaaatgcatgcaaactttctatttataaactttattatgtataaatactcgttatttcagggaggctgaaaagaaaattagtatatactgtactttattatttgcagtatacaaatcgtggaggctaatcacggaatgatgcgcatatgcatgatttgtgtggaaacatgcataccacacgttgatagcgaaaaataggaattgcgggcgatttaacatggtatggctaaaaaaaggaagatgagtgaagcggtgatggtgcggctggcggacgcgcgaatgatcgctaattaggagtgtagacataggaggagtgataataccgaaaatacccctggacactaaatatgatttgatttgagtgattagccatgggacccatgtgggttttgttatctcctctcctcaccaccaaaaatccattccaccccatacccatccccacctttcctctcctcctattctcttcttctcttgtaggagtcctcttccaaatcaaatcaaatctagaagaagaagaaatcgagatcaaatcgatgaacctttggacggacgacaacgcgtcgatgatggaggcgttcatggcctccgccgacctcccggccttcccgtggggggcggcctccaccccgccgccgccgccgccgccgcctcaccaccaccaccaacagcagcagcagcaggtcctgccgccgcctgcagcagctccggcggcggcggcgttcaaccaggacacgctgcagcagcggctgcagtcgatcatcgaggggtctcgggagacgtggacgtacgccatcttctggcagtcctccatcgacgtctccaccggcgcctccctccttgggtggggcgacggctactacaagggctgcgacgacgacaagcgcaagcagcgctcctccacccccgccgccgccgccgagcaggagcaccgcaagcgcgtcctccgcgagctcaactccctcatcgccggcgcaggcgccgcccccgacgaggccgtcgaggaggaggtcaccgacaccgagtggttcttcctcgtctccatgacccagtccttccccagcggcgtcggcctccccggccaggccctgttcgccgccagcccactggatcgccccggcttgtcctccgccccctgtgaccgcgccaggcaggcctacaccttcggcctccgcaccatggtctgcctccccctcgccaccggcgtcctcgagctcggctccaccgacgtcatcttccagaccggggacagcatccccaggatccgcgccctcttcaacctcagcgccgccgccgcctcctcctggcccccccaccccgacgccgcctccgccgatccctccgtgctctggctcgccgacgcgccccccatggacatgaaggactccatctccgccgcagacatctccgtctccaagccaccacccccgccgccgcaccagatccagcacttcgagaacgggagcaccagcacgctcacggagaatcccagcccgtcggtgcacgcgccgacgccctcgcagccggccgcgccgccccagcggcagcagcagcagcagcagagcagccaggctcagcagggccccttccgccgggagctcaacttctccgacttcgcgtccaacggcggcgccgcggccccgcctttcttcaagcccgagaccggcgagatcctaaacttcggcaacgacagcagcagtggccggaggaatccgtcgccggcgcccccggccgccaccgccagcctcaccaccgcgccggggagcctgttctcgcagcacacgccgacgctgacggcggcggcgaacgacgccaagagcaacaaccagaagaggtccatggaggccacctcccgcgccagcaacaccaacaaccacccggcggcgacggcgaacgaggggatgctgtccttctcgtcggcgccgacgacgcggccgtcgacggggacgggcgccccggccaagtcggagtcggaccactcggacctggaggcgtcggtgcgggaggtggagagcagccgcgtggtggcgccgccgccggaggcggagaagcggccgcggaagcgcgggcggaagccggcgaacgggcgggaggagccgctgaaccacgtggaggcggagcggcagcggcgggagaagctcaaccagcgcttctacgcgctgcgcgccgtggtgcccaacgtgtccaagatggacaaggcgtcgctgctgggcgacgccatctcctacatcaacgagctccgggggaagctcacggcgctggagacggacaaggagacgctgcagtcgcagatggagtcgctcaagaaggagcgggacgcgcggccgccggcgccgtcgggcggcggcggagacggcggggcgcggtgccacgcggtggagatcgaggccaagatccttgggctggaggccatgatccgcgtgcagtgccacaagcggaaccacccggcggcgcggctgatgacggcgctgcgggagctggacctggacgtgtaccatgccagcgtctccgtggtcaaggacctcatgatccagcaggtggccgtcaagatggccagccgcgtctactcgcaggaccagctcaacgccgcgctctacacccgcatcgccgagcctggcaccgccgcccggtaactcaactctagcgaggaaacccaatcgatatactctctactctccccaagccggcgtagccatggccagagcttcaggaatgccaagaagacgacgagacgatgatcaaatcatgttgttgttgtaaaattaagtttaaagatctgtgttaggatggatggatggatggagaggatgattgatatcaactcgcaactcaagctgaagctgctgctgctgatcgtcgtcttgtttttgatactgatagcagcggttggtatttcttttcttcctttctttgttagcaggaaggaaggaagggaggaaagaaatcatcggcgatgggctgcagg

SEQ ID NO: 75920 - DNA, 744 bp, Oryza sativa
tatatattacaagtaagtttaataatttataccctgggttgcctcctctaaagtaagaatttgcaggttgcacgcagtatttgtaagaacaccggattccttcatacttgagtttgtaggttgtctttagaatgtagctgagcgtgtaaatcactgcatcttctatcgtatcttgaatactaaagtttactaattgtttgccctgaattgttatattttcatgacgaaggagaagaattgatagtttattgccgctctgaataacaacactactagtgctatagctcagttctccctgatctccaaaagtgataataacattcattgaagcattatatagcttactatttgcaattgttaaaatataacggaacttatcaccacatgcaagaatgattccacattgagataaatcaccaatctgaatcaacacgcaacagtttcgacaattctcatgcttttaacgcatagcatctccgtaaacatcctacataaaagaaaaaatacctttgctggtcaaaagtttttacagaaaattataacaaatacaactttggagcttgtaaaaaacaccagatacaactccaatatgaatcaacacgcaacagtttcgacaattctcacgcatagtatctccgtaaacatcctacataaaagaaaatacctttgctagccaaaagtttgtagagaaaattataacaaatacaactctggagctcgtaaaatacaccagcacaacttaat

SEQ ID NO: 75921 - DNA, 1338 bp, Oryza sativa
gaaagtgcatgattttcacacgagaggcacacaccgttactccctattattcctgaatggcaacggaggcatgcatgctgcacgcacggagtttatactaggccggttgtctaaatggtggagggacacgtggcagtaaataaacaggtaaaagatggaccaagctggcaaggagattagccagctttagatatataaactagaaaacacagcgcggcaaaagccgcgccttacggtgattgttctatttatttgaacattttctcatggccaacaggtggaaacagagatatatagtttagggaagttgaacaaggcacttgacaaaaaatatataaacattattgtcactaaagaagaaaaaaaattcaacacactccaaatttgtttggtactttttatttcaaattccaaacatacgtaatttttggaggcacgcgtagcatatattcagtaaagaaagtttcatataaactaactattcaataaaattcaagggtctatgcattttctttcttgccttctttgctggcaagagttttctgctaggaacttgatacatattggaccagtttagctagagatctggtgtgctctcaataacactaagcccaacttccttaacatcaacaacattatagcgatcctctttgcagagaaacttaagagcaacctggtagccatcccagaaagaaaaatccttcactttctctcacctctccaagatattcagcaattataggctttggatttatcttcattgactttagcctgacagagtttcggagaatataaagtgccagctccagttgatctttctgaccataaaatcctgtaatgtagatcattttaagatgggaatgagggtgtgaaggaagactcctcaactcagcatgatcctcactataaaaagatccagtaagagtcacccaaagaaaaacaatagtcccacgtttgctatcatttgatagaactttcacatctctgaaaacaaagaatggacttcggcagccattgatcatttctattttgcaaattaatgttaaaccaagtgatggtgcatgctagtctgattattaaatctttattctttgatgtttgcaatatggtagttaggaatggaactaaagacttagaatataggtggcggcatagtgatgactgatattgcaataaaatcatatgatcagccttgagcagctctcaatgttgacattgaccaaaattaacttattttattatcataaggatccaaagaagaatgacaatatggcatggcatacaaagggattctagtgaaggccaatcgacgatattgactaagatgatatgatacaa

SEQ ID NO: 75922 - DNA, 1230 bp, Oryza sativa
tccaacagattctagtacataacaacataacacttgtgcagcacctctcagtaaaaacctgatattgtaaaacggcaaatttaagtagagataaaagtcaaaaactaatttgtaaccacaacacttcacacatgagctgacacatacaatgcaagaactgtcaaggaagatggataaacaacagaatataattaggatatggtctcgattctgttggcatttaactactatccacagattatacagcaaagaaggcatatacacattatgtgttgatctgttactctcttagcattaaaaataaaccactacacatgcattaaaatgtgacatgcatatacctggtttgaagaacacggatagaccaaaatatattgcgtctatatcatcatctcctttttagctcgctgtaatgcccttctcctgaacgccaccaccgacctcctcgctcccatccaacgacgaggaggaggggccagcggcagggacgaagctaagtagtgttatggggttcctaggcacccggttgcaaaagaaaaattagtgcttaataccccttagtaaccatatgtgcaccccctcagctaagcttggtgtacccccacgctagaaatcaggccattgaagcacgaacagcctacaaccataaccacgataggagcccagttcagtcctgcttgcctcatcagcgtgaggacgtacgcacacgcacgcctcttctctttttttttctttctggcgactcgctcttcctctttgtccctaccagtgccgacgcctcttgccgctaatgccacaattaatcctcgcctcttaccgccaatgccataattaatcctggatgactaattaatcgacgcctcagcaagatgatgggatgtcaccgaggctgggcacaggcaattccttgcctcctctatcttctgttctatttgctaattctttaccagtcaatggattcatttgaatagctccttcacttttcaattacgcgataatagctatctttttttccagatcgaatggttatggttagtgcagttttttatctctgcttctttgttagtgcattccactgttattgctgatgataacaacacgcaaaaaaattataatttactataatattgttttaaaaaatatataaattactccctccgtttaaaaatataaaaagttttagagttggacacgattattaagaaagtttggatgagtagtgaatgtagg

SEQ ID NO: 75923 - DNA, 966 bp, Oryza sativa
agtggatcccccctcgtttttgttcttgggcagaaagcctgacgaaactgaatcctccaacaaaagcaaatggcgaagcgtgggctttgttgttaattatactttttgagtttgcccattcctcgaggttggtagtggtgaactggttggtgttggtgttgttgttgatgcttctttgatgagcgcactgttgcttgcagggctccttaattaatcgctttttcccaagatttcgtttttaatttatatttatatactcttctttttttctccggcttctaggtagaagcagggggagacagagcggccagtgtctttctctacaagaaattcctcggtttccacgcgcgctttggcatttcttttcttttgtttttcttttttttacctttcctttcatctcttccgctggttttgtgggatatttgtggggggttttgggggtttagaatctctttgatttcttgtgctttttcttgctttttctcgtgatgttggagtggtgtgttttctgatttgatccgcccaagtagcgattttcttttttcttttcttgttgtttgtttggaggggggaaaaggttgcgatcttggtggcgcgccgatggcgtcgtcgtgcatccccaccggcctccggctggacctggagatggtaaaggcggcggcgccgcccggtggctcgtcggcggcggcgcactcgtcggcgtcgtcgacgctgtcggaggcgtcgaactcgtcgtcgtcgtcggtggcgtcgctgtcgctgaagcgggcgcgcacgccgcggaagcggcccaaccagacgtacaacgaggcggcggcgctgctcgcgtccatgtacccctccgtgttccccgtcatcaagggcgccgggacggcgccgccgcggctgctcggcctcgccaccgcgctcgccgacgacccctcctcctccgatctcctcccgccgttccccgtcctcgggaac

SEQ ID NO: 75924 - DNA, 822 bp, Oryza sativa
gctcacggacaccaccaggcatacaggtcgataatcgatcgatcggccggcggagaaagcagggcaaaaaaactggttacaaatttacaactgggatcctcaaccgaaaaaactctggagacagcagggccgataaaaatctcctaaccattggatcctaaattttcaagattcagcaaccacacaataaaccgtatgacaacagaattacacaaaaactggagaggtttaaggagtggagtagaatcgagagggtttagagtccatcagagaaagaagaggcagccaatgtctctgaagacattaacaccattagtgccataggaagggacaaacttctctttcagttgtcactatcacacaccttacctccctgtggaccccacctcctctcacgacatttctcctcttcttcttccctctaccattctagactgactgtgtttagttcaacgcaaaatttaaaatttgattaaatttagagtcgatgtaactaaaaagttgtgtgtatgaaatgtttgatgtgatagaaagttaaaagtttagaaaaaatttagaactaaacacacccacagccctattctaccctcacacctcatgcgtagtgtagttagcatcacccctacatacatgtgttcttctggtccaaagctatgagatacacgtgtgagactttgcacactgcgtctgcgagtctggctggctctcacggtcacacgtagtacgtgtgactgacctagtacaccatcccacggccaatgcggctctcacttgctttgcccgtactgctgctaacaggggaggatggaaaggcacgtactc

SEQ ID NO: 75925 - DNA, 2643 bp, Oryza sativa
  unsure (1)..(2643): unsure at all n locations
tttaaaaattcgatctttagaatctcaaaactgatctcggtctccaacaaaacttaagaccgagcaattcggtcttcggttagttcggttcggtctcggttatagacctaactaaccataacaaaagtttgaacaacaaaaaaacaaattaaataatcagtaagatcgatgaatcaagcaattaggccgcagatgacacactacaaattggtgtcactagcaaatcgagcacgatttagaaaaaaaaaagcaaatcgagccgatttagaaaaaaaaaagcaaattgatactgtcaatctgccatgacttaaatccattgacttgaatctgcaatctactcatggctgtcctcttcccatcaccgagctcatagctcacagcgaatcggcgatggaggttggctggaggcggaccctacttgcaaggtctctcaaaccattgggggaaaagtgtagttctacaaaattggtagtccttatttaaagaagtgcaattttgtaccaattttggcaatataagtgaatgcttgcacaaagatttattaacacataatcttgctcctcaagttcaggtaggaattgcaagtgcaaatcaaaatgtactgcatatgcataccagagcaggaatttgggcaactcaaagtgcttgcaggtttgcaaacacacaaaaaccatcccaccatctaggcattcgttctccggatccacagttacataggagtaccaaattgaatggaaataaaacaacatcatctgtgtagtgtgtaggtgctgtctagcctttaaatttttcctaccctattcaatgaaacaacgcattttctggtgcattcgttcaaagaaaaacatctcccaagaatctcccaagtaattcctttcaagacacattacaagaatcgacaaaatttctgaaatactcccaagatcatgtattcatgttacttccactcatcttgcactgaatttacatgatgaaagaaagcgagacgagaacaaattgcagagaagaagcacaattgttatgcctgcaaatttacaggatgcaaacgagaaaacaaatcggagcatttcaccaaattaataccacgaattatatgattatgcaagcgctaaacctgattagagatgcaattggaagaaccgtgcgagccgttgtctcctactgccgccgccgccgttgtcgtcgtctctactgctgctggcgcggtggcggaccgttggcatggccgtcgagcttggccctgagctccttggcgccctggcgaactctggcaactcggcctccccgacctcgcccacgtcgacgtcccaccagaaccgcccctcggccttcgcctgcaagatcttcgccgtgatgccgcgcatccgcgccttctccgccgcgacctccgccctggtctcccccaccgcctacctcagcatctcgaggtcgacgtccttgcctaacccgccgctgtggacgggtgcgggctcagcatcctccccggggacggggccgtaggagaggaggacggcgtcgacggatgggtcaccgaaggcgtaggcaaggttggtctcggagaagacgacgacggcgatgctcgcgccggcgagcagggcgagctccgacgccttcttgannnnnngccccgccgcttggtgaaggtgacctgccgcctttccttgttgtcgatgtgctgcctccccttactagtcctcccgagcggacgcatcgtcctcgtcgatcaagagacgcggatgagggcgacggcggctctgcttcttggtttcttgggtgctctggttcttgcaagtgctgcttctccaaaatgaaaaacaatgcgatgatatcccactacaaaatggagatcgaaattttgggggcttcggttgcccacatttcctaaatattgaggtgggataaacggggaagtgtgctagaagaatatgtgcggagaaaataaaaaaaattcactaaatcgcaattggaactgggaaaattgttagaagaataggtgtggagaaattttttgttaagtaaatgaaaattgtcaaaagaatgctacatacatgtatatatttgttaagtgaagatgtttaataaggcctaaagattacacggagaagacataaaaatccgagaaatgaatcaaaggggaaaacaaagaataatcaatcacaaatcaagtttacaatacaaagatagcatgtctcatgcccacatcgtgtctttacgtcgcatcctaatcagtgtttaatttggtaaaattggctatgacatgcccttttggtcttgttttgcatgcattagacaacttcatacaccaaagcaaacattttaaattcatgtactaaaaagcattcacctaacaagtttgtacatcatcaatacaatctactcaaaattagaatttcatttttctagttgcactctcatggatcattcaaaattagaatttcatttttccagttgcactctcatggatcattgacaagtgatggatccaccggtgggtcgtagagacagctattattcttagactattactatagccctcatttcaaatataagtcatcttagtgttatatacaggattaagaaaaaaatatacaataatcatagaaataagtttaaattccctaggatcacaattcgcgtgtttcg

SEQ ID NO: 75926 - DNA, 1341 bp, Oryza sativa
ccatggcgcgagcctcaagggcctcttagcgctgccgggacgccgcctcgttttccgccgcccgccgttcccgtgcagcggcggcgtcaaggactccccgggcggcgtcgagccaatcgctcttccagtcgtcccacttcttgcggagaacgcagggaatgtagcggtgtagcacctgcccccgcggctggaagtagcaaccaccaactaccgtcggcggcgacaccggctgtacggtgaagaaccactggaacagccggagagatgggcgcaccccgataaacatctcgcacaggtgcgcgaagatggccaacgtcattattgcgttaggggtgaggtgcgccatctggagatcataaaactccagaatatccatgaaaaaagaagagaatggcgggaccagccctgccattgcgaaagagaggaagaagacggaccgccccgggtagtgtggcgccgggcgtccctcgcccagctcgaccacctcccggccggtggcagattccggcatgaatcggcgcggagcccggcctgcctctcgctcacgatgcgggaaggcggcagcacgctaccgtcgagcggtgtggagccccgtgccatgacgccggcggaggaggagcttgagagcgagcgagtacggcgagggtagggcacaggaaacgaagagttagagcgcaagtggcgaaggcaaggggaatagtggcgagaggaaggaaacgaatctcttcctcggcgtctttatacccttgccaacgctattcccggctcctcgtttcccgcgcccactacctcgcccctcgtttctcgcgcccacgcctccactaatcccactcgcccgtttgcggcgcacgcggcagatgtgcggccgtggcagttgagatgggacagatcgtgctcgcgttaactacgctcgccgaccgaagcgccatcatcatgtctccaggcgaaacgaaccggctcgtcccgattcgcacgctactcgagtaatgtagcggtcttaaagagaccgctcattattgacggtcgtttttcccttgccgatgtgcgcgatttgcgaccactgggtttctgcccgcctgtagagaccggccccacctgtcaccaggcctaaggagtggcgtcacacccgagcgcttccctcgaggggggcgatcgccctggcgtaacgccgggggctactgtcggtgacatgggaccgggggtatcgtgactagaggcttgggcagccgctgtcacccacgtggcctgaccccctcgggggggtcaggcctgagggtgacgaggccacccctccctctgtctccccgaggggtcgggccgctcccgttttggccccgaggg

SEQ ID NO: 75927 - DNA, 19727 bp, Oryza sativa
acccctcctcctcctccaggcccatctccatctccgccgccccgtccgacctcctcgccagcgtccagtctgtcgcctccgccctcaccaccatcgtcctcgtcacgagtcaggccacttccttgccgccacctccccgatgacgacccggactccgacttcgcgcccgacaacccggacctcctccgcaacagccccgtccccgaccgcctcctcgtcgtctccgggggtgtcgccgccaacctcctcttcaccttcctcatagtctacgccctcggccgcccgccgccgcccctcttgtctccggcctcctcggccgtagatggggaagggggagagaaaggggagagagaggggggaagggaagagccagacgggttggagagagaggatgacatgggagccccacatgtcagtgggtcccataatatatatatttttttgtgaatgacagatgggtcccataatttttttttaaaattctaatgccacttaaggccacgtgggacgaagactgggtcaacactgccacgtcagcgccacgtcagtaaaaccgccctccaataccgctgagggagtcaaatcgcaccggtttcaatagttcggggagtcgttctatccggttttctggttgtgcgatacgaattagattcggcgtacaattaagagagtcaaagtggactttttcctaatagcaataagccaatttttcaaccctaggctgagttaatagccacccatcttggtaacaaattaggcccaagctcagatcaagtcgcattgtcctaggttgcccataaataatacttaggatatgtttagattgtagccaaaataaatcttactaaatttgacatttacaatttggcaatattggaaaatctttgagatgactctggcaaaattccataatgcaaccatagacaatcaaccatccattaaatctgcttgattattggctataaattaagcgtttaatgggctagacaaaaggcccaaacaggaattgggtgtttgttgggcctgatcaaatatatattccttcctagaaattaaatactccctccgtttcgaaatgtttgataccgttgactttttagcacatgtttgaccgttcgtcttattcaaaaacttttgtgaaatatgtaaaattatatgcctacatgaaaatatatttaacaatgaatcaaatgataggaaaagaattaataattacttaaattttttgaataagacgaacaatcaaacatatgctaaaaagtcagcggcgtcaaacatttcgaacagagggagtatttattattgggtctgcaaaggctgagtgctactgtggtagttcaaatattcaactcttcaacttcaaggcctcgtcaaatccaacaatattggcactcgagtggtttttttttaactgaagcactcgagtggttagatgtggttagactagttcattgaagatatggagagaagggccggagaggaagacagagcaagaagaattacaagcccaaaaggaaagattttagaggaaatacatgctccgaagcaaaacattttagaacatacctggttcaaagtgaaaccattttgtgagaaatacatataagagtggtataaaaaaagatagtccaaaatataattcactcaaccttaaatgtagctagatcgaccgattagtcccatcccgatggaatgattatattattctctgccagcatgaaattaagctttgaattcaaacccagacttcaaatctagaattttatccacctctcggtattgtaccgatcgatttcaaacctccccatttacttaatcgtatattttgtccgacatataatcccgataagtcctgtgactcgatccctatcccttggtgcatgtacacgtccacatgcatgcacgatcgatctacccaccacgtctcaggccaccggcgataatgggtcggtcgtacgtacgtttgaccttaattgtgtgagtcgatcagttagaattgaagcttagctaagctcgctgcctagcttattggacaagtaaattagcacgccactcacatgatctaaatatctgatcccaaacatttggagtatatagatcaggatgggacgcccaaaccacgcatcagtgatgtggcaacgcgccatatgcataacacgtggtccccaccctatccacaggataagaagtgaagtagtacatgccaacgtttcaatgcaaagggcacaggaagatatacgtttaactatttaccttatttaaataatttacataactataatttagtttattgtgagttgttttaccataaaagtttttaaacatgatttatatcttatacatttgaacataaattttaaataaaataaatagttataaatgtgtgtctaaaagttaacggtattacatatgttaaaaattaaatgaaagaagtagtaagtagattaaaagaaaggagtagtaagtaggtagcatatcgtgtacgcaatcattcaatcgctcgagaggatagatatttatgatttctatataaaggcaaagtaaaaaagacatcaagtctaaaattatagttgaaaatttaaaattgctttgaattataatccaaagaacaaccaagagcatatacttgcagcacattcataatccacacaggaccacacagtctggttggcaggtgagcgtgtagccgtgtacccatgacgatatgtttatttcagtttgtactgatcaatatgtacattgcacgtggcagtaggtgccatgagccatgcatgtgcccaagaaaaaggccaggtgcgcgtgcgtagtgcgtacgtcgtcagtacgtcggagtaacttctagttattctacctgtcaaaaagagaaaagagagagaaacttctagttaaccggcggccaccctccccttatcatacgtaccttaccatcgattcgtgtgctcgtcgtgttcatttttttaagcaggtacaatagcatactattaaccagtaagtatattttaataagataaaagatgagatagaagagcagtggcctacagatctatagccagctgcagcacggacttcaagacgtaatgtgtgtatgataggtgtgaccatatattaatagtacagtaattaactattttataaattagctattagatcagctatagatgaattagagctaatactcttagtagtgggctatactattaaacttgctcttacggcaacgatgtcctacaaggctacaacgttatctgagagtaaatagaaggtacgttgtggatgtacagctttatcacacctcatactggattacattagctgggttgttagcgtactttagcacctactttagctgggttatcacacctccaactttagcacctaagatgaaaaaataggaaaacgcaaacagctttaagaagacccggtttgccatatgaggtcggtctaaccgctaccacagggccggtcagactgacggtgtgggcccaatctagccgtcagcatgaggccagtcagaccggcagagtccaacttcgagtctgatttatcggttcttgggttttcttgtttgggcctgaggttatcttcaaatcgatctaaactggcctcaaggctgatttgatctctaaatcggctctggtagccagtttaatcttcaacacctatcttgatttagagttatctagatcatgatagtaggcgactccattaacaccgcaaatctttacgtgagtctcatgttgggactgaaaaaggtggcaatagaatgcttacccaccacatccacaaattcaccctccccaccgctcattgtcctattagcacagtgtattctactagcactaattgtactaagtaggccagtaaaacataaatctagctgtcaatgcaatagacaatttagacctactccctcttttgttactttcggctataaatttgatgtaatctatgcctagttcttagctattttttttctagagcgaagggcgtgtttttcaaagaaaaaactagacctattcactatgttcaaaaccattgcacaagttggagggtagcactcttgcccctcactaggccgtcatcatccatgactctacgccaccgcttgtcatacctatatgagacatcctatactaaaattaagtggctcccctattttagtcctcttattatgcaagttttccctactattcagttagggaagtccaatagcttggagacctaaagtactcttttaatcacattttttctatgtatacaacttactactatttcttctattttggaaacttttttttttaccttagcgaagcaaatagttctagctagtagaaaaggatgggtttgactaaataaaggacaaactttagaaatgcctttagtaggacactggacacacactttagaaatgctttttttttatgggatcgtttcatctatgatggatggaatgatcccatttttgtaggaatgatagggtatggcccgcaagtcaatgagataaaggaagcggattggaatggtccttactggattcggttaagaaaagaagttgatcaaccgatggaagcatatccagaagagaccgagttcaagaaggaatcgtgaagaccatggcatggcaatttaattaggtaggatctagtaactttcctttatctttaggaagttttgtctagtgtccgatcggaccttttatcttttcttttaggcaaaatttgctatagggcatcgaaaaaatgtgtaattagcttgtggacaccgcaagaacgagaatttgctgtcgggcataaaaaaatgtgtaattagctgatggatactcacggccttattttattatttccgatggatttggagagagaaacactggtgagagtacgattttgcccctgccatcgtttcacttacagtagactgtgtctggttcgaaccaagacccagtccagtctcactcccctgtagccatcgcgcacggcgaggtgatgttgatctgcctagacttgtaccttgttcaagaggtgacgagcacggaggaaagcagagtcttcgtgagcggtcgccgaagccaccgaatccgaccccaacttgatgtccgcgctcgcaccggcgggctgatctaccaaggagcgggctttgcagatatcccgattccgaccatgcatcgccacaagaggcagtggtggtaggtgacaccaggttcgtgccgccgacgctgcagctggagagcgcctagagaatggacggcaacaggatggtggtggcctggcttgcactgtgcgcgccggcgagcatgacgaggtcgcgggggtgaggtgggcacgccgccttgcgaccggtgagggagagtgcccggagtagaaacgacggaaacatgcttgtacggtacggtgaccggcggcgatcgagtcggggatgaattggggggatcagcgtctaaggtttgcagggatgaatcgaatccaatccaccacgcggtgctcgccttctcactccctcgttgtaagtggaacaatggtaggggcaaaatcgtactctcaccagtgtttctctctccaaatccaccggaaataataaaataagcccgcgagtgtccaccagctaattacacgtttttttgatgcccgacagcaaattctcattcttgcgatgtccaccagctaattacacgttttttaaatgccctgtagcaaattttgccttccttttatctttaggaaacttgtatcgtgtccgatcaggactagtatcaatccgagggtataaatatgtacacccgggttctttgtaatctatctccacaggacaattacataattacttttggactatcgcaacccttattccaccgagttcttaattagtttcgagttgggttgcacggtttcgatctccagcgaggaactaagtttcgtcaacttcgctagtatcggcgtggctagaactatctcggttaagtccgatattctatctaggttgatgcaacgttgcctatctgatatattgattcgatatttaactgcattgttgtttagagtcgtatcaacttagttaagactttctcggttaggtttgatattttgactaagttgatatttctctaatcatactgctgttctagatagatttgttatatccatcatgtttgtgtaaatctatatactaattagatttttcttattatcttcaatcttatattgtctttgttaggtctgatctattagattgctgctagtaaggttaattctagtaacccgataggtttttacgcaacgttcatcggagtgctagccaatgagttatcattattgtgggtttcagctatcagatatatcaattagttagccgatgtacattttaatttacttacatcggatctccaaccaaggtatgctttaaccatcagatttacatttatcacattatatcagtatcggttgattggttcatattatattaactcgttgcatcttctgagttacatcaattcatactcaaacgtgtataatctttaattaaatctatctttatcaacttcaatattgtactgtctcggtttgatccgatctatcaatattgttttttataaagaacggtttattgatgattatgcatactttgattccagccgatgacaacataaatctcattgtttatctggtatatttgaatctacattgagtctatagttgattgatcaaaaccttatcgacatcagctgacatcgctacatcacatcggcctactggctggcaactccttgatcatcaatctatttccatcttgttagttgcaggatcaaactaactggcacgccctgaaaccgattgattaaacctgcactggagctaagcaaatctcccaatccttcgtgtgaatgatgaatttcgcgtcaacaacaccctgaaaatgggttcaccctaacccatcccatcgccttgctccgatcaaacacatgcttagggatagggatgacaatgtagggcccaatcaccaatccgtatggtgaattcatcaattaggcctagatatgacgaaatcttttcaccacgagtcaattagtaggcccaactctcatgtcggatctatttaggccatggctgatgaagcattcactttccccgctaaccatcaggagacctaataaaactgctcacacgtgggattacaatataccatgtataaaacctgcttcaaaccttagatctcaccatgttttgtgaattttgtcttctccaccccacatcaccctctttatttccatttcctcctctttttgctcctttcacctttcgctcctctgacgctagcgcctccactaccatatgctagatcagtgttacccaacattcttccagcaatcccgcgtgcaccagattatcgctgctaccgctacacatgacctctaggcgtgacaacctcattgcctctcactctcagtaattgtgatggcatgtctcggtgagtttctcccttgcaattctcggcagttgttttgggtccctttgataagtgcatggtttgttgggaaagatttagatttctaattgttttgaccatatttttacttgattggtagtgttagcgttcatttgttgtttaattgtaaattttgacacctaaaaattcctacacccccgcttgcggggtatttgtcaggagaatttactatttgccatcctaccaaaaatatatgcccaaatgccactcttataaattttcattcccatttgctatccgagtctacatgtcagccttctttccgggtccacacatgttcacaagcttaataaatagaaatgaaggctgacatgtgagcccaggtaataattgaaaataaaaatttaggaaagtggtatttagccatgtgtatttgggtaggatgacaaataataagtaaatcctcctggtttttgcctgttcctagccggggacggctgcctgtgattccagtagtaatccacggaccagttttgcatcctttaccaattaccagtgaaccgcgttcacataaacccgccgcgccgtttgcgtccattccgtgagaagcgaacacgacccacgggactcgacgcccaccacacggcccagcatgaccatgggcccacttgatccacagaacctctccccacgtgacgccggccaagtggggccggggcccccttagtctaagggccccacctgtcagtcagagctttgccgtgtcacagtcgaggtcgggctctctcccctccctttatttaggccgcgcgcgggccgaacgaacgcaacacccgccacaagctaagctagagcacgagggtcaggcaacgcgtttctctctcgctgaaaagtttgctggatttgctcctctccctctctccgccatggaggaggcccagtgtacgtctctgtctcccttctcttctcttcatctgttcatggtgagtttgattggtggtgtggtgtggtgtgggactctgaggctgtgattgattcgattctgggcgctctctctctctctctctcgctgctttgggagtatcgaaaccgagaatcgggatcggttcttgatcctgttctgttctgttatgttctgggtgtcatggggcagagccccattgggatgtgtgatctggtgtttgagggggagaggttgttacaagctgtttgttgtttcttgctgcctgaattctcggatgaatttggcactgttcttcgttagaatgcacgatgctcgtttgagatctcgtggatagccaataatcatgccgaccaaatcaggattagtataaactctgagaattccggtgaccaccgggttcgattctccatattttgtggagctttttctgttgcaatcgttgttcttggggtcccaaatctgaaacctttttgcgctcgcttaatacttttttttaatgtccattttcaccggaatctgccaaaataaacgcacgttggcgactttattagagggttggtggatgtagatgctcttttttttttctttctctttgacaggaagatgcgtgtgagctgtggcaatgtcattagaaaagtacgcctttttcttgcgtgtaggttgttctgttgagagaaagaaaaaactgatgagaagactatctcgggctgggcatcgcatctttagaattgattgagtgatcaaccggatcaagtaggatatccttgtgagttggcatccctatcacgccatataaggcaaatgcagaactcgtgttcggctggaaacaactgaaagtagatgagagcgatgtcatgctgtctaccggttgtcacagtaactctgttctattgatatgcgtgtaccaactggccgttgatgcctttggatggaaagaagaatctgcttttatgtttctctgccttcttggcatttgtagtatgtctttgacaagtacaactaatctgcctttctggacttcttgcctgatttagtttggggtaaattgcaatactccggatgttcagagacaataagagaatttactcgaattgtcaatcagataacgtttggtagcgatcactatacttttagtacttgttgttaaacttcgttgaaggttctactcttttaggtctctctgcttatgaagttgccaatgatcatgtcctcaatatgtaaaataagctaaaataagttacttttcctgtagttgtggagtcaaaggatggaaccatctcagttgcttctgcatttgctggtcaccatgaaggtaagagtaaaataatgcttctgcattagtcttctcagtttgatctgcagcccagctttcactgtttgggtgatttggggcgcttttaaggtcttccagaagaactgcttagtgttaacttgagttttggaaaaatttacagctgtgcaagatagagaccacaaattcttgacaaaagcagttgaagaagcgtaccggggagttgactgcggtgatggaggcccctttggagcagtcgttgtccgtaatgatgaagtagtagtcagctgccataacatggttctgaagcatactgatccaactgcacatgctgaagtgactgcaataagagaggtgaaatgctttatttatctgtcactgctcgtaaatcatttgttcatgagaatatgtgtatccgtttgggccttttgcgtgttaaacttcgaattgtttaccacaccattttcggatagctactcacattgtcgttctgttaaattttcaggcttgcaaaaagctcggaaaaatcgagctctcagattgtgaaatttacgcgtcttgtgagccatgcccaatgtgctttggtgcagttcatctctcccggatcaaggtctgcacccgtcaattttcctacgcataacctcatcacaaatatctgacgattttatttaacacaactgctaattcttcactacagaggctggtgtatggagccaaggcagaagctgccattgccattggatttgatgacttcattgcagatgctctgagaggcactgggttttaccagaaggccaacatggagatcaagaaggctgatggcaatggagccctgattgcagagcaagtctttgagaagaccaaggagaagtttcagatgtactaatgtgcaggatagagtctcagatacgccaaagtccccctgatgatctagggaggaataaaactacaatgttcagcttttccattatttctcaaactgccaattcaaatgtattttcatcctgataacatttcaattgtctgcatgttaatatcattcaatgaatgggtacctacagaaacaattgcaaaacagagtttgcatgtctatttactcttaaaccatgaaaacgacagatgatggatgctaattaaacatgttgattgaaagcaacgggttactctacattatagctaaaataatatggaaatgactcaagacttgggtggtggcatcagatttgtaaaatccttcttctggtactgaaagaacagaatactcaactataaattgtttctgaaactatcaactcaaaggtgtatttacattctgatgacactcaatatctgcgaattctgttatgtgctcttgcatgaatgttcagtttatacaataaactttctaattaattttccatagatcaacttgctaaaggttagaagtccttgttttcaggttgtcagtaatggttccattgcactggtgcctaaataattctcaattaatcaatttacatcaatgatgtacactaggaatataacactctcagaaaatgtccatactattttgagttttatttgtgtactccatcttttgttgatttcttgattgatatgtagcagactatcagtgtaccaccttctcaggtactcattccatcccaaaatagtttttaaactttgtctcaaaataaaccaatttctaccttcttatctaacttcagcttgcaagtttagaaattgtatcccttcaatacccctcacctaccaaccaaccaacattaattctatattaataagggatatttttgtcttttgactttctccacattggacaagggtagaagttactgtgcatcaacagaaattgtcacattgttactctaatagaaagtggtaactgtatcttttacactcctttgaagttataaacatgggttgcttttatttagagtaagaatccaaacaatacaggacattgaaataataacatcacaccaacagttatctccacaaagctctatacacacgactacacaaggcaagccttaaggcaaaattggaagtcttcaacaatcacttgcaccaaaaataaaaatctacaaggacatagttgatgattggggcgtctaactgtatagagaaatgaacttgaggaaaggattttgtaaccgggtagcgcccgacttatatggctgctgtgctgctggcactgggtagctattaccatcatagcatacttggcctggcccagggctgggcctaagttgctcacatatctcaggagctacagaatttgagaacccttcgatgagcgaacaattccaaggatcagcagatttgctactgagggacacatttgataagcaaatgttgctaaagatatccccctggatgcccagcaacattcctgcagtaccaatgtttacccccaccacattttttatcgttatgttgctaatgactggaagcgcattcttgtcatagttgtcgtcaggatgttccccatagtttccagtgatcctgatggctattgagacattgtccatgctcacatcagctatgtatatgtttttcacatacccaccgcgccctggggcagtcttgattctgattccatgcaccgagttgatgaaacgaaggccctcagctcgaacgtctgatataccacctgacatctcgcttccaaaggctattcctgcgctgttccttgtctgtccagtgatgttgcggatgctaatgttggagctaggatgggcaaaagagataccatactcgtcccaaccgctcttgatgacgacaatgtcatcgccgtttctgatgtagcaatcttcgatgcacacatttgaggatgagtctggatggcattgaagttgcattagcatcagctattgaaatctgctaaatgaatgcaaacatacaaaacaaggggaaaaaaaaggggaaaccaggtatcagagcaaggactactctaaaaattatgcattaaagtggtcgctttatctaggggtgcatggtacattcgaaaaaactgaatcgaagctacatttgaggcaaatatctcaggaagatgaactggtatgctccatgctttgaactgttattccatcgtatatctgtccacagttagtttgtgtttactaaggtaatgagaagttctgtacattgtatcggacagtaactatattgaatcatggttaactgcaagttaattgaaattacatgaaaaatattatagaaacattcagaattttggtcatattaactcaaataaagcaagcacacctggatcaatgccatcagtgtttggtgaactgataggtgctaggatcgtcagatgctggacaagaacttggctgattattttgaaaaaaaataatcaagataagaaataggtgcaaccacaacagctggcactgttaataatgaagcagagatgtagacaaaccaacctgcagtatacaggatgaatattccaaaatggtgcattcatgaaggttaaattggaaataacaaccctgtcagagtacatcagttcaagaagagggggcctggtataatttagtgtgtgattgtgaaaccagttccaccaaagttcaccttggccatcaatggtgccattagcacctgcaagagcacagcaatatgaaatgcatcattacaatttacaagtaggctaataaatacaagagcacacatgatataaatatgatacttactaaccagttattattacatcagtaagattggatccaaaaataagactctggtgtcttttaccagggagttctctgccacgcccataagatggcagaggatcaataactggccagtcagatgaatcctgcaaaagaattcttatgacgatcgcgattgtaatacttcttgcactgtttgttctagtgtaaagtattttcatgttggaacatgagaaacagttactgtaagttccaataatttgttttcaggaaagaatgttatgaaatataaaacatttcacgttattctgcaattttgttagaatgcgatttatgtaaagcagtataaagttgaatgcactagttttgttaaatttcataagacaataataaataaatcacttctgtgaaatgaatcaaataatgcataaagttatcttacttgagatccgattattactgcatcggcgtcaagtgacacagtgagatgactgataagattaaaactcccagtcaaccaccttccagcaggcacaaagagctctgccccacccttatctgcaaatgagctgaggtaaaagattgcattcttaaacgctttcgtgttaagagtaacaccatcattaacagcaccaaactcagtaattgacacactgtgtggccgatgcacgcttgctgtcaagtcgttgcagtacatggcagatgaagtggcccattgagtcgcagcaaaaacagttgcaaaaaccaaaaggacttgaagtgcctacaacaaattccagaagatgaacgtcaaaaaatgttgttcatgagctgaatctgaatagtgcatttttaaggaaatacaaagcaaatgaaacatagttcaaacacagagtaaacactatttgggggggggggggtgaacttgtttagtttgccacaaagattaattcaagttatccatcagtctttgtccttacaatgggttggataaaatgtcagcatcaactgactttgatttccgtagtgttgccaatgctgacttctaagttctaacaaggccacgccgccttctgcaatgtcggaatccatggtataggggaaggaatcacaggtaaaagcaaagcatggagctcctccactaggagcaaaggtctcacacatcatcctcggagaattttcccaaaagaaaagtggccaaatgggaattataaaagtcccacttgaatccccatgcaagaagacagatgtctccatcaaaaaaagacaaagacagcagcagtgcacttatcccgtgatgcacccattaggctgtccatcacagtgcccgatcttaaaagaactgaattctaagcgaactgccaaattctacccaaataattcttggatcagttgattcctatccaaatctatagctcaattctaccaccacattagagttcttggccaaggcaggacatgctactacaaggtaatcaatcagagcaaccgaaacgggacccaaaacaagaaatcgtccacttacagatgcggatcggctcatcattttctctagcagcgagtgaagaaactgtcaagtcagttcttcctccctcaaatcgactcaccagcaggcaccacaccagaacaacagccaagatcgacgacctgcaaccagccgccaccaccactaaccagggtcaccatggacggaaatcaagaacgaggagcgaccaaccaacaagaacacagcacacaaaacaaaacaaaaaaaaaaaacgcaaacaagaagccatactctctacttctccgggctcgccttctcgggccgcgaacgcagcggcgtcgacggcgacggctatgccgatggcttcactcaacacactcactccccatcaccttctccggctccaagcggcagcaaagagaagagtaggactggaccaagctacagtcacgaggtttattcactttattgggaggtgtgcagaggctgctggctcatcgattgttctggtcggaggtcggatagggggaacctggtgctgctgctgcccgatggaatggaatattggacggacggaacaccggttcttgacttggaatattgggtccgtcaaagtctcattggttgccaaaacgttttaccagggaataaaattaatttttaggtaattttttttatattcttcatagtgacttaaaagccaacactaaaaagaaattgcattaaaaatatcttaaatacaacttcaagtccgtaaatttaaattttagtattttactttggcttattagatcaaccgatgagacttttaagcgtgtgtttgatttaagggatatgatagaataggtttaatttaaaagagaatgactaacataagttaccatctttcttaaaaattgttgggtcaatctaaccgatcttttttttttcatttttttcagtgactagcgaaatgtccgtgcttcgctacggataaattatttcttagactaagtattgattagaaattttaatgataattaggatggataaaaccaccattacatattgatatactcatgttctcataatactcaagatgggcatggatggtctgatgatcaaacggcgatgaggactgtggtaggatgcatatcacaattggactcatctattgatggtggacactggcaactaagaaaatcagaacagcagaaacgcgactcacaatattgttccgctagatagagagagaaatgacaatggcgacatccgggtctgatttgagttgctcatttttttcggttcgatctggtttttcttctaataatacacatggtttttgctgagttttttttgcccgatctgattttttaataatacacatggttttttccgggtcgcttattttattattttatttttaaataataaaatagcatatattttattttattttttctagaaaaaagtccgtgtgttgctacgggtgactattttaatcttattttgctacgatccaggtcgccgagttttttccggctgatctggtagtttttgtccgggtcgctagtttacggttttttttgttcgatctaggcttttggttgggttgccagttggttgttttttccggtccaatttagttttatacgtgtattttatttttaaataataaaatagcatatattttattttattttttctaaaaaaagttagtgtgttgctacgggtgaagactattttaatcttattctgctacggtccaggtcgccgagttttttccggcccgatctggtagtttttgttcgggtcgctagtggacagtcttttttgttcgatctgggcttttggttgtgttgccggttggttgttttttctggtccaatttagttttatacgtgcctaacctagatgacggatgaaaattaagataagtacggaatcatcttcaatttttataatagataaagatgaaaattagttaactctatttgagattcaatcctttcgtgtgcacgaagaaaaaaactaatcggaaacagccgtggaaaagaactgggcccacaaaaaaccgcaacaaaataaaatcgtgacccactcagaaaaaatcggacttaaaaaccgggcccaaataaaaaccgcatgcggagaaaaaaccacgtcggaaaaccgaaaaaaaaccgcgttgcggaagtaaaaaacgtcggacaaaatttttttaaaaacagtaacaaaataaagtcgtgacccactcagaaaaaatgggacttaaaaaccgggcccaaataaaaaccgcatgcggagaaaaatcccacggaaaaccgaaaaaaaactgcgttgcggaagtaaaaaatgacggacaaaagttttttacggaatcattacttatattttaattagattttaattaggtatagatatagatatacggaccatatcgttcaattaaaaaatatttattcatctcatccctatatgtgcaaatagatggttggaatcataacattttagaaagaaagggataagtcttaagccatctatctcattgtcaaaccaaacacaaatacttaagttgcatcgtattgagagaaaattcgatgcacaacacagaaaaaaagcttgtaccataaatagtatatttttttcccttttataagaagcatatgtcatttgtttttcttcgattcgtagcactcccatcacatttgccgtaggtgcccttctacaattccatctttctgttgggctaaattccctccacatggacctttgttcttagcccatttgcagtccaaaaagtctaacaattgtgagccattgattcatgtcttgatcaatggttgagattacctcatcctttagtggtgggaagaaaaaccctagcctttattggagggagagtgagaagtagctttgaggtgaaataacaacctagcaaacacaagagagggagaggagagtagagaagaagaagggcagcttgttcagcttaggggctcttacctgatcttcatcaagtcagcgattggaggatcaaacatggttggattggcactaaacttggtgagtttgttcctcactttgagcacttcaatctagacagtttggatgaggattggttgagtagagcaccagatttgggtggtggtttgtcagctcgagttactgcggttacagattgtgcagcagttagtaaagtgtcagtttgaggggtcaaacagtgtccgatttggttgttttttggatagcctagaagggactcatagaccatcacttctgccatgtttcgtgcaatttgcatttgtggtttgggagatctcagctaagaaccgaagaggacaaaatctgccatttctctgcttgttgttatgcctcttgttagttgctatagttgatgttgatgatgccaagtttgtaacttgatgttatagttgctgttgtcatgtgcctctagatgttctaaagaagaatccatttgtacccattgttgattagtgcggaagcttggagtggaccgttggtcccgtggttttttactcctcacaccgaggaggtttttctatgtaaatcaccgtgtcttgtgtgcgtgtgtttattgttgttccgctgttgatttgatagttgaaactatcctcaaagttcatggcaagataaggggttgattgtgttgtggaaattataagcacgtaatgatttaatttgttccataaataaatcatgacattgcagatgtaaactagcatgaacgcatcattagatctacatatgtaaactaagcagtaaaacacgaacagatcaaatatgtgcaacatgttgaacacgtaccaaggttgcggaaagaccggttgcttagcaggaaccactcgcggttgcgggcgtcgacgaaggcacgcagcacgcgagtggagaggaaggcgagccgtcgtggatgaacagggagcagtcgcgcgaagcgcttcccaaaaaccttattgccgccttgtcccggtgtaggacgtcgaaggtagaggttccggagacctgctctcccgatcaccggtacacgccagcgagcgagatggagtagtctacgagcggtggcgtagcacagagtaggaggcaaaccctaaattgatttcgtgtgtgttgcgtgaaggcggcggctcagtttatatagagataggtcgcttgatcaaggcgcctgcacgatctccactccgcgtaaccgaaccggataaatctatccggactccacgccgttttcacgcaccggttttttcggaatgtttccaaaacaaaacaaatccaaattttcccgtagcaaaacaaaactgcaaaaggaggctgcatctgcgcaagggtgaggtgttggtatttcttacgatcacagatagaatccgcaagcgcacggatataccgatgtagcacttcccttatggagtattccaagggtatcgaatcaagggaacgtgtgtgattatctcctcgttaggttcatccaagggcacaaagctaatgtgggcagagggcagagaggatttcctaatgagaaacagtgtctaaggaaagcttaactttaatcctaatgcaatacttcaggcactggtaacccgctgttcctagatgtcgctctactacgtacccggacaaggaggacttaagtgctcttgagggttgtcaccacctctacacccacctcaaacgtactgtgggatacgcagcaaccactgaagattaattacccagacatcgcgtctatgcaattaataactactctagtgccgatcaaacactaaagcaatcactataaataaatggactatagtgaacaatgatcccgtatgctaattaggaactaaccaagaagtaattctcactaagcaaatcttaattactcaaaatgatatttctattaaagcagagtaatta

SEQ ID NO: 75928 - DNA, 15565 bp, Oryza sativa
  unsure (1)..(15565): unsure at all n locations
tgcatattgttcctaaacctgtcaaagatgcaaccgaacatgccaaatcttctgtgttgcgtctataattatatacacagtctgttacaaagttctcctttacattttcacaaactgcttttaaaatgttatctaccatttcacaaaaaaacacaagcggtaggggtcaactatagaaatcataagcaccgtttcagaatttccacacgatcttttgctatgttcatatgggaattgttgctaataaaggtacagtcagggtacaaagaacttatttgtgtggaaacaagagcacggttatcactgaactcacaagcatgcactgaggcagagtattatctagacataagggtcctggcagaaaattctgcttaagcaggccccaaaagaacatatcatgaacattcgctcacttcacatgctatccaaatattatcacaaggcataaaaagcagtaaatatgagtgcatcgactgctaggttcatgaaattgcatgcttccttagctaacatcacccagaaaaccaaccgcaaaagtctaaatgtgtaggacatgatctgcaacacgatttagacctcaaccacaaagccagctctaaccctcacgaaaacctaatttacgtgctgtgtcgcatcaaatacactaaagcactcaagtttagactacaaaagacccaattccagttctcaattgttgtgagtttaggcatttcaatagtaaaaggcacgagcatgctacgcattggtgaagaaaacatggaacattcttgcacatgccaataactcttttaaaaacgagcgcatgacatattaatcactcggaacagttgggcattggcagaaaataagatgccatattcagttgaatctgcattttcttatagattggttttgccttattttgcgcacaccctctacgcacaggggcggatctaacatgggacatgggggcgaaccccccaaacttaacaaacaaactgctgttagtattaagattacggcaaatttctagaacagaaagttagggttaacgaaaattcgagggaaaaaagtgtgcgggtcgagagagagagatgggaaagaggatgcggatgcggtgggtgctcaccaggatgcggcggaagcagcaggacgaacggcggcgccccccctcctccgctccgctcgcgggatgggtggggatcggcggcgtcggcggcggcgaaggcgaacgaactcacgaggagtcggagtcgacgccgctctccttagcggacggggaaataacctcgaggcacaggcacacacggcgatttgctcttttttttttctttggcccaattaggcagggatacggctggcccgaggacacgcgcgagtgcgggcccgataggcccattagtgtgtactatttttttttacttttcagattcaagcaatttttttaaataaaaatggctcattttttaaattcttttgaaatttggcgcatttttaaaattaaatttcgttaggcacctcacctaccaatttcttcagatggaccgaagtggtagggcgaagaaattcgcatttcggtacaaatttcaaaagtcacatgaataaatggtaaatttcaaaagcttgcatattcagtggcaagtcgtgaaatttctcgaggccggaccaatctcctgtcaccaacatcagtacatcatctagagcaccagccaaccaaatccgatcagggcgagcatccatgtgcaatcctaatttagctaggaaatgccccctaccctgtctcaggttcttggacaatacttattaattgaagagtagagtccatcaccggtccctaaacttgtactgttgtgtcatcctggtccctaaactcgcaaatcgaccgtttagatcctcaaacttgttcgactgtgttatcccggtctctaaacttgcatatcactcgtttagttccttcaacctgttcagttgtgtcactctggtctctaaacttggatttgaatatcatctgggtcaaaatggatggtctaaaaactttatattcaaaaataagtcataactcttccatgtgaactctaatgaagataaactttatatcaaacttgtagccctcgacgctatctacaactttgtagttgattttttttattttaagtcattttttgtcccaaaatgtaattttaaaattaaaatatcaaaatctataaacatgcaacaatattttgggaccctaaacagttttaattcaaaaactttttaactacaaagttttaggtcgcgtcgagggctacaattttgatataaagtttgtcttcattagaattcacatgaaaaagttatgaattatttttagatataaagtttttagaccatcatgtttagagaccgggatgacacaactgaacaagttagagaacctaaacgagtgatctataagtttagggaccgggatgatacagtcgaataagtttgaggacctgaacggtaaacgagtgatctataagtttagggactgggatgatacagacctgaacggtcaatttgcgagtttagagaccaggataacacagcagtacaagtttagagaccggtgatgggctttactcttaattgaaaatacgtcctatgagttctcaaaataaaaaaaaaaagtcctatgccctaccatgttgtacaggttctttgacatcactcgattgagaatacgtccatagaaaaagacaatactcaattgaaaatacgtctagaatttaggggcctagacaggatagatcgtagtcaacagaggtcagtaatcgcttcataagtccacattcaactttaagaaatcagtctccaggataattttgttcgatcggatggctccgagcctctgatggtttccatgtcgggggaagagggcgaatcgaagggcacatcaggatcgtccgatcttaatcggatgggtaacaagagcgcggacctgccactgctgatgctgcaaacgaacttgttgtatccccaggtcctgctgctgctaaggaagttggctcactagaaaaagaaagaggatatgttgcacgaaaataatcatttggacaagacaatgttacccggccaatcactcaatattgcaatactgtttcttattccaataacttcctaacaagttttggaataaacaattacagattaaaaaaaaagaaaaacatactattggaataaacaattacagattaaaaaaaagagagaaaaacatactaactcgacaggcaagactgcagttagctggttgttagctctagttgcccacattcatgttccaggaataaataagtggtaccaaacaatgcattggttcatcagccttccttcactgttcactcttgcaaattctcttgtttgttgtataattcctttgtatcgtcatgaagctgcaacatagcagccagaatcaaggcccactgataaatggcatacaaactgaagggaaaagggtataaggtgagcatatatacctcgggcaagaaaagtacgacatatggtggcaacccaactacaaggaagtcagatcatagctgagtagttcatggtctcatgcctcaacaacacaaaaaaaaacacctttgagttcttaaaacacatggctaacgtgcctctgaggtggttcatccagcggtatctgaaaggaagtttcgtatgaatttaaattgtagaaacttgccaaatataaagaaagcacaagttagtaaagccaatgcttgttcaaactcttgataatttgcaagacgggaagatgcacactaagcaaacatgtacgatatgtagagatctttctaagtataatcttgcgcatgccacaaattcataatctagaccacagtctgtgcatgatgtcaacactactaaatgaacatgcgtacaatattaaggactaaggagatagagaactaactacaaatgtaccatagcaggaacaaaagttgtaaatgagcaaacatttctagcaaacagaacttcgaaaatgaccaagaggaaagtatcccacacctccccaattgcccatttttccttcaaccagatgctatcatcctgattttcatttttgttgttcctgtggaatataaacaaagaagattaaacatgatgcgaagctaatttaacacagcaacatgtattcccatcagcagaaatacattcttatcaagtatacagttataattatcacagaacttacccaacagattcctcaaacatcacactaggaggagttaccatcccattaagcaactcttgtgattgcctatcaatgtctctgtgctggacagaggaagcaggagacttcgaactgggaaaacgtggggcttgaaagctcccaaatggttgacctgaacccctggtttccaaaatacgacctgcgaaaattctacaatagttaaatgaggcaacccagacagcaactagttcattgattcgccagaatgggatgggagatcactggaaccgaaacgcctagtggaatcatagatcgcaaagatgcaggactagtacagagtgtactctagcaatagagtattcttgaagaatactgtagtccccacaagtaccgtagctacgcaaggcagacgctttctggcagacttacttttttgaagttaggccgcaagacatattcctttccacacataccacctcaaataggaataactattatataatttccactaggtgaacagccttatatgccgatcttatcttaccatgatacacagctacgaatatgctagtaaatgcacaactttcagcaacatactcgaaactccaaacttcatttgagaactgccaaaagtaggggcagcaagtggtgcagagcttggatgaccaaaaggactactggctggcattcctggtgcggtggttctgcatgagaggcagtcatttaacacacatcagaaccaaatgaacagcattagaaaattgatcaactatatgtgagctttgcaattgtgtttaaagaacttttctaagcgctgctttctgattaaattgtctttcttcaatacttcctccgtttcacaatgtaagactttctagcattgcccacattcatttaaatgttaatgaatctagacatatgcatgtgtttagattcattaacatctatatgtatgtgggcaatgctagacagtcttacattgtgaaacggagggagtagattagtaacacaatcactgcatattttacaaaagaactagtagagtagtaccctggcccaggtccaatattagttgctgctccaatttgactgaaactactgaacacaggtggtccattggtttgagaagccccgaatgatgagttgtttttcacttcagggaaggaactcatagtaggaaagcttggagtttgtgatggacgtgcactattgagcagattagtaaactccattaactttgcgttttgtagatttctttctccctcaacctgaaagagatcacatcaattcaaatttacatagatcagaccatgtaagcaaagctaatgaaagcaggtattacttctgctaaaatccacagataaaactatcaatgaattgggagtgctggaaaatggaaaacttactattgattgcagagaatgcccttgctttccttcctcataggctttagctcttagttcctcgaagctaatgtctcccttaatattgcaagggccactgatgcaaacaaaagtgcattattaagtgcacaaacatttggcatggcctagagcaacttttgaaggcttgaagcataggacatgaattatttactttctgagatgagcataacaagtaagcttccaaataggagcctcgttcttaaaatcctcagaaatttgttgtctgcatgactgagggtcttcacaggagctggaaaacaaacatgtcggtgattcgcccatacccaagattaatcaggtgagatcaaaagcaaaacatatagcatatggactcacgtgtgggcagcctgcgcctgcggtggctgcaccgcctctgtttgcttcgtcggggccgaggggtcccttacccacttattttgaaaaggctgattcaacaatttctttattagtcatacacaacacattcctatacatggaaaaacactgcaattgaagaatttcctttgttctgattagcgctgacaaaccttcgcaggaccaggagcattacgtgactgggcattggcaccttgtaccccaaaaccaaaaggattgggcttctgctgctgctgttgctgctgctggaactgtgagccaaatgacggctgctgctgctgcctgcttccggtgccaaatccaaacgggttgggcttcgcctgctgctgctgctgttgctggtgaggggaggcatgcaaatacctgcactgcgctccgtacttgcaactgcacgcatcattcagaaacaagcattgcaaatcaaaaactcgaatcaatggctgggtaatcaatcgatggcgtagttctcactgagagagatgagagaggggggggatccggtaccttccgcgctggaagttgcggcaaatctcctgccgccgactcatcgccgcaaagcggaaggaaggggggggattcgattctagagctccgcctctagggtttagctcctcccaagcgcttgctcctcctccttccgccgccacgggattggcgtgggcacgcgacgcagcaagcgcggccgcacgacgtcggtgggtgggttgccctcgccggcttgccgcctccgccgagaactcgagacgcggccgccggccggagtagtcgtgcctcctcccttttgagaggcggtgacgacggcgagcagccagtgggccaggcgggccgcgggtgattcggcccacgagagggcccggcccagatagaacggccgtagcgcgctccaacaccaacaccaatacatagagatttttttattctttgaactttttaaatttttaattttaaaaacaaacatttcaaaacttatttttaaatctgaacctttttactacgccgaccggactaacgtggcaacattacacaccaatctaactagcgtgacaccgttatttggccacgtcgtgtggtagcgttatttcaccacatattcacaccatcttagctgacgagcataataaaactgtcaggtctgcagtatgggacgtgtcaatattgttttgccattctaggcgggctcatgtcatcaaaagtttatattttaaaaataagttttgaaaatgtttatttctaaaattaaaaattaaaaaagttgaaaaaaaaatccgctacagagaggcgcagcgcccgccacacacgcgcccgcgcgcgcagattgcgtcgtcggagacggagaggatgaacggcggcggcttggcccgcgcggcggcgccggcggtggtggcgctggcgctggcggcgatcctctcgacgccgccgccgcagccggagaccttctccaacatcccgcagacgctctccggtaagcgagaccgatctctcgcggtttttctcacgccttttgctgggggatggatcgatgacgacgacgaggtgggtgtggggatgattttgcaggcggcgacgggaagcagcaggtgaggataaagcggcccaagtcggcgaaggcgctgcagtgcacctccaagtgcgtcgccacctgcatccgcggcggcgagggccccctcaacgtcagaaagtagcagtaccctctctcaatctcatgtagcctgatcaaatatgttcactgaattcctgcagaaaatatgttcattcgccaataattcgagctcaattactgttaaacctgcaggcctctggtagttttcaagggacaattccgcagccggcagtactggtacctgttctatcgccattgcacctctcagaatagctcaattcaattgtgcagtcctagtactatgtgagctccactctgattatatatttatgtgtttcatatgcaattagcttggcagagtgctcggatgtctgcaatctcatcaaggatggagaagatgggcaatgaggaaagctttgacaaggagaagcagcaggtacagttgaagatggtatatccaggcaacaactaaacattgctgctgctctaacattgtgatagtctgctattgcagcaattcaaaccaaggcaaggcatggattcaaggatggttactgactgaattttacacaagaaactgaacaatccggtaagattgttccgtgaagttacagtgagaagaattagtgcaaaaaatacggcaccgaatcctgtgaacttagtgcacaataggaaatagattgttttgttaaatcattccacagagaaacaccatggaatgaagcatcataatatgttatggatttgttcttttacttttacttgattatacatgggaccaaatgccatagcaggcagatccaacatatgcaatagtcgaagaccatgagcagtaggctgtacgcacacaacatcatcagtgaattcctttactaacttcattgtttatttgctactacacatacaatgtacaacatgttttgctgagttcgacaagaagtcgaggcaagggaacctattaagacatgctgaagattttttttacatctgacatccaaagatgtcaatcttaatccagtgcttataccgattcaaaattttaccaaacctgcatttccaagatcactggatgtgcatttgcttgtttaagaaatactgtaatccagatacttgcttgctgcaaaagcttgtttcaactgtaaccaataggtttgctcaggagacttggtcactgtgtttctcatgttaggctgttagacacgcaaatatgttagtgcaggacatgtaaaattgtaatacattttattacaatcaaccatttagagtgaaaacttaaaatagggtaacaatgttgtactttaccttctatgttatctggatggggaaacatgtcagggcagttaatttgaaaatcccatatctggcaagaagaggtaccgaaatctagaatcaaacggaatgatgccaaatgtgcgggtgcccaggagactttgccgcctttgagacacacagtgctcaacaaaagtagcttgctgctgaggtagaaaatgtgatatccagatagggaagctgttgtcgtcaacaaaaccgcgggcaaaacagtgcagcattttagggaccagaagtttcccctttcgactgactcctaccgatgctctaataaaatcacgttgtgcatcttggagttcttcccttacattgcctgctgtatatatcttcacctgtagtgataattcgtcctttgttatcattaagctcagcagaggaaataatcaggatgcatgctatactggtcaatgccaatgaaggaatcaacaaatgagtgagctagtttaccgcaggagaagagtacaatccacagctgagagcaaatgtcaagagtggctcaggtgacccaatgcaaaactttttctgctcctcaggcacttttatcttctgaagggcaagaagcagagccttactcaaaaagaaagaagtagctgccatcagtttacgttgacagggcaaaatgtaaaaaaaaacaagcagctttgtcagttggatgccagttcacataccatttgtggcctatgatttggaggtttcatcttcagaatcacatactcgatgaatgcagcgctgaatgagtgacctccaattgtatatgcggcctaaaataaatcaaaggcgatattattattcagacagacgagcaacatcattcatcgaacagatgtatcgataagtaaaattagttgtgtgttcattacttcaaacaccaaatgaggggagaaacaaccagtaaataagaataaagttttccaaacaaaccttttgcattagggaaaataattttatgtcactccgtggaacgccataagcaagataagcctgtaaaagagataaagcaagcattatcactcactgtaacataatgttatatacaagtgaagtgaatttgcaaaatacgcacatgcatcatcagtgcattgtataaattgatccaaaatgccaactttgcgtcatcaccgaggtgaattgggtttacttctgccaattgttcaatcagcaatctgcgctcagataagtgccaatagtatggatgagtggatccaaatgttaagaaggaaaaagaaaatcaagaaaacaagaatgttcccatgttgtaatacaaatggaacagaaataaaagtacaaaggtggtgtttccttgagctaaaacaagtgcattgaatcatttttggtacacagattgtcagatatgttacctgaatttccttagtgattctgcagcatactcaagttgtttcttcccaactgacatccacgaaacttcagccgctgcaccgtagctcccaatgtcagcccaactaagcttctcgcgagctttgtacggatcaaagacggtctctgaagctaatagattattgttgtagttcaaatcgacctgaggactctgcacccaggaggatatggaagttggttcggacagcgaccagaatgcagaaattgaatagtttccgctaggagatggtccagactgctgcttctccgtcgagggagtcctcgaggactccctgcaggaatctgacaaggaaatgaagatgttcttcatgcagcgaacgatgtcctccgaaagctgattaggattgccaaagcatttggatgaaagctgcctctgtagtttcatagctgagtcgtgcaggacagcaaaaggataaaccttgtccactctacatgacttctcgtttgcggtgtcctagtagcaacatgaattcacaaagttaagcatcaatagcatataggtagtgtactcaactcttcatctgaattaggtccatatatgaatatgaaaccataggagccaattcttggaaattggagttatggaccatgttgaaagaggatggctatgctgaattcagtcattgttaatgatgattcagagtcattgttattcagcaatgcatatactgaagaggacagattattcagaaattcagtacctatgcaaatactattcagaaatacagtactgaagaggaaaggagaagagggtccatacatctgattcggatttggtggagtggcaggagcagacggagcgtggctgctgcagctgcagctgcggtggcggcggcgcctgcttgaggcggtactcgacgagcctcctctcgttccgctcctggatgagctgaaaatgcagggacaccatgtcgtcctccagcttggagatggtgccttccaggatggagatgttggagagcagctcctgtgcctgcaaactcatggagcttcagaaaccaagaacacaccaatccaatcaatcgaaatgcagatcgacatgggtgcgcgcgtcgtacgttggtggggaggtaggacatgtcggcgagagtgagcgcggcgcggtggagcgcgttctcgaggatggcgtgcagcgtcgtctcctcctgcagcgccttctgcagcttcttcacctgcaaaccattgctctctccatcctctcaatcacagtcacatcgcatccgattgaaaacgagggtaggaagggaagtggatcactcacgtcctgctccagctgcgacctgcaggaggacgcggcggcggaggcggaggacgacgacgaggagaagcccctcctcgccttggccgacagcgacagcggcggcatggtggcgcgcgaacctgcactccctgtcaccgtactcggagaagagaagagaagacgaagcagtggaggtggaatggaatggaatgaagtgcaaacactgcgacaatggcagcgtgagcagtgtgggtgggagtgggagcgaggagagagtaaaaacttgctgaccagtacttcaaaatttgaaatgtacgagtagtgtagtgtggcgtgtcgggggaggcggacgcggacgcggagtgggtggccaaacccaacccgcagctcgagaaaggcgggggcagacgagcgagcgcgacaccacgacccacctgggaacacacgtagtaggacctgtctgggagcttaataccgtgagaaacaattgataaagttggtagccggtttttaaggatttgaaaaagctgagttttcagctccttatttctatttctagtttattttttaaattttatgaccacaccttctcgtaatctaaacttaaaaaattagattgttttgaaaagtttctaatttagaagctccccaaagaggttcagaatctcccatgaaaaaacgaagcagattaacgtatgattaattaagtattaattagaaaaacttttaaaactagattaatatgattttctaaagcaaattttctatagaatatgtttttttataaaagatgtaaattttaatagtttgggaagcacgcgcgtgaaaaacgatacagacatacagtgaaggctgggaagcaccacaagccaactcagcctgtatattatactccctctatttcaaaatgtttgacaccgttgactttttagtacgtgtttgatcattcgtcttattcaaaaaatttaagtaattatttattcttttcatatcatttgattcattgttaaatatactttcatgtatacatatagttttacatatttcacaatttttttggaataagacaaacggttaaacatatgctaaaaagtcaatggtgtcatttgaaacggagggagtagttgatagttcgtagcgatacgtgacgagaggaaggaagaaggggacaggttgggcgggggaggcatggcgccgcgaaccgcgcgccgatgcccacgaccgcttcgccatccaaccccaaatacccaacccaagagaacgagagctaagctagccgctagctaagccaggagtccgaggcgagtccgttgttcggctcgctcgttgagttgctagaacgcttacgctttccactttgtattgaccggttttgtttacggttaccgtggcaaagtggcagccagccaaagcttggcccttccttccagcacgcggcccggagcccaaggatcggatcagaggcagcgaccaccccactgtcacggatccagaacaaattccacccattttagcatggtacatactctaggattaacctgcttttaaacctgaaaaccccacaaacaacaactagtactagtaattaaacacatcctaagataacttactacagtacaggctctgacatatgtcgagggtccaacctcaactaccattcactcctgtgaattcaatggcaagttggcaacactggggcggtgacctcgcgacagggagagtggagagtggtgccggcagagccgcaccgaccgagaggggcagcagacactgagaagagtcagatatgcagtgaacagtgaacactctttccttctttctggtggtcaatcgaaatggaatgcagataagctctactactgccaagtgccgaaactcgaacatggaaattactggaaaaaagaaaagaaaaaaaaaaagctcctccagctgaaactctgaaacatgccaaagcctgtcggcccattaaatatactaataatatcactaacagttttcgtaagtatataagaagcatatgatgagaaaagacaataaagatcatgcatactccctatgttaaaagaaattaattttgggttggaatctagacatatgtacatatatttgtattaacagagaaagcatgtattagatataatgccatatgtcgatatcataaatgagagtaaacaaggagggtaattcaacacaggtaatgccaccaaaacactatgttcacctgtcgttttccattttgtaacatggttaaactacagaggtgatttgactgaaactaaaccaggtaatccaacaaagaaacagcatagtacgagcactaagaaatgctttgtcagagtctggaggataagcataatgccagaaagacccaaaaaagagctgaaagcactgcgtccagnnacctattagcacngntttcttcacttttggtgatataanggaagggtggntnnctgccttnctggatgagnnatccatggtcgaccgctaggttggagcttagtnggagcctnnactatgctgttgagccccagaagcaccgcgtacgcatggctcacaatgggcgaggcgaagattgtagtgtagatactccatcgttctgaacctctcttgctcaggatatgtcctcttcacaacatgcagctgctcggatatgctccggtcaatgttgtatatggaagcaccgaagcatgtttggctcaagatcctgatcgcaaacgtttgcagctcaggggtgtcagtcccatgtgccgaccaccaacgaactgcaattaaaagtaagagatggtaagagaagtgtttctttaatatgaacaaaagcaacaactgcattcgttagttaccagttctaaacatcgaagagaagattttctactactacaacttaagcaagtcaaacagttcaggctgtggcaggttgcctattacatgggaagtgtttgcatcagtgtaacacgggagggaaccagttttgggggggggggggggggtaggagtgaagacaaactagaaagataacctcacattaatgcccaagtgaaatgaaagataaaaccacttgttctaaaggtaaccttagtgtccttacgtcaattagaaaaggagagccagtataaaaggtgcaaaagagacctcatatttgcatcgaaggggatatcaaagcactttgtttaaattcactcttatatatatgttttgtgtatcgttcaggcggagaacagaacctgatttaccatgttgacaagtagactaacagtctaactctaattgacttagtacaacattctgactttttcttagaactacaacaacattctggctttaacaaaaaatatgataatctttatgccactttgcacataacaaatatgcttttgtagtgcatcttagttagtaatgcacatgccagatccatggaaaaccttgtaacattattatatcttgctgtgtctaaacactgtacatgagctcgcaataacatgtgattgagggacattttacatgagaatatgctatactttaccttgtggtatttccattgtttgctgaattgctgagtctgaatcaaaaggagctgatttgcgtcgatacctatccatttgtatggccactttcttaggatcataatggtttttggccagacgggttacacaggcattggtcccacttttgatttcagtatcataactgaatctttctgtgtaaaagatccttggattcagaatataaccggcagcatggactggggtatgcaagtaatgatcccatatctcatcaaccataggccaataatcaccatgtttgtctcgaagattgcactttatgtcttcttttgcgcaatccatagcatcatacaagatacctattgggcaattatcagcttccagtttgtacaacacagtgataagtggatccgtaagcttcaaaatatcagcagcagcactccaaaatgcattatcagtttttactacttcatagacatgcctgaatgaacttctagaagccaa

SEQ ID NO: 75929 - DNA, 2967 bp, Oryza sativa
tgggaggagaacagttctacttttccaatatttttcagagggcttctatgggtaaccatttggcataacctagggtcaaagatgctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttaacaaaacagttaagtaataattaagcaatattaaaccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccttcaaatccatgtgctcacaacccaccattaccaggttttagttggcacattaattaattaactaatcacgattgaccaccgtgaactatcaataagccatcatgaaataatagtgagtcattagttatcccataagtgtactaatgtttctaagcagggctaagcaattatatctaatatctagttgaaccaatataaataaagctcaactagtcaaattataataacccaaggtatcaaggaataaggtaatcaagaacaaaagggccataacaatcaataggttaattccacccaatgacattcgaaaatagatgcaatagttgaatagaaacaatagctttaaataggatcaacatgctcaaagggttgtttgggatctgtgtgacttgccttgttggccttggaactcttcaaactcttcttccgcgaaaacggactctctggaaacgacggaatctaagcaaaaagaagcaaaatcaccaaaacagcacataaacaagcatgaacagttcatgtggatatttttaatgtgtagatctcaattttagaaaaatttagagacttgaaccaactaaatcggagctaagatgaattagttatgaatttttaaagattaaaccggattaaaacacttaaatcggtttaaaattgaattatgacgcaataatgaattatttttgaaaaggaaaaggggatttattgcgtcagcggctagggtttgggtggaccgggcgcacgggcggcggttcacacgaacggacggccgagattgatccgatccaaatcggacggccgagatcgatcgggaccacggcggttcacggcggacggccttgatgacgccagcaatgatgtcaccgatggcggcggcggctcggcgaggcagacgactcgagcggcgcacgctcaccggcgaacggcggcgctacggcacgaacggaggacaccaacgggtagcggacggcacggcgaactcaccgacgaccaaagcgacggcggacgaccaacggacggcaacggcgacgaggttgaaacggcggcggtcttcggcttgacgacggcgacgatgctccggcggtctccgacggcagcgaaagagcggacgaggacggcgacgacttggcgacgacgacggcgaccttcccgagcgacggcgacggctggaacgacggcggcgcacggctggagcggcggcggcgaaggcaaagctagggcacacggcgctagggctactccggcgacgagaggcgaaggcgagggtggcggcgtgtcacgaccggaaaacacccaacaggcgttcctgacgtgcgtgcattattccttgtcccaggaggcaaggtacaccaaaagttgatacaattcagagtttaacaagcggaagcgtatataaaattattacacgggcagcggaggcccaacacacaaagacaaacgagaaacagcggaagactagggcgacgaccacaggcgcttgacggcaggcacgagctagacaccaaagccttcatcttccaggaactcctcatctgggcttggggaaaattgagcaagactgagtacaaccaccgtactcaacaagacacacccacaaatgcagaataaatgcaagggagtacaagggaattataccataaaggggttagggttgcagtaaacagcatttaaagacatttagttgctcaaggccattttgtaaacacgatcctagaactatccaatattattaatcaaggccgtgaacccacacgaacctgccttaacccaaggcctatgatgattcagaccgaactggcaactcgaccctgggtcccagctcgtcctaagccaac

SEQ ID NO: 75930 - DNA, 586 bp, Oryza sativa
gattgatttgacttaaaaagaaaaggggttgtatttgaagcacatattacagaagagcaattaaaatgaaacctactcaatttcgatatggtgatgcaagatttatatatacaaatctatgagatggtagaaactgactcacatataagggaaaattgcaaatattttttatcacaaagggatgctatacgattggcaatatattctataacgatgtttcctgaatcattgaagtatcgaaaagttacaaattcataattaaggaacagacttatattaaagatattagaagtcagcagtttatgacaggaaatggcatcactaaatcaccaatcagacaagaaacattgcatggagtccagttctcccgcttataaacaccattccacattcttccttatcgtagtattccatgtgcaatgtttaatgtgtaaatgtttcattgccacagagcaccgttatgttatcttgttgcatatatcaggtgtatagcaaaactgaacatttaataactaaatttacaaactgagattgttggtaaaaaatcgtgcaggataggagaccataccatagcactaatacattt

SEQ ID NO: 75931 - DNA, 702 bp, Oryza sativa
atccacaaagccaaacaacctaacaacccaacttacggctaaccggcaacattttattatattacttgcaatgatttgatttacaaatttccagtacatatatgtatttcttcactcgtgaatacgcaagagattgtatctctattaaacaccgaaaacggcacacaaactattttttgaaagaaaaaacatatactcctagtttgttttaatttattctctttttacttgtaaaaactgcggatgtaacaacaagccagatcctttaaacttgctctttgtaatctcatcaatcctccttgccatctctggcgtcaggtggtttctccaatctccgaccacgccacgccggaagaccgtgttgtttgggacagtgctatcgactatggtgatcgttcccgaccgattcacctctaatccggacatgttctccaatgcgcaggcctccacgatattcctatccacccgtgcttctgctcctccgtcgtgaatggacatccgacaaactcggcaaggcgtctcaactggccgagcgtgttggcgacgagctcatcgtaggtcaagaagagcacctggttcggcttctcgacgtgccacctccagtagccgaggatatgctcccagaacggcccaaactgcgagcgccatcgcagaattgccggtgcgcctcgtcgatgtcccacggcatgaacctgttccaaa

SEQ ID NO: 75932 - DNA, 1275 bp, Oryza sativa
ttaccatcttgttcagcaccagcttcaaaaacaacatcatccaacttatctacttttcctgtctttaacttctccttcagttctttaaaacgcttgtgtatctgtgcagcctcttcatcatcatctgatgggcaatcatctccaagaatgcaatcactgtcactgtcactccctgaagatacctcactagctgattcatcgtcagctaatgtggacttgcataccactaatatattgtccattatgtccaattggattttgtcttgccacctgtcttgaatttccgttatgaagacgctgcaaaagagatagtagaacaataaataataaataaacaaacacaagaagacaatcactttatcccagaaccacgtaacagtggatagtaacgcatagctttttattctgaaattagatggcaggagctctacctattcaattgaggacagaaaagtaaatttgttgagacacagctgatgtatgtatgtctttggataaaagataaaaagtatcaactagccgggaccatataatgctactgatttccaacatgcaacaactttactactcctagaaatttaatttacccatccctcatccacaggttcccatagaaagtgtgaacaattgcaactatagacataaatttgcacctggtaaacagtaaatacaattgaaatcaaaatttgaattctataccagggcaaatatgagaaagtatatataatcaatagtagtagctgggatggaactacaaaccaaggttctgagttgtggaattgcattagggaagaaatgtatatgaggttgattggtccaagttaagcaattgatcatgccaagagttctaaaaagccaccagccacttatcccaattatttccggaaatacatgcaatgtagaagggttctcaactagtgcatttccagtaactcaaaatcacctatggtcctagtccaacaccatgcaaatatattcgttgaatgaaaaatatttgaatctcagaaccagcttgcaaagaaagtactgagaccctgaccattgcaacactaaatttatatttggattcttaccatctgtctattttggaaaaaagatattcatgttcacagtttgaaaataaattcatgggactctttattgtcttgctttgcacttatcgtcagcagagataaaatatgcagcttaggagaaggcaagaagcaatgttatcaccagcaaagatcagctgggaataatagaaagctgcaacctggagttgctctcagagataaa

SEQ ID NO: 75933 - DNA, 28834 bp, Oryza sativa
ggctttggtggagaacccctcagcccaaatgtacttgcaattggcccatttgaatgtgcttcattatgtttgtgggtccaaaactccataggtttgaatatggaagtttaattcacttcctcctctatgtatcttttgtctcaactttggtggttattgatggcgttaatttggtatttaacagccgtcaacaaagaggaaccaattttgtggaccattcgacgcgtacgtcgtgcacgtgcgctgcctgcctccgaggcgaggcgagcgagcgtgcgcgtgtgttccccctcttctctccaccacacatgcttcaagtggctaggagggcatcctcccttttaaggaggtccccctctcctagaataagcaaggtgctactaaactccccatgcatgccatcccatgaggtgggcttttgtgattttccaaagaattaatctttgagtgggctaaggcccatctattaattccaacatgtgtaaaatatgtttaccggttggtgaattgtagtttgcacattaaaagtgtttggttcagccccaaaactttcccctttccttcagttcttcccattgatcttgtgcagcacgtcgatgtgtagccatggtgcagcatggctgccgaagctacagacaatgcggcggtgcggcgcgacagccggctctgcggtcagcccaatagttacagcgcatggtgtggatgcacatggcacagtgcccaagactgcagcagacgcttcagctagcgtgtgtagcacggtgggacattcaatgtggcggctcgccatgggggtcttgtagcttctcggtagcttgtggcatgcagcctcatcagccattacttctattggccacacatcatccttctccgccctcgctgccaaggcatcggccaccacacccacacccactcgccatcgccgttcatcgggatcgagtcgaatcaaatagccgaggagcccaatttcatgtttggttagaataaagggcaaatttgtcttattaagcctctaatcatggctaaacaattgaactctgatgaaaaatttgatgggagtgctacgaatctagaaaaaaaaaacaagtggcatgtgcttctgatcaaaatgtaaaaatgttgtacaatttttggtagtattttcctgtgttatagatcgaaatttctcgtgtgtggattaccacgctcaagttcgttctactattgtgccaaccctttttgcgaggtacattaatttaatgagagataataaaaatgttaaaagatatacatcaataaaaaaattgtacaatattagtccctcaattttataatataaggcaaaagttgtttcataatatatggcatacatgcatgtatgccattaactaacacctcttctccactaaaatattattatttaaattctccactatcaagatctctaattttattagatgcatacattacatttattaggttaatccaaactatgtgatgataataattatttcttgatctttgggttaagagtggttatgccttatattttttaacggaggaagtacatgttgtcagggttacgggttaggcataccctttacccttcgatatacgttacatatcgatatgacatacccacgcgcatgcggatatttcctgtatattctaaggaaacctttcacggaatctacagaagggaagaatcctactcgggcagaactgggtcattggcgtatcgtatggggtctgatacctccgagtcctacgtggagacctctcgatctacaatataaaagggacctcccggggagggtttaggacatcgaatctcagagccaacacaacctacacagcctatgaagccggagcctacgaggagccaagtcgtcgagggctagtcgaaacaactcgactacaatctcgccagatccgacaagttcccttgttccctttgtaacctgtgttttctaccgtataatcccacatcaactggattagggttattacctatcaaggggcctgaaccagtataattcttgtcttttgtttgcttgatgtcatactacgtagatccttgtaccaacgtaccccaataccctctatatccggtctacgggtatcacccgtcgacagtggcgcgccaggtagggggccttggtactcaaggttctactactatgtcatccagtttcgtcgacaacaacgtcagcaccagcctcagccaagtactccctgcttcaacaatgctggtatggactcaagtcggcgaaatcgtcttcccggtttacaccacgacgccgatctcaaccggtcctccaatgaccggagacgagaacgcagtggctacgaaccaaggcgattccatgtcgaaaaatcctcccgtcgagacggagaacggaatatcgacgacatccaatctcgagaaggattctgatacggccaaaccttgtccttccgacatgaaccacgagttgacaaagataacttccgaagccacaaggtcttggtgtcctatccacaaaactaagaaacacactctgcaagattgctgggttttcctcaacgtctgtgctgaaattcgcgcctgcaaagaacgtggaattcagcgtacttctccaactcgggatgtctattgtcctattcacaagacaaagaatcacgacctctcgagctgcaaagtctttctcggcgccatgaaagctccgtctcctaagtcatatgtccccatcagggataacggcgaggaacaaggagcaactccaacttcagatcgattcgttggggtaatcgatatcgatcctcacgaaccatcggtcttacatctcctcgaggactatgggtcatcgacaacgagcgcgccgcgggaggtattggctatcgatgacgttggcacgtcagctgtcacgtcctgataaattcattccgaaataaaaatcattccctaaaaggaataatagaattaattaaaattcgaaaagaaattggcaaacactaaaatacgtacaagaaaaaaattcgaatgtggcccagagaatttttgttaaattctccttggtctaaaatgagccctcaaattttacttgaattttcagagcaccggaaatatttattaagcaacaaaaacaattatcaaagtttaataaaaagaaaacctaaaaataatcctcttttctcctttgggccaagcccagccaaagtctccctctcctccctctctttccctcctctcccgggcctctcctcctcctcccggcccacctcttccctccctctcccggcccagctccctcccctcccctctctctcccgggcctgcctctccctcctctcctcctgggccgcctccgggcccaagctgagcggcgccctcccgcccgtgccgcgcacgtgcgtgcgctgaccgcgcgcccgcgtggggcccacgtgccaggtcgtcgtcctcctcctgcccggcctcctcctctctcctccgtgaaccctagccatttcctccctcaaatccgcttgattcatttggctaattccaaaattgattaggggttttaatccccattgattcctcttcaattcccccttgattcgtgcccccaatcgtcgggaacagacgcgtcttccccggccgctttccatggccgccggccgccatttccaccgccgttccccgctcctcccgtgctcggctcgcttccctccgctataaaacggaatcccctcgctccgttctatcgttttagccccctcccgcgatctcctgtggtccctagccacctccccgccgtcgtcccctctctcccatgccgccggccgtcttcagccgcccctgccgccgcgttagcacgccggccggctgtgccgtcgcctcctctagcatcgcagccacctactcttcgccggcctgccctctgtttcccgcgaagacctccggaagtgcatccccgccggcaacagtggcgttgccgccactgttccgcctccggccgcctctgccgcgtcccctgtgcgccggccaacgtcgccaccacctctcccggcaccggaactccatcctcttccccggccaagccacggcatcgcccgtatttcgccggaacgccgtcgcgcgcgccgcctctccctcggtcttgtcggcacccactccggcagcccctttcgccgtgccagtgcgccggccgacgtcgccgtctccacctccggcatcgcagcggcaaggtcgccctcggcctcgcctccccttcgaccgaacccctccgcggtccatcgttgtcgtctccgttcgttctcgtcgtcgacgtcccgtcggtcgcccggctcgtcgtctcgcggcgccgcctccgtcgtcggcatcgcagcggcgtgttccacgccatccttgtctttatgcagccgttgtaggctgcccacgtcgcctcctcgccggccccggtcgtcgtcgtcgtcgccctctcgtcgttcccggtcgtcgtggcgttcgtccctccgtcaagccgttctcgttcatcgtcctcgcttcgtcaagtgccgcagccccttcatcgtcttcgtcctcgcctccgcgtcgtcaagcctcgtgccggccgtgtcttgccttcgttcaaggatcgccgccgaagtcgttccctcgccgtccgtctctgccgcgcccgttcgtcgttgtcgttccgacgcctcgtcgcgtggcggtaaggatctctcctctcgctgccccgtcctcatcctttcggtgtcgccccgtacccgttgtgcggttgtcgaccccgatacccgtgtaccggtgtcggtagtcgttcacgtgtgcgggtggtgaccgtgtagtgtccatgttagtgtgcccgctcggtagccgcgtggtttccacgtgtgcagcccgtgtggtgtctagtggagtccgtttgtcggccactcgcctcggttgacacacggggtccgcttccgtcgacccgtggaccatctctgtgtactcggtctaccgcggtcctttaggttgacatgtggggtccgcatgtcaacagcgcagccttcctgtcttttccaggcttgcgcttccacatgttttatagttgcaaagtttaattataataatccgcaaatctccatataacagcattaaacttcggatgatcatatcttggtcatacgagctccgaatcgacccgttcaagtctcttaatgtttgttataacctaaagaaccgtgtgctttctttttatgtattgttattgcttctttataggcttgtagctttgcttgtgtgcttcgcgtagcttctgtcgttccggaggttcccgaagcgtggttcgcggccgtcgccgaaggttcggaaggccgttctctctgagcaaggcaagtcacatcatccttgaacatattgaatcccaatttataaaattattctgatttaaattattgcattatcgctttatttaaattcacgcgttatcactgttttatctagccatgcctatttacctttgttatgaccttattattggtgttattgttattattaccttgttcaccctaggataaacaaaaccccaactagtgggtactctattcatgggtccactagtatgaatttaggtagatgcttcgctgattaattaggcaatattaggtggttttataactttagactttgggaattctcatatcatttggacactatggaatagttggcttatgttggaattggacacacacctccccctctattcaaaacccacaaaatagttttaggctgggctcgaggtgcgtggttgggtttggttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggctcggtagtcgagatgtcatggcacagggctggtgtcctgctgctaggggctcaatcctgcctgcctatcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagatgtacccctcggttatgggcaagcctagcaatgcacccaagttagtgttttaattcttaaaatttgcttaacaactaaaatgtggaatggttggcctgggttggcttaggacgagctaggacctagggtcgggttgccagttcagtctgaatcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattcttaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatggagccgtaggcccgctagtccgctgctgttaaattttgattgtcaggccttaagtgcctttgtaataatgtaaatattatcgatataataaagatgtgccttttgtatcatgtttgtttggtgtaccccggcttttcctgggacggggattaatacactagcgttcgggaaaatgtatttttctcggtcgcgacatcagcgcacgccaatgcagaagcagggaatcaatcgactactccagcccagcacatcagggccgttcaagcgatactgagggaaactccttacgatcccgttttgaacattgacctcgagcgttggacagaacgactacgggaatcggtgactaacctcagcaacgcgtttgaagaagccgctaccgcagcacaccatggtgccccatacacaagacggacagacattctccagaagattggcttgttttcaaaaagttgctcgagaagcacatggcatttgaaaaaggcaagcgagtacgcgttgttgagacgaacgaagagacggctcctcacgaaccggactcaacgtatccagactctgacctccacgtctcacacatcttcggcggttccacaacgtactcctccaagcgagaatacaagaaagtggaacgtgaagtctgctcgacatggcagggggctgcgcccaagatgaagtggtctgagcagaagatagagttctcggaagaagaccaccccaagaccgccgttatcctaggacgatatccgattgtggtcgaacccactattcggaacatcaaggtagtgcgagttctcattgacggtggcagctcaatcaatcttcttttcgccagcacttttgacgcgatgggaattccgcaaaacgagttgacaccaactgatcaacccttccatggaattactccccaatcatcgtccagacctttgggcaagattattttgcccgtgactttcggccaagccaacaacttccgaacagaacagatcacctttgatgttgctgaattcgatacagcttacaatgccatcatcgggagaactgcacttgcgaagttcatggccgcatctcatgtcacgcccggaatttctatccaaaattccaaacgcttacatgtgtgtgaaccctcatccaggaatcagccgaggcacacaataacaaattgataatagagtgcaattattactctaattaataagcgaataaaatgtcattacagaggtagatagttcctctcaatcaataaatatgtaagcagcggaaaataaaataaacggcgcagacgactccactccacaggcagcttgaccagggctacgcctaatcctccacaccatcagcatcactgtagaactcttcctctgatgaatgattgcaaggtgagtatatgacatactcagcaagccacgcagcaaatatgcaagtgcacagggataccaaagaatggcataatatagggctcatttgcaaaagcagcatttagcaaacatttgagaattataaaacagttaagtaataattaaacaatattaaaccaacactatacaacatacccagttgcataggcccaaccattctgaacaaccatcccggctgcacagttctatctccaaaccaggaatataccattccaaaccaggagctaaataaattattaccagttatagcatcttctattatgatgagaagtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctatgacagtacccctcgcacaacacaatccaccacagtgcaccattcctggatcataatcacccccttataaacaaggcatggactccccagcgacccccgtgggcttatctccgccacttctcagtctggtgccccgcaacgaaccatgctatacaaaaggtaaagccgttgcccacgctggcttgtggttggcacgattaatgtttcacaaccgaaactcgtgaaccggtccttaattgtcatgagcacgactctcaaaaccatgtgctcacaacccaccattatcaagttttagttggcaaataattaattaaccaatcacgattgaccatcgtgaactataattaagccatcattaaataatagtgagtcataagttatcccactagtgtgctaatgtttctaagcatggctaagcagtcatatctaatatccagctgaaccaatatatataaagctcaactagtcaagttatattaacctaaggtatcaaggaataaagtaatcaagaacaaaagggctttaacaaacaataggttaattccacccaatgacattcgaaaataaatgcaatagttgaatataaacaatagctttaaacgggatcaacatgctcaaagggttgtttgggatctgtgtgacttgccttgctggccttggaactattcaaattcttctcctgcgaaaacggactctccggaaacgtcggaatctaaaccgaaaagagcaaaaacaccaaaaaagcacataacaaagcatgaacagtacatgtggatatttttaacatgtagatctcaattttagaaaaatttagaaacttgaaccaactaaatccgagctaagatgaattagttatgaatttttaaagattaaatcggattaaaacacttatatggattttaatggaattatgacgcaataaggaattatttttgaaaaggaaaagaggtttattgtgtcagcgggctcgagttcacggtggacggggcgcacggcagcggttcacgggaacgaacggccgagatcgatccatccaaaacggacggccgagatcgatcgggtctacggcggctcacggcagacggccacgatgacgtcagcggtgacgtcaccaccggcggcggctcgggcggcgcaagcttgccggcgaacgacggcgcgacgacgtgaacggagggctccaggacgatgcgggcatcgcggcgaactcaccggtgaccaaagcaacggcggaagatcaacggacggcgacggcgacggcgacgaggaagaagcggcggcgacctacagcgacggcggcggtgctccggcggtctacagcgacggcgaaggggcggacgaggacggcggcgacttggcgaccacgatggtgaccttcccgagcgacgacgacgaccggaacggcggcggcgcacggctgaaacggcggcgacgacggcggcgcgaggttacacggcgctagggctcttccgacggcgagagacgaaggcaagggtggcggcgggtagagaagacactggggatccttttataggggcaagaaggcagcggcgaaggcccacggcgaccggcggcgagaaggaaagtttagggttcggaggagagagatcgatccgaatcgaactcgaatccaacactttccaagcgattttagctggggattccaaaagagaaaaggtagaggagatctcgggaaacatttcccctctattgatttcaccggaaacggaaaggatcgaccgaatttggaaggagacggcggcggctcggcgctagggtttcgggcggcagcggccggaggtagacgacgaccccgacaggcgggccccacctgtcagcgacgggaacgcgcgcgcggctgcgacggactgggccgacttgggccggggagagagagaaggttttgggccgactttcggcccaaagccaaaagaagacatttaaaaaccttttcaatttaaattattcatgaaatgcaattccatttattaaaaatactcccttagctcaaataaatcccagaaaaatctaggaattatagaattaagcaaagtatttaatgaaattttatctggccccattttatgttggaatttattaattaaaattagatcttctcttctaggctttttaaaataaattctaataattccatttaaacaacaatttatatatttaggatttttagggtgtgacatctcactacgcatatcaagtgcttaagatgccggaccgaagggaacaatcaccattcaggggaacacaaagctggcggtgcaatgcaacaagcggagcctcgacatggtcgagcaaacgcccagcccacccgccacgactgagccacccaagaaagtgaccaagacaaacaagacgccgaaaccagacggtgccatcaagattgttccactctccagtgccaaccccgacaagaccgtcaagatcggggcgacactaaacgagaaataggaactcgcgctcattaccttcctccgcgacaatgccgacgtgttcgcttggcagccgtccgacatgccgggggtccccagggaggtgattgagcacaaactcatggtgcgacccgatgctaagccagtaaaacaaagactgcggagatttgcaccagaccgaaaacaagccatacgagaagagctcgacaaacttctcaaagctggcttcatcagagaagtacttcatccaaagtggctagctaatccagtcatggtgcggaagggcaacggaaaatggagaatgtgtgtcaacttcaccgacctcaacaaggcgtgccccaaggatcactttccactccctcgaatagaccaactggtggattcaacagccggttgtgagctattaagcttcctcgacgcttactctggctaccaccaaatcagcatagcaaaagaggacgaagagaagacagcattcatcacgccgtttggggtattttgctatgttaagatgccgttcggactgataacagctgggaatactttccagtgcacggtccagggcgtacttagcaaccagcttggcaacaatgtcgaggcttacgtcgacgacatcgttgtcaaaaccaagacaggcgactcattgattgacgatctgcgggaaacgttcgacaacctccaacgatatcgcctcatgctcaatcctgagaagtgcacgttcggagtaccatcgggcaagctgctcagattccttgtctctggcagaggaatagaagcaaaccccgagaagatcaaggcaatcgagaacatgaagtcgcctacaagactcaaggaggtacaaaagctaaccggatgcatggcagcactaagcagattcgtcgctaggatgggagaacgaggacaacctttcttcgctctgttgaagaaacaagacaaatttgtatggacacaggaagccgaggaggcattcattgcactcaagcgctacctatctaacccccctgtacttgttgctccccaacctaatgaagaattattcctctatattgctgccacgccatattccgttagcactgtcattgttgtcgagagagagaaagtacagcgaccagcttattacgttagcgaagctctccacgacgcaaagacaagatacccacagatccaaaagctgctttacgcagtcatcatgacatcaaggaagctacgccactactttcaagcccatagagtcacagttgtctcctctttccctcttggcgaagttgtgagaaacaaagacattgtcggccgcattgcgaaatgggtagtcgagctgagccagtttgatgtccactttgtgccacgaacagccatcaagtcctaggtactcgctgacttcgttgccgattggactatgccagataacaaatcagacaaccaaggcgacaatgaaacatggacaatgtcgttcgatggcgcactcaacagccaaggagcaggggcaggatttatcttgacgtctccctccggagatcaattcaagcacgcaatccacctcaacttcagggcgaccaataacactgcagaatacgaaggactactcgccgggatacgagctgcagctacacttgaggccaagggactaatcgtcaaaggggactccgagctagtcgcgaaccaggagcacaaagattataaatgctctaactccgagttatccaagtatctcgcagaagtcaggaagctagagaaaaggttcgatgggatcaaggtccgacacgtctaccgcaaggacaacgtcgagccagacgacctagcacgacgtgcgtccagatgagaatcgctcgagcccggcacttttctcgacatcctgacgaagccatcggtgaaagaggttagcggcgaagtcagcccgaacacccccgacattatctcggaggtcaccgaggcagaacgcgccgttgccgacatcgaaacgacagacgactggcgcattccactaatcaaattcatcagcaacgaggagttgcccgaggacgatacagaggccgagaaaataacccgtaaatcaaagatctactgtatggtcggcaacaatctatacaagaaagcgccaaacggggtacttctcaaatgcgtatcgaccgatgacggcagacaccttcttcttgacatacatgaaggcatatgtgggtcacacgccgctggtcggacattggtcggcaaagctttttgacaagggtttttttggccaaccggccttaaagatgcatgcgacatggtccagcgatgtgaagcctgtcaattccacagtaaacacacaaagctacccgcgcaggcgctccagactatccctctgacttggccattcttgtgctgggggctagatttacttgggccattcccacaaggacaaggcggctacagattcctattcgtggcgatcgacaaattcaccaaatggatcgaagcagtacccacgggggaaatcaaggccgacaatgccatcaaattcatcaaagggatattttgcacgtacggactaccacaccgcatcataactgataacggctcccagttcatcagcgccgatttctagaactactgcatcgggctgggggtcaaaatatgcttcgcctcggtctctcaccctcaaagcaacggacaagtcgagagggcaaacggcatagtactacaagggatgaaaacccgcgtctacgacaggctcatgtcacacgacaaaaagtgggttgaagaactcccatcagtactatgggccgtacgcaccacaccgacaacgtctaataaggaaacacccttcttcttcgtgtacggctctgaggccatgctcccaggcgagctacaacatcagagtacatgagtacagaagtactccaacgagaaccaggatgagcagcgagatatcgatgtaaatcttctcgaggagcatcgggaacgagttgccgtccgagcaaccaactatcaacagaccctccgccgttatcacgagaagcgcatccgtgcacgcatactttcgatcggcgactatgtcctccgacgagttcaaagccaagcagggcgaaacaaactctcacctaaatgggaaggaccttacacgatcacacaagtcttgcggccaggcgcattcaaaatcacagacggcaacagtcgcgaattagcaaattcttggaacattgaccaactacgtaaattctatgtatgagtcaataccatccatacctataagcacccttacagtatcaataaagcctatttctaggcccatatcacaatcaacgtgtttcgcccgatgatccctcactctgatgacacctagcgttgcaacctgtccttatgtccctttacaccgtctcgacaaggcctccgaggaacctaagggatcttcggctagggacgcccagagccgataaggccttgtcagatcctgtagagacgaaagaccatgtaagatctggtcatgtaagagttctcgccgtgcgtattaaccaagccgtgaaatcggaaatcaactttccaacttcatggctgggggctaggatcagagcttattcaaccaaggcaggtcaaaggtccaagagccttatcctccgagaaaattcctccgatgacaaggctgggggctagggagagtgtacgactcaaacggctgactaaagtcgttaactgagaacgcactcttacacatgacatccagagtaagagacatttgtcaaagatagatttctttattcacaaaatactccttacagttttttcacaaatctttcgctacattacatcttttcctaagatatttgtcacagggtacgagtactaccaagaaggccaacgccagtccatagactagaagatcttctcggccaacgacgacattgactttgccagatggtctatctccgccggagtcctccgagaacgagcaaaaccctcacgaagatattcaaggtccaggcgcgggtgatgatctcgtaggcaagccaacacgtgccccccggcatatcggctcgatcgacgacactcctgcttcaaggcctcgtcgatacgtttgccgattccatcgagttgggcacaggccccattaagccacgagatgtacccggccgccaactcctcgggatctccgcggactactcgaagctccctgcatactctggccatggatgtgcagcaactcttcaagtacgagttaaaccacacctcacgacctcggagcgtttccacagcctgctctttcttcacggccagcatggttttctcgagctccgccacttcaaacttcgtcttccagtattggatatgacgatcttggctagcaagggcaccctcgagatctgctaaacgtgataaccactaagtcaagctatacatctctgtcgggaacatggctgacctagtcaggagggcattaaggggtgaagggactactaacctgaggaagtcgtcgccatccttccctctatatcaaggggttgatccacatggtcaggcgagacgtgtggttcaaactcgagtaccggaattactgccagtgactcgggctgcccgcgctgctggacatcctcgtcatcagtatctctacagaggacaaaagttcccgaggtcagcataccaaagtaagccgggatagtaatcgcacgcacgaaggcggtcagagttcgagttttacacattaaagggggagaacagactcccccagatcacctccttacgcatgtcgctggccgccccctggtccaagatctcgcgcagatcaagttcaggatgtgacagccttacacacgcgaggacatgacacgccccggtgtagatcccgtttgacgtctcctccgcaatcctggccgcatgcttggaggggatctcccccatcgccgtcgccagctccgcgagagaggaggttagcgaaaactcatcgggattcaccgggatcgtggacgtgacgccgcattccccagcgagctggtgaaggccagtgtaggtgaccctcaacgagccccggatctcggataggttgttcccgagttctgacattcggtcctcgagccccttccgttgtcgctcgttgccagccgccaactccctcatcttcataagctcttcacgggcttcagccaactcgcgcaccagtctgtcagcacgcgcgttcgccatcgccgcttccgacctcgcctccgcaagcaccagcttcgaggaggcgccctatctcgacttggagctcctcccaggagaggacagcagttggcagatcacgacctgccgcgcggtcgctgactggggcactgggcgtcgcctcccggctcccggctgcgggcacgacatccgtcgaggccacgacaggcgacgcactggaagcttctccggacttggctcgcgcagcctttgcccgcgcctccctacaggacgaccacgagtcagacaacaatcgaataagaagcgcggggattcaagaattcatctacttacttcttgccgatcgtcacaatgcgttgttgtcgtggacgtgggggagacgcgtccgaggcctgaaagataatcaacgcaaagtaaggaaaaatccttcatgctgcatgatttaacgacaaaataaattaccgagggggtcgacgccttgcgacgatgtctgcttacagacgagaatttcctcggctttgtcggaatattgccaccgctagtggtggcagcatcagacacctccttgacgaccttcacttttagagatgacgccacctgatggtccgcgagcggtccgatgatatcagtcaaaggaagggcctacgctcaatcaagtcaaaaagtgatttcgaaaggagaatgcgggatgcttatcgaatatacttacgttgatggcttcatcacgttccgccgcccccttttcacaaaggggcacagggatgtcactcgccgtggtcgggccactgatcatcacttggccgactcggcgctccacggtttcgccgctcagacctgttaatccagaaccaaccttcgataagtcaagaggaatgcgaacacaagcatgtcaagataaatgcgagaaagataccccgaggagaaacccgggtcgcgtcctctggcccggaatagttataagctggatgggcccgagcctgaagcggctggatccgcctaccaacgaagtatgcaacgacttcatatctcgacaaaccccgtgctcggaaatcgtcgatgatgtcgataaacgactgaagagagggggtcaaggggggctttgcggtccaagacggaatcttgtccggttgatcttcaggaaccacgaagacagggttcgagtccttgatctcaagataaaaccacctattccgccacttgctgcgagatgaagggcactggaagggaatgtaacgcgacttcaggccatcccgaagtcggaacccgacgcaaccagataccctgttggattccatccaacgcagttcgtagtaaaagcaaaaaagatcaagaaaaggctctaccccgatgtaggcctcgcaaagatgcacaaagatgctaaggaaggcgatggaattggggttcaaatggagaagagaaagaccattgaaattcaaaaccaggagaagaaattcggaaggtggagggagaaaaccgcagagaacataatcttcgatcgcaaccatgcgacccaagatgggctgaggattagtacatcctgcttccctctccatggttccacgaccaggaagagcgccatcctcctggggtttcttcaacgttgcactagtggaagccgattttccgaggtccattgctgatcgaaggtcgccggaaaacgagcctaggttgatgaactagggtttcttgcggcggcgaagaaggcaaagagtgcttgcaggtggtgtgtgtttaacaggtttggcggacttcaaaatggactcccaaaattccctttaaataggcgcactactgacggtgcgaattccagggaacagagagagatgcccgctgaaaatttctggtcccgttacgcgcggcggttttctggacttcagtttaaaattcgctcgtgaccgttgggcttcaaatggcgtgctcgactacggtctatctccgcggtcctcacaccgggaatgacaatagtctcgacacccgaagtcgcaaatggttgcacgagttcattttaagcagaagtcgggggctactgtcagggttacgggttaggcataccctttacccttcgatatacgttacatatcgatatggcatacccacgcgcatgcggatatttcctgtatattctaagaaaacctttcacggaatctacagacgggaagaatcctactcgggcagaactgggtcgttggcgtatcgtatagggtctgatacctccgagttctacgtgaagacctctagatctgcgatataaaagggaccccccgggagggtttaggacatcaaatctcagagccaacataacctacacagcctacgaagccggagcctacgaggagccaagtcgtcgagggctagtcgaaacaactcgactacaatctcgccggatccgacaagttcccttgttccctttgtaacctgtgttttctaccatataataccacatcaactggattagggttatttcctatcaaggggcctgaactagtataattcttgtcttttgtttgcttgatgtcgtactatgtagatccttgtaccaacgtaccccaataccctctatatccggtctacgggtatcacccgtcgacacatgtgagctcataaaatagcgattaaatttatcatgtttgtaggtggatatatatcataatatgggacagacggatggatacaactcttcccatatcctaacccatatttttttgcgaatttggatccgaactcggatagtaccagatatatcccattctctctcgcatattcttcctgggctgcgagcctcaagtcggtgtcgaaacattgcgaaccactgggtccagtaccagggggtaccgccccgggtggaccattcggtcaggatgatccgagcggtcgaacttgattgttgtctctgaccaccgaaggtattgaggcgtgccgggctggacgtcgttgatctccctgtcagtcagcttttgcttcctttttgactcataagcttgcggcccaccaaagatataattgagctctttgcgagaatcttgaaaaccagtcggaccgtcatcttcatcatccttcatctttgaggtgctctgatctccatctgtagccttctttgtttgctttgcgtattgctccgcaaactgcttgtagatgaaactatctttggctgcatggttagagtttggatgatgcgagcattaggcgttcatgatcttgtcgaaggtgttgatgcacgagcgctgtcaggaagatggcgatgcaagtgctacaaggtcttcaggcttacgcttgtgatccttatggttgttgcttccactccccccggtgactgccgtatctttcttggacttccaattgctacccggctgcttggaggcggtgacggcatcatcagctttggcatattcgttggctttttcgaacatttgcttgaccgtcctgggaggcttgcgtccaaattttctgactaagagttcgtgacggacacccttagtgaaagcggctatgatgacgttgtcggtgatgtcggagatcttgttacgttgcttagaaaaatgttggatataatcccaaagggattcactaggcttctggatcacattgtagaggtcgaagtgggtgtcgggacgtttgaaagtgccttgaaaattggcaatgaagtgctcacgaagctctgcccaagatccaattgtgccacggggtaacccatgaagctaggaccgagcagaatctgctagagctaccaacaagtagtttgccatagccttgttgtctcctccttctgcgcggattgcgaggccatagacggtgagccaagactcaagatttgttttgtcgtcatacttctcgattccagtcggcttgaagccagccggccaatccactcgacgcaggtcacttgtaaaagctgcaactccatcttcatcgtcaccgtagcggtctggtgatcggtgtgggacataacctctctctacacggcgtcgattgagtgtgtcgcgaagattgatgggctgcctgcgacatggagagcgaggctatttagcacggtgcactctgtgtctgtcggcaggcgagtgaacagaacgttcaacatgatctctgctcctgcgattagatcctgacgcggcaacgctgaggcttggttggtggtaatcttgagattgaagaggcggaacccgactgctagtcggcgtgcggacacttgctgagttaactgggaccgaggcggtgatcatgatcttcgtttggttaatgatgttgaggacgtggttgggcgcatcttcctgaagcaaagtatccagaagagtgattgtcgtgactgcgttctgctgtggggtgcgaaaaaccgtcgtctcctcaacgtcttactgtccaatgagttcacgtgctcatcacccggcttccagggtgcactgtcgttgatcctcagcctcctttgcggcccgctcgtgttcccgctgcaactggtctcgctcttgcgcttgtcgttcctccttcagtcggcgacgctcggcttcttgtcgtgtgcgctgttcttctgcttcacggagctgacgctgttctgcagtctcgttatcggccatgaaaacgccgaaaaagagaggcgtgtagttgtcttcataggcttcatcaaaatcgtcgaaatcgtcgaggttgctgaagtcgtagttgtagctgaagtcgtcatagtcgaggatctccattggccgtgagtcgacaccaggagagctgaggtagccgtccaattcttctattgaaaccgtcccgaggggccaacttccctgaagctagattggatcagggccgatgccagatcccgtctagacctacgggaagaagatgcccttgtggtgaaaacagcagccaaatcatcaggaagcttcattaggattgatggataggtcgcatcgccttgatctggtcgtgtcgaagtagatgagatctcatccgagtggcttgaggccgactcggacaagataatcttggggtagatctcggccgagttcgggagaccgaatggggcggagaccgcatctctttccgactggttcgaatctgagtcgaagagagagatcttgccaaagttatcggtgatgaactcgaggctgctgaatcggaacgcctgccctggagggaagacgaagtcgtcgattccggaaacgaatcccatcgcactaatcggcgaaaagcttgacgcaacccctacctggcgcaccaattgtcgaaacaagatttcggcaatacaaaaagggggtggctatcaagcaggaaaagtggatgggtttggagacaaggaattttatacaggttcaggccttctcaatgtgaagtaataccctactcctgtccggggattgattcgccgagtgtgttatagatagtatgatctgggagaaaagttatgccccaagaggcacccggacccctccttatatagtgggaggaatccgtattacaaggtacagcccatattcctaacggaataggcaaataaagataaaatacaatcgtaaccgactagaacctcatgtatttccttgatacacaagtaaggaatttaacccgagtcccttaaaggtattatatctgtatatggtacccctatacctagtcggatatacatgttgtgtgggtatgggtatccataatctccacagtcgagcacgtgcttgggaaatatccatctcactttcacccctagtgctaacgaaaaatttgaagttgaagaaaaacggggccttggtcatagaaaaatttagcccgacggttgtccaagatgatgtctctaacataaacactgaagtataaagtgggacatggctttgggccaagtgcacttcttgtgctagctgagccaacctagtcaagataaaagaagggaccgagagggtatacatgtgaaaggaataagtctattttacctccctcatctcttgctcgtaattgaaacgcttccttcaaacatcgatttgtacccatttcgaaaataagggagttgtagttgagggatgtgattgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagaatttcagtaattacccacatattaaattaatcattaaatggtctgtttttaatattgttaaatactttgggtgtccaagtatgttcaagatttttcttggaattatttgagcataggaagtatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctatttgcctccctcgacactgtttatcttctacctctagcagccgaactgagaccgatttggctcggtttttctcctccaaatctgacctttccccttgtgtttttctaaaattagttgaggggaaatattcctcttatcctcctctatctttatccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcatagcgccgccgccacgtgctccaccccgccgtcgtcgccggccgagctccatccgcgtcgcgccgccgcctccgtcgtcgtcgccggccgtcgtcgttcgtcgtttggttcgagggtgagtaccattgggttcgtctcgtcgtcctctacgtgttcttgtcctccaaagtcgcagccgaccatccaatctccggcgaggtcgccatcttggtccggccattgatgaggtcatcatcatgacgtcatcatcgttttttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttggttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattattttattcctggataccttgggttattataacttgactagttgggctttatatattggttcagctagatattagttatgattgcttagccatgcttagaaacattatcacataattgggataactaatgttacactatcacttatgattatatttaatggtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagtagtgttgtgcaaagggtattgtcacagcctctattcgggtactttccagtatcgcgacgcatggtagacatgatgatgaggctgtgtcttgtgggtacagtggtacacctctggccagagtaaaactattcgaatagccgtgcccgcggtcatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgtcatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgaaagtatgtaacactattattgatgattctgtatattaaattgtcagtttgtgtacctcggctgattcctggacgaggattttatgcataaataagttcggaaattactagtgaatttctgggcgtgacagtgatttaatcagaagcaagaaatgagagagaaaatatagacttattcccacatgtgatgtggaagaagagagagtgaaatatgggctgggttgctccaaagttcagcccaacattgatgtgttttttttggaataggttcacatcaggtccctaaaccaagttgtcgccgagtctaaaatttgtcctaaaccgcaataccaaatatgacacatccctcagctttcaaaaccagtgcaaataaggtgccaaggcggtttgggtggtggtttcagctgacatggcacctatgtggcattgatgtggcacttaagtaaaaaaatgtgggacccgcatgtaagtgactgttcggttaaaataaataaaatattacagtgggaccctgtcacaccctgaagttctcctcccaagcctaaaatttaatttataaatgaccctaagaaaatgccggtgtacatcaagagaaaaccctaagaaagtaatacaaataataatcgaatctggcatgtggaatttttcttgagttttacatgtcgaaattcactaacaggatttttagtggaattttcagagccctagaaataattttaaccaattaaaattgagcaagcaatattttaattccagggaaaatccttttcttcctttttctttttctttttccctcttttcttttcgagtgggccgccggcccattctccttcctcctctccactccgctgggccggccgaaggccaaggcccagctaggcgggcagcctccctcctccaacgggatgccgacaggtggcgcccacctgtcggcttcgtctcctacttcgcgcccgcacagcagtaccgcaacctgctgtcgcgccaaagccaccccctcctacgggccacgtcggtcacgcccgagcatgcgcggcacctcccgcgcccactcccctctctctaccgacagcgccagcgaccaagatgaccggaattcgatttttagaatcccgcctctctctcttctctcccactcccccacgttggccggcggaatctcgcccctaccggccacgtccgagccgagccgggtcgccgccgcccgtccgatcagccccgggggtgatctgggccgttggtcccgtggaccggcggtggaccacccgcgtggtcccggtccacggtggaccgcccccccttgagccgctgccgagtggggcccgcgtgccggcgccccttttccctctctcccgagccgctgaccggtggaccccgcatgtcggcgccgcactcccttgatgacgtcagccctgggaattattgcgcaataaattatttaaggtctttttgttatagtaataaacacagtgaatcttctaaaattcataactaattcatccgagctccgtttaagcccattcaagtctcagtaaatcaagaaaaatgcgtagaatccattaaaaatggttttttttctgtttcagtagttttgtagcctgtttgtattgtttgctttgtatgtcgcctagattccggttcttccgacgttccggtgtacttcgagatagtcgccgaggttcctccagctgcaaagcgttttataatgttattatgggatgtttacctattgttacagccatgctattttggtaccttgctcctttgttagcttgggttataacatgaatagacgttggactaggagttgcttagccatgcttagttcaactaggatacaatagggaaaatcttattaatgtttagactgttggttctaatggtattattggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagctgacgcatccaggcaagggtgggcgtgatggagtttggatgggccctgcgacggcctatgcggcttccggattcacctaggcacgagaggggactgcccgtcgcccgctggggacggtggtgaaacctgaggtgtggtgtgcttggctagagggggttatgcgaagggttctgtcacggcctctttccggtatgtcgtggtggcatgtcggcgcacggaaacgtgtcgtggggctgtgtcttgtgggtacagctgtacacctctgatcagagtaaaactattcgaatagccgtgcccgcagttatgggcggtcaaccagattcaccgtgattagtctcaccctagtttagtctaatgaaattggatagtataggtggatggttgggcctgttgcaacgtgggatagcgttggacagcggatgatcaatattaattaattattgcaaatgtttaattctttcaacttctgtttataaatgctcgctttatgcaaatgaaccactctagctctcctttgataattccctgcatcatacccctattccggtatgacttgctgagtacagtggatagtactcagtcttgctctattttttccccaaccccagagtgcgagtatgtgtccgatggcgggttctccgaggagtaggcttcgtccgtgccgtcgagggtgcctctggagtggtattcccgctgcagttcaagtccaggcttagccccagttatcttttgtttttccgctgcatttatgtaagacttttatgatgtttgtaagacatggatctgaatgtcaacattgtcgtttgtgtacccggccggtcctagacggggattttaatgcacattctgcttggaattctattcaggaatttctaggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgcttgtttaagtgagatttggcaaaacaagtcagtctagggttttagtaaaattatttggggtttattcgtcagtcagttgggatttgatgggtgaaatgcattaggtcctagctcaggaatatgggttgcaaggtatttgtacctttattgttattattagtatgtatctaatttccccattattttatcgttatgtaagtctgtcttatttattcgctctcatgcaaaattatctatgcataaaatttcgctcttattcgattctcttatttgagtcctttattgctttatttaaatttggatttaagcatgcattgatcctactcctttgtcttctctagatggccggccacccacccaaccaccgcggagaaggcatgatcgactttgtggcagagttagcacgtatgacgctggtggtgggctaccccaacgcgccagagtacacgactgttccaccactcagcggcgagcttcctcaccgtgtccgcctagaggtccatggctacgtcggtacctgcctagctaatatggtggttgaggcatccgaaggcacagcagatcacgcctgtcaggaggcagcatacctgatgatggccagactacgggagcgccacaactacatcttccacgacacggcataccgatttcaccctcgtcgagccagcggtgatgatgtcagtactttccgtccgacagccggcgagaatgacaccacctttggtcacatgtgcactgtgatgagggggatggacaggatgcactcggacctgcacaaggcgtccaaggccttgaatgatgggaagctcatgaggatcgtcgctctgaaggacgagatagcgcgcctgaagagggagaatgctctgttaaagggtcttcacgcgccaggaggagtccggatccgcactacaccccgcaagtcgacaacggcacccatgcgcatccagcttgcgcccaggaa

SEQ ID NO: 75934 - DNA, 1379 bp, Oryza sativa
atagtaggatgataccgtaagcattttaacatgtaacatatccagttttctgcatacgcacgactggtgggtgttacctggtggcacacttctttttagaagggagcttaacccatcctcttgagtcttgacagttactattatattgttatataataatgcatagtaatcatatatggtagcttgtgtattttcatgatgtagttttccacttgacgcgtttttaccaagtcctacacaaatctttcatggtgacagtgtttgcgattttgcattgcagatgcaaggcagcagacagatatttactttggccaatctccttttggccaagtgagaagcaatgcaatttcttcatgtgacaacctgggaggcttcaaatttacagaagcaaaactcccctggatgaagccaatgaaaactataggccttgaggatctgaatttctctaccctgcagatgccaggcaatgttgtgtcgcatacggtgcatcatcatgattttgatgggctcataccattcaagggaaacaccccgaaggtcctcaaccaaggtacattaacatctctcaattcatcactgaactttaaagaaaagacatgcagctgttgcagcatcttcaattttaagtttttaaccatgtgtttttatttaatgatctaaatgggactacctattttagcaattcaatttcttatcagtaaataggtccgactgatttgaccttttgtttgattgttatctgtactgttcacctctctgctattcgacaacgccgagacagcattttattctccataattccttttcatacggctacaatcttctgaaaagtctttgttgctaaacagtcagcattcctgacttggagtttggattaaacaagctacttagtcataagaacacatcattttgctccctttttttcagtaactactgattactcattttatccatttgcatcagcttgctttatggacaagctagaaccacaaattgtttctcaaaaaaacaaaaacaaaaacagagaggctagatccaccaattatctgttacaagctttttggacttcctgccttggtatgttgatctttcaatctgaactgctccattttttctctgggtggagcctgggagcctttcaccatcccaaaaagcaagaaatgtgtttcacgcgagagatcgacaagaaacgactaggtcccatttactaggtttatggccccatcactgcccctgataatgacattcaccagaacttttagctggtagtccagtacccacatctgtgcctggtactaacctgggaccaacaaatacttattggatatgccagcttagtgttgcaacttgcaaggagtgtgagtcatctcaatagatac

SEQ ID NO: 75935 - DNA, 3783 bp, Oryza sativa
ttctccttcccgaatcattcacagttactgcatataacaaattctactgctccgaaattagagcaatattggcaaaaattacagcaatgcacacttcaggaaaatattatagcataattgtcctgcttcagttattaatgggcgaaatttatttatgaacaatctttcttcagtggcctgtttgttgatgacctgggaaccaattttcttgccagaaactctatactatagttttgcaaggtagcataaggaaaaatttagaagcttcacatactggatggatttttttagtagttagcattttggttattggcagtcaaattttttttagtagaatggtaggaggatgggcttatatttggcacaattaattattcagaagatgttgtctcaatcttccattttactctactaaacttattccatatgttttcttaaatgttaaatacttaaaatgggactgcagtgggtctctgatggttgcttgatagccataaggaaaagagagacaaaaataatgaattcatgcagaggtttcagtcaattgcaaataatatgagattggtcgacttaaaattgaggatggtgtgatatgacgagcctctggtgatatgatcattttcctttttcatgtcaggattgacatctttggattgcataccagaattttccatgttcttcagctcgcaataattcatcttcaggtaatatgatggtagtctaggtttttagatgatttgcagcaaggagtgaaaataaattgatcagcactgcaacattgattttcttatggtttgtcgctttagcaaccactctccttatttgcaagctcatgatgtgttgtaagatctagagttgtctagcgaaatcaaacctaacctcccccagtttactgttcgatgtggctgctacaattcttttactaaaagtatgtcaatttatttgttctatatcaggcttgtgtcgaggagaaagggaagcgaggaaaatttgtaggtgaagaaattgacagattgcaatgggcaccagttgtgctggtaattttcttgaaacctgacactataatttcaggttacactcttaatccaagccacaacaaatgtgagtggttttatatgttgaccatctgttatgagctctagaattttttttcatactgcacaggaatggatatcatgcttaatgaatactactgtgctgcagttttcctttctgttttggtgaatttagtaccatatatgcagcaggtcgtgatcagtttttgctacttttgcttgcagtcggtggaactgaacctggctctttctattcagatacagcggttcctgcgtgatcaatatctcaaatctcaatgaagataggcagattgctattccaggttggttctctgaatgtgtgcaagtttgcaatttgtatatcattggctgtatacggttgatataaatttgcagatcactggctgtatatggttgattacttgatatgagggtaactgggaaatccgtgataaggtgtgaaacatcccttttgatgcatttctgtagcactattgaagtaccaaggagtttttgtggccatatttatttatcaccattcaatgaataataactcttcctaatcagcgctaaattttttaacaaaatctgtaacagaattgttctgatttgaaacttagtaatctggtgtgatgcatattatatactaatgtaatgctgctggcggcgtgatgcccactcagtgtaggagttggagggtgtaggactggggttcgcattgccaatgagaggaggaagaccgcctccaagagccttgtccccatcctgtacatggccgtgatgatcgttgacatcgaccaggatctcttcagggtaagtagaacgacactaaaattaggattaacatttctaaacaccatgttatttcagaaattgattagttggaatcttgtattcattttgctagcctaagtgcctactgcctaacttaatggaaatatattggaaaagtttctccatggcagatcgaggctgctatttcctgtagatttaggtttcgctgtaaatactgaacaattgatgcaattttctatttgtattgagtacttgggtggttctttctatcaaccaaatcaatttttctaccctatatctaccctatagttcaacaaatagtttcactcatcactcattctttcattcctcgtgtaacggttcagaatatctgcgtgaaatccaacactcacaatcgtctccgcctcgcgttttcctccccaatcgctccccctcccgacctcccacaataggcgcctagattgctcccccgttcccctgccgctgccaccttctcctctctcctctaccgccacaagcaccgcccctaccaccctggtgaaaccctaatcgccggcgccacctcctctcttcccgttggggctgatcccccaccgccaactcgtcgtcgcgccgatctccctcccctgccaaactctaattgccgttgccactccctcctctctccgttgtctccctactccgatctctctccgttgtctccccatcgtcccctcctctctctctcgcaccgagacgccgccaacgcgtcgcgccgcccctccgtgattcctcctctccgcacgggcatggccctctcctgctttccacgcctcccctccctgcttgactccatcccgtcaaacgccgacctcgctgcacagcaccgcacccccatcccgtcggccgttctctccctcaggcgccgtcgtggatctcccgccatgctcgcaccagcattcagatcgacgccacctcgccgatctcctctgtgccgccgccacgatccgccatcacacacaaatcatcgtcgaagattcgctgcccgtcgtcgacgacttcatcgctgccatctccgacttctttgccctcgacctccgtcactgggcgccatccactggtatccagattgccgtgtgtagtcttcgctccggtatgtctatgttaaatagtcagattcatgtctatttgctatttttgttgttcgcggctgtttgttctaatcatttttttttggggaacgggtttacaaattgcagcagctaggctattcatcaatagtaaaatgttaactgtgcatatctgtcattttgtaatatgataacttgtgtgtgatggctcgcggataacgtatgagaatttctatagatttttgtttacagcatgaactaactatttttttttgaggagaacgacggcaggagatctgccggaatttaattagaaggaagaaaaaaacagtacaaaaccagttcagtcccgaaaataaaaagaaaatagtacaacaatacacggcacaaaacaaaagaaactatggaggcctaaaagccgagcaacggagatcaagatcttgttttactatatatgccactgctctctctaagattgaaatgttgttgaaaattctcctgtttctttctaaccaaacattccaccaagtggtaagcagagctcctcttatcgccttcttttgctccttcgatcccatacaatcaatttgggcccaccaatcggaggttccgacagagaggccaacattgtttgtagataaatgttgccaggaagtaactagagaccaaacttccttgaagaaggggcattcactaaacagatgattagtgtcttcaaaggcgcttgtgcataaactacaaatccaattgcacggccagtgtcttctcaacaagttttgagccgtaagagttttctggtggaggactagtcagccaaaaaattt

SEQ ID NO: 75936 - DNA, 685 bp, Oryza sativa
ctggaaatctgatggctttgttgatctttccaaactttccagactgtatagatacagaagaaaagtattagtcaaacactaaatacaatttcaatgcttgttggacttattcaaaactaggataaatgaaacaatgaactcttgaataagtaaacaagttccttcagtgttgctattataagaaaagcaaaaaaaaaggtcttattgtagatgatacctgatatcttttcagcgcaatagtcaggacatttggtgcttccgatattgtcagcttctttttagcgcgctcatgcgatttgcatctgacattacatagtagagttaggagtatcagcattagggactaggcacaaaagcagtcaagttacacagaagtgattaaatatgtagttattacagctctaacacgatacatttattatagaactagattaacaggacacgtcttatgacatccaccttcctattatttcacagaagcaaagcaattttaacaagcaacagagcgttccaccaattctttttcaaaagtccctcgagaagatatctcgttttcaagactaaaatatatgcaacttttgcatggatatacatgacaatttctgggaaatcaattttccatctcaacaatttgccagatctgaaggcactactcatgtcgttgtagaaagcttggatacggtag

SEQ ID NO: 75937 - DNA, 1802 bp, Oryza sativa
gaagagaaatctaaggaaacaaaagatccttgatattggaaaagataagcactcttacttgtgtaaactttggatccattccagttccaagagatgtcatcaggacgcggggtaagcatgactccctgaagcatgctcccaaggtgaacaagttcgtggatttcttctattgatgttatttgcctgaaagagatcaaccagttattgttatggagctcttgatggacgcctttttgctttctttttgccaacttgaaacacagtggtgcaatgtcttttgggcagctgttttgtagccaattgtcatgccaaaagtttatttttgcgccattacctagctcaattgtcgttgctgcctgaaataaccttttatctgtatcatcacagggaacgctcatgccagcccatggtttgttttcatccttccaaccgagccaaagccaacgaagacgatgggctcgcgaaaacctctctaaaaccaactatgaacaattgcaatcttacgtgttgatgatcatgggtgaagttcacatgtcttttctctaggattggtcactatatgccattacagtacacctgtgagtttaatgttttttaaactacgtataacgctcacattgcagctggtttattccataataaacagtttttttcacaaggttatcagtgattagattctttgagcgtaggaaaagacaaagtttgatttttcttttttgcatgtttggatgggtattttggtttaatctagcgatagggtggttaatagatcaatctccttcaaagcacattatagctttcacatccagtagcgacttatatgaagcacattttcttgccttttttggcacttaacttttaccatccagaggtgacaaaattgttggtagaatttctttttccccttcaacaactgctaataaattgttgcaattcagaaagacagaaaaaaatgactttaatatgacatagctcaactagaagcgaaaattgttagcacgacaacacatggttcaaataatgaaagggtagaagcagaagcatattccaaataaggccactcccgatcataaagaacggattcagggaacacgtatctgatattctgatctcatctcagaaaagtgatgtacaatcatgcatcatggtgctacgaaactacaaatattaccgtgtggatttaaagagttccatattcaaatatctatgttatatcaaaaagagaaccttgacaaatgatatgttcaatctgtcagaatagttatatagtcaatcaacatcctaccatattaatgatcaaaattctgaaatatctactgcacaatcccatatagtcaatcaacatcctaacatattaatggtcaaaattgtgaaagatctactgcacaatcccatagcaacctacaatcgacgaacaaacaggaaaaacaatctacctaaggattaatatcattatagagaaaattatacgacccttcctctataacatatagactcaaactttaaattcgcattagcactcaatgcatactttctggttgccatccttgtttaactcaaaacatttcatcattcatgttaaatatttgcatcattgtactcagacaacacaaacatagtgaccaactgaccatcatactgtgatgtacatcaaggaaacatatctgccatgggcaacaatagactaatatttattgaatatcaatttgttcaacaaggctgaggccgcatggcttgataagggcctcatgtgctctatatgtgtgaaacatcatatagactgcaagaaagaattttggcga

SEQ ID NO: 75938 - DNA, 826 bp, Oryza sativa
aagtttcatttactagatatttgtactgttacatggaagaaagatggcatataagctttcacctagtgaaattataaatattattctattgaggggtagttggaaagaatatgcttgcgcctaattcaaaaaagaagttttcaaaagttctgcttgatagtaggtattgtggactaagattttcaaaatatctattctaatacatctgactattttctctttcatctatgttcacaggcttttgttccatgattccatcccttctgggaattaataactattgtgttgggttgctatttaacttttagaattttgcaggcgtatttggaaaccagggttcaggtcaaccatttgggagctttcaagccccacgttttcccagttcgaagtctcctgcttcctctgtccagcacagagacattgataggcaatcacaagagttgcttaatgggatggtaactcctcctagtgtgatgtttgaggaatctgttgggtaagttctgtgataattataactgtatacttgataagaatgtatttctgctgatgggaatacatgttgctgtgttaaattagcttcgcatcatgtttaatcttctttgtttatattccacaggaacaacaaaaatgaaaatcaggatgatagcatctggttgaaggaaaaatgggcaattggggaggtgtgggatactttcctcttggtcattttcgaagttctgtttgctagaaatgtttgctcatttacaacttttgttcctgctatggtacatttgtagttagttctctatctccttagtccttaatattgtacgcatgttcatttagt

SEQ ID NO: 75939 - DNA, 1327 bp, Oryza sativa
aagttgtaccgctcaataatataactcacacagagctagttttctttattttcaagcatattatttatagattcggtatacctcaaattttcactacggatcaaggagcttcttttatgtctaagaaagtaaaataactttgccgaatcttagtattaaattgttaaattcttctccttacactacgctcaggctaattgacaagtcgagtcgagtaataaggttttcttgaaattagttaagaaaaagattggggaacatccaaagagatggcattaagtgttctttgaagcattatgggctaatagaatatctaggtaaggtgctaacatgttaacaccttttgagttagtctatggacaagaagttgtttgacttggctctcttagatatatcaagtaagatgatttatcggtgacggagcgtggggctcctcaccgggagaccgcgcaggcccccctttgccggttcggccgggggcactaagtgaggttcttcgccctcgatctgaggaatgtcagcgagagaggaagtgcacaagacacgggcgacgtagacaggttcgggccgctgagaagcgtaacaccctactcctgtgttctggtggatctgtgcatgaaggaatacagagagccggagagcgagagagagagagttcaggctctagaaccattccccagagtcccaaccctccttcctcttttctttcctccctttttttctccctccttctctttttttctccctctttctctttttttctcctaggcctgggcctcctttttatctggtcaggggtcactacatgggcctctagctgcctaagaagggaaacatgctttttacaatgagggctagtctacagccggaagtgacctctgacaagcagagcacacgcctcctgccccgctcgcctgctttcccggtggacgcccatttcaaccttcatttaatggccagcgacttccttgccatacctgcgctgaagcctggaatggatctgaccgggactgacataccaactccaggagttagcacgccggctccggctagggacgagagccaggaagctctcatcattccgacgggacggggcgaggcgtgtgacaggccgcctgttgccacctaacctgcgatctgaccggtctgtgaccggtcacacaccgcgactggtcacggaccggataagcgtgcgcggcgccgcattaaatgcggcgtggcgcgctcgtccaacctgctataaatgcgggtaggtgagccccgctgtgctcacctaacccacacacgtggtgccaaaaccacagggggtcggggcgccccagccctc

SEQ ID NO: 75940 - DNA, 704 bp, Oryza sativa
aggtttaacaaaattttgagtgatcttagatctgttgattcttcttatgatgttaattatacacaatctgagatttctcgccactttttgaatggttttgacatgtctatttgggagatgaaagttacatctattcaggaatccgttgatatgtctactttgactttggattcgctttacacaaaactgaaaacacatgagatgagcattctttctcgtaaagttgattttaagtcgagtgctttggtttcttcctcaacttctttggatgttgattcttcttcatcgaagtttccgcaattgctttgtgtaatgccatgtccgatgatcaactctaacaattcgaggaggaggacctggttttgttatctaacagactttctcaagctgtgactaatgttaggtacaggaaaagaggtggtccaaatctttgctttgaatgtggtggtacggatcactttcgttcgcgttgtcctaagcttgggagagcaaggagggaagataatggtgatgagaagaccaatgataacaagccgaagggtacagtcaaagggaggaagatcaaggagactctcaagaaggcttttgatcaagtctacgccgtgtttgagccactaagcgatcgtagatggtgagagtggagatgaagataagggaaagaacatctccggtgtttgcttcatggcgcgtggggctgcaggaat

SEQ ID NO: 75941 - DNA, 12921 bp, Oryza sativa
attcctgcagcccaacaccaaccgggactaaagattgatttttagtcccggttatttgaaccgggactaaagatagcgatctttagtcccggattcttagtcccggttgaaaaaccgggactacaggggggttacgaaccgggactaaaaagcatttctccaccaatgtacggttcaaagatgattttgtaactcgatgataagttgagtgaccttcagcgtactttttctgcattttttttgtcacgttaggtgatgaacatgggccctatttttctattctcaataattaataatcctgaaactgaataagtggtaattacttgtactttctccgtttaatctggattcattaacatcaatatgaatatgagaaatgctagaatgacttacattgtgaaatggagggagtagttgctaagatttcgtaaaatataaggtggacgctgtagccaaaagcgtccagctgcggatgctgttgcggagtggtgcgagctagctgctgccagcgtgctcgccggccggtgagcccatacgaaccagatctgaggatgttgttgcatgaatgcctttatactgctgttgaattgttgatgattactcgactcaaaagaatccaatctagttcaaatccgttgtattaattgtgttccatccaagtgctaggttagattttttgaaacagagggagtatgatgctagctattgctgtccgtgttttgtttgctgttgatgcatgcatgctagtgctgttgttgatgaatccgaggaaaaaaaatcatttctaaaccattctatttatgtcggtggaacggcttttatgcggttaattttctttttcttttgaaaaaaaaatattttttagccgggtgacataaggacaccgcttatgaaaaacctatttccacatgcggccgtcttcatctatccgtttgcaaaaatagctttttctaggtgagcggccatcctcctgtgaagatataatattttcgcatgcctttgcttacaagcggcgtgtgtgaccacctgcaaagagcaattttggccgcctgcgaaaattgcttttctagtagtaacaatagcaaaagggagactccaaattgtatttggatctaccaaaattaaccctttcattcattattgagtactctctccgtcccattttaagtgcaaccataagtttccgcgtctaactttgaccgtccgtattatttaaaatttttttagaattagtattattattattattatgagatgataaaacacgaatattactttatacgtaacttatgtttttaaattttttcaaaaaaatttcaaataaaacagactgtcaaagttgtgcacggaaaatcatgtctgcacttaaaatgggaaaagggagtagtaatttaaggttatatttatgaatttatgataaaaaagtatgctattaaaaatatgtactcagtataggtaaaatgcgctactaataatacaaataaaatatcatttccagtatgatgtctaattaagatgaatgaacaatgtttttttttcaaaaaaaacttatgtactttctttaaagtaaaggtacacaacgtacatgagagaggaagtcgacacatataacttccagattgtagaaaagaccctaagaaatgggcaaattaaccttataacacaaaatatgtaaaagaggacttaaaaaacttaaaaagcaatcggatcctactttttccacaggaacggcgagccatcttgtgccgacgtcgatggggaggatgattccatggcgagctgcaaaggagagagccgaggagcaaacccagtcggggcctccgcagtggaggttgaagctaccttggccaaacaagaaaaccacagctgcccccagaagacgaaaaaccgaataccaaggaaagaacaccgttcttctgtgttggtcaccagagaaaagttggacggccgacataacctctttgcatgcaaatctggtgaacttgaagccgcagacaccgaagagtagggcgtctagtacttacccaatgagtaccgttggaatagagagtacaggaataagtttcaacaactccatccatggctaagcacctccaggacgaagaaggacgacacaacttcctccattgaactacacaaactacggaaaaaacccgacactgggacaagcccaaccgctccctggaccctcccccctcccccatcccctccctagcgacccacggtcatcggagacagagaaagaattggagagctctcttgcactgttcaaacgaggagagagaaagaaaggataagaatgagcctctgatcccccaacactactcagatgaaagaacagttgatcctatattcagtctctttggaagaagtatatatatgactagttaagctagagttcacatacccaaactaactcaaataaatacgaggccttggcaatataattcaccttttgttacacgtgatcgttgccacctgtgctgactcacagccacatctcatacataagctatgtcacaagactcagactaccaatcaagaggttttgcaaaatcgtcatgaagggaagggcacatgcacatgagactgcatgagtaagatataagcacacactttgatataggtgatatatatgaatcctagctagctagctagctgctcagctccaacccggtggcttgtggtggttgtttgggcctgagggtgcatagtcctgtgtctccaaagccatcctcgcattgatcatggcgtcctcctctagggcaacaactggtctctccatttccatctgaaagagatatcattgatgaaaacgaacaattctatgctgtgtatagtaaagtaagtgtttttctgacttccatgtgatatgaatccaccatctctcttgatatataactcaatacggagtggttctctcaagttggctatgggttgggccataacaacgatatctaggaaagtgataaggttgtagattgagtacttgtgtacctaggtccttcgacgcaaattgatgcatctctaattcaacagtacatatcttggggatatcaatcatgctaactatccacctttttaacatgggaatctttgaaaaactattcctatacacaattcttgcactagcaacaggttatgaaccactaatccttttcttcactggagaacaaattttgatgtacgaaaaacgtgtaacaaacatctaagaaaattttgaattatgcaagatgctctgcgtcggtttataggattcctctcatgagctcttatatatgcatgcatataaaaaacccagggaaattaagataaaaggatggaaacaatgtgtccttaagaatgagaagataatattatattatttaaaatacctttggctttgctgtgctgcctctgactaatggcatctcactggactcttgcaagtgcagcctttgcactcctgcaatcaaaagggatgtgaatgaacaggttgatcttacatgctagaacaacaaaaccaaatggatcaaggaatcaaggaaggcaatgagtgtgattctgaactcacttgagagaggtatagcattggaaggaacaatcaagaagtagaatgccaacaaggtgataagaagatagtagagtggtagtgctggtgatttccccattgtatgcatgcactatagaaggctgttgagcagcactatctcaagttctcaatggaatggaatctctgctggcttcatgtgcccttgcactacttcttggtcatgccctcaacccctttttattgcacatgtcatgcaacctagatcattcatttaggagccaaagtcaaaaaggcaaggtggagattcacaaagtctaatcagtggaatttggcactagcccaacctttctctgcctttcttccccgtccactagttgatgaagtgcttctattagtccatatctcatattgctgtatttggtcatggcatgccatttgttgaatgaggagagagtgagagatggtgtagtttctattaaaagaagactaattagtaagtcatatgtaagtagctacttcatgggtatcttgtgttttcagaggtgtttgcttaatttgaaggaaaaattgtcaccatcttaatttcattttacacattaatataactagatatatttatcaaaatccaccgacttggtctaaacaaagaaaaaattaaaatccttaattactccatcacgttgttaatatttttgcggtgaaattcaatgtagcaacaagtcctgaacaagaaaagctatttccagcctctatgtcaaaacaaagtgccatacacgaaaatttcaaagtccagagctgtattgcatttcagacaatatgcatgtcattgtcacaacaaaactaatgggacggctttctgatgaactattctcaattatgcataatgcacggcattacgcatgaactgagagagatatttccattgggagatgcatggatcatccatagtggtggatgcacaagctaagcatccacaacaaccagtggctgcaactccttgtttggcatggcagtggtggtggcgtctgtcttggaacgaacaaaaacccatgggaatttcacaagtccacaaaagaacttttgattgtgcgttggtaagtacggttggtatccaagagtggcgagagatatggtgctggaaaggtggtcacttttgtatatttgcaacggggacaggacatgcatgcagtggatttgagaatttcggctgagcaatggggtggtttcttataggagtggatctgtgcttttaaaatgctgagagtgttgaatgattggatctttattagagttttagttagcgctactagatggttggtgcaattagtccacgagttctgtaattagatagtgcactctataagctcgtgctcaagtgctaaccaagtttatttaataagtagtaaattgtgtctatggtacgtatataaacttgaggtggatgtaatttaatgcaagaacttaaaaaaaaagcatagaggtgcgataacttggataatgtgtacatttttgttaaaaaatcaatattccacaccatatatactttttaagctagcgatgtaaaaaagcagtcactcagactatctcgataaggatctacatgtattatgttgtgactatctcgataaggatctacatgtattatgtattgttttttttcttggttgtataataaaattgcatatcgatttgaaactgaaaaatataatgattagcaaaagtaagtgtgtatgcaaactaacatagtttccaaactattagactaatcatacatatcattgtctccggtgacaaatacactgcaaaacacaaaattaatccaggagccaacaatcttgttaagcttataatacaaataacgaaacatgattaatcaaaggtgcataacaatgtttttaaccaaaatgttgccgagtttacataccaatctactcattttttaagttagtacactagatcgtacccacctaccaagttcttgtatcacatgtgcaatttatactctttaatgaaaacaaaacaatatacttgtgtggttttaatttcatccgcacctcaatattgtttatttttcttactccatccgtttcacaatgtatgtcattctagcatttcacacattcatatagatgctagcgaaaaatgctagaatgacttacattgtgaaacggaggaagtatctattataacatgacatatgaaatgtgaatttagtctaccattatgtgtttcaatccccgtttactttctaaaagtcatgtgttagttcaatatgattgtgacaagtcatacaaaacggatcggatcggatcaaaagtaatgatcggactatattaatccttatgttaggtcactgtaaaaatatagtcttgtgatggtattacggttcacaaaaacgggaccatggtggttttgggattttcacaaaaaaaaaaccgttgtttactagtgaaatccgatcaaattttgtcaaaaattaaattcagtttgattttttaaaaaacttcagtaagaaactgacccgtatgtgttcccgagccagcccaggaagttcagttttcgttggttttgtaaatccttgatggcatagacttcacaagtagtttggttaagtcaacaaaattgtgtaatccacttgtcgccttcttagtacactcttcgtttcccttcctagtcaccacactcagacccatgcagcgcactcactgaagctgctacaaagttgacatttgaaggccatccgagcaacccaaagagaaaagagggggtctaagaaatgtatcactctatcgtgtatattgtacagcagggtgagaggtaaaggatgcagagaaccttacatatccttctcatctctgcttccctgcttcaagtctccaagtaccagtaaagctgcagcctagctaattgagatagcccaagttgttagacacttgtgatgcacccatggaggtgataacttatttaataaattgatttgtcttaattagcgtagtgcatgatcaaatgcaagtaagcaagccaaactaaaaaaatcatttttgcaagcggccaaatgtgatttttgcatgcggcgagcacaaccgcatgcaaaaatcctatttatgcagcccgccgccgtcctccgagccagatccgcaacagcgccggtgttgcctgctccaggccctaccgcccgccatcgtcgtcggatccgtcgcccctaccaccctcggtcgtgcgtcttgagctctctggactacgggacgtggcgggagcttagtggcggcagctgatgatgacaccatggtcatggtcatggaggccttcctccacggaccaaacggtgcctcgtccacgcgactggtgagcacttcaggttccactcccacatgttcccttcacttcagtttgctgatctaatacctgatgagaccaatgtatttgttcccccttcaaattttgtctgctgctgcttatgtgatgttcgatgttgcatcgtaaattccactcaacatcgcaccgaagcagaattagtataatgcataatgctttacctgcctctatctactcttcgcttggagctttaaagttaattaatttaatttgtgctaaattaggattggttactctggatttcgttgcttcatttgtccactgcaactgcaactccacgctcagctgatcctccccttcgccaatcggggctgccttggggaactctcgcccatcgcgcgcctgatgcgatcgatcctgccaccaaaccgaagccgaaccatcccggccgctgcctttgatcgattgccaccaaccacgacgcctccaacgtttcagaatcgatcagaggttcatctctttttacaatcacagtttcatgctctatggttgcactatttatttcgaacaacatattatcagtgaccctatattcttgcttagtggaatacatacatctatgattagtgaggttgacatgtggggtccactttctcttttttttattgtcacataagcaccacatcagtgaaaccagatatctataccactagaggatttaatttaacccggttttgtaagttgggagattatgatttctggtattacggttagggtattaaattaactcgacgtaaagatgagggatgataggtggacttattctaatctgtcatgcatgcatggacagcccatacgccatagtggcatagagagcccactagccaaattttgatatctgaaagtgtggcccgtagtagccaaggtcaaatgtaatgttcaagcccaaatatgatcctgcacgtacgcatgtctactgggtggaaagaagccttatgtctacggtctactgaacacgatttgtgggctacattctgggcaccgttcacccggctaatttttgcggaaaaagtccacattgaatcccttaaatatcggccgaatctaattcataccccttaacaagaaaactggataagatggctccccgaactattaaaacggtgtaatttgactccctagatggttttgcaagcggttttggctgacgtggcacctacgtggcggtgctgacctggttttcatcccacgtgtcgcttacatggaataagaggaaaaaagaagtgggacccaccgacatgtggccccacaggtcatcctccctctacttcccatcttcctcctcccccccccctctctctctctctctcttatctctctttctcggcggcggcgcggagccccagcaacaagcagcggcggcgggcggggcgcgctccagcgcacggtgcaggccctccgtgtcatcgtccgtggcgtgctcgaggagccctgcgaaggcgtcgtcggggagcctaggcgctgacgggaagcaggcccagcactagccccgcgatggtggagaggaagatggagaggagctgccacgcctgggggctcacctcggcagggtgcgaggcgaggaagcgcacggcgaggccgaccgcgagggacacgaggagaggaacgagcttcgcaccggtgggggccaggctgtccgcctcaagtttgggtgttttcgaggcgaggagagaggtgggatgcgacggcggagaggcgttagcattgttctcggccgtcccttccttcccggaaaaaggaaatgatacgatgatgcgaggagagggagagagagagtgtgaggtgtggggtagggagaggggaacgacagcgatgtggcggcgccggagctggtgcagggataggagatcgagcgagctgtggaggctagagccgctggctttggcgaggaaggcgatgtggatgcggggagatggactggctgctctccatcgcaaactctatcgtcgagctgacgagatcaccctgtcgatccaagagctccccgacggcggggggcggttcgaggtcatagtgctgcgccgtagcgacatgtacatgaatctcgtggaggccgtgccgccgccgttgctccagcacccgtcggccgtcgacccgcctgcctccgccacagccgaagggaaaaagaaaagagaaggagagagagggaggaggaagaagggttggagtgagaggatgacatgtgggtcccataatattctttttgtgtgaatgataaatgggtcccacatatatattttaaattctaatgccacataagcgtcatgtggtacgaagaccaagttaacactgccacatcagcgccacatcagcaaaaccaccctctaaaaccaccgaggaagtcaaattacaccggttttaatagttcggggagccatcttatccggttttcttgttaaggggtacaaattagattcggccgatatttaagggagtcaaagtggactttttccaatttttgcttgggagagacaacaaagggttttgggttgggctgattctcagctgaaattctgtaatgttaaaatttggacaaatttgactggagttaagttcggtgattagttgtgcatgccaccaataatgagtagtccaatatatcatcaataagatttatttctaggagttatcatctattttacaaagctagtccccttccctgctcaaccctaccatcgttgtcttcttctatttgtatgttggaagtcattatgttctgttgaagtatcaaagtttgtttgaccctacgtaccacaatcatcctctctctccaataataaagtcggccagtgagactatgaaggataagcccatcaccagatcttcatcgtcgagtgagaaacagtccagatcactggctaaggcccaaggttcaaaagaactctgaatagcctagcaactggggaatgctatgctgacaaagcgacgttataccggatagaaatacgcctagttattagtgccatttattctatcaatggaaaaaaaaactttgcatgagaaaaagtacatgcttagagcgggtataatagcagactattagccagctattaaacatattttaataagataaaagataagagataaaagcagtgggctacagatctgtagccagttgcagcacggactctaaaataacatacgtatatgacatgtgggaccatatattaatagtatagtaagctattattgtatgaattggctattagatcggctattagatcggctatagatgaattggagctagtagtggacgattctattaaacttgctcttagtagatgatagcatggtgtaccacatcagcgatagatatagcatcatataagtgtggcatacctagctcgggcgaatagcttttgcgtctacggtcaacacattttttttcttagcaaaataaacactcctatatcttggtaaagttgagaagggatgccaaccaaaacccagcatgaatctcttctaatctagcttccgattacagaagtttctactcccaagaagcaagaagaggtcatatttttttttccaaagcaaagactcgcatttcttttatttccttgtgcaacgtgacatacctttaggcggtgtacgcaaatcctgttggtagatggatcataagtcacaactttttaaaaatgtcatcggtgataataaagactgtgtacaaacacactaccctatgataaataggtcgcgacgactagaaggcatgagtacattattatgaaaacaatcatgaatactcactccgtttcataacgtaagttatttcataacgtaaattattttagtattttctacatttatattaatattaataaatctagacattaatatgcatgtggaaaatgctagaatgacttacattgtgaaatggatggagtatctcacaaacacatatctataatgtgtgcagtcctaacaaattttagacaaaaaaaaatacgatcaccgagaggaaaatatcgttaaagttttaggactaccaaattttagatgcggtatttcagtactactttgattgataaattttgctataggacactactattgtgtggttttagccgcgggacactgtccaaactcacttttaggggaaaacactccataaacatggtaatttgccaatgaacaccgtgccaataaaaataatgatttccggttgaggagagagaaatcacgtgaaatgttaaaaatgctcttgggcccacatgtcagctctccatctctcttcctctctttctttttctttctcccttggcgctgcgggaggtgctcgacgcggcgcagtgtgctgtcgtgtcggcggcagggaggtgctcaagacgtgcggcaccacgccgctgctgcgcgcggtgcccgtactgctgcgtgccgccgctgcgggcgggctcagccgggcactccggctccagtcgtgcaggtactcctgcggcgagtgcctgttcccggaggcgcaaccgttcccgcacgctgactttgccgacgaggtggcgtacctcgacggcgccctcccctgtgaggtcctactcttccgccactccgccgtgatgccgccgtcgtcgtcgcccggtgcctcgcacaggtggcacgtctacttggcatcttcgtcgtcgtcgtcgttcgtggcgcgacgcggctcacggtggaggtgtgcatgacggagctggaccgcggcctagccgcgcggttctaccagcgccccggcaacggccggaccaaccacgccatcggcgacgagttgacggcgcgtcggggatcggcggcgtggtggaccgctaggccaccgtctcggtctccatctcctacaccgccggtgctgcgtcatcactctgcacgccggtggccgaagccctggagaaagaaaaagaaagagaggaagagagatggccagctgacatgcccaagagcatttttgacatttcatgtgatttctctctcctcctcaaccggaaatcattattttaatcggcgcggtgtccattggcaaattaccatgtttatggagtgtttcccccaaagtgagtttgagcagtgtctcacgactaaaaccacacaataacagtgtcctattgcaaaatttgccactttgatactacctccgtcccaaaatagccttttttgagtttttgtttgtaatatttgactattcgtcttatttaaaagattatagaatagttatttattttgtttgtgacttgctttattatcaaaaatactttaattatgacttatcttttttatatttacactaagtttttaaataaaataaacggtcaaacgacatctaatttgggacgtacggagcagcggacaacaaatttgtagccagctgcagcatggactttaagatacatgtgtgtatgacaggtgggaccagacattaattatgtattacatgtttattgataactattacatgaattggctattaaattgactatagttgatttggagcctatagttagctataatactactacctccatattttaatgtacgacgccattgactttttatccaacgtttgaccattcgtcttattaaaaaatttatgtaattatcatttattttattgtgacttgattcatcatcaaatgttctttaagcatgacataaatattttcatgtttgcataaaaattttgaataagacgaatggtcaaacattagataaaaatcaatagcgtcatacattaaaatacggagggagtattaaacttgctcttatgatactctggatttcacttagtttgcaagagccaggtgtgtttgcaagagcaagttcccaacactcccctctcgtttttcgcgtacacgcttttcaaactgctaaacggtgtgttttttgaaaaaaatttctatacaaaagttgtttaaaaaaatcatattgatccattttcgaaaaaaaaattaactagtacttaattaatcacgtgttaatggaccgctccgtttttcgtggataggagatgggttcccaacggggatggattctaatagctcgagtgg

SEQ ID NO: 75942 - DNA, 43203 bp, Oryza sativa
  unsure (1)..(43203): unsure at all n locations
aaattaggcaggccaacctggcccctccgcacgcaacgccgcatcccggcgccatcgaaccctccaaaagcctcgtttaaagcccccacgaaacaccaccacctccttctccctccctccctcctcgatcccattccccccccccctcttatctctctccccaatctcctccacacagcaatggcgaagccgaggctgctcgccctcctcctcctcgccgccctcctcctcgccctctccttctcgcacggtacgcaggcgctcacctcaccgatctctcgctgtgttaactagattccttcttcgattggttaatttcatgatttggtgtggtgtggtgtgtgcggtcgatcgatgcaggggaagcgaaggacgtgcagctggtgaagccggcgcgccgctacgggcggtggcgctcggccctccaggccggcgatgggatggtgtcgacggtggcggactactccgatcccaagcccaacaccaacccccgcggcggcgtgctccccccgaccgaccccaactcgccgccggcgcactgaccgccgccgaccaccgtcgatctacggtctccttccaccccggtcagccggcgacgtatctgcgtataaatacactatatatactgtactaccgtataaatacctagtagtagtaaatacggcgtataaattcggaatacatgtgcgtaattaagtagtagaggaagaggaaggatcggaataagctgacggcgttcttctccttgggcatatacggtgcagtgaccgtatacatgtacgcgtacatacgtatacatgtacgcgtatacgtatgcgcggcgtacacactagccaattattgaagtagacctagctagacttgtgcttgactgtctgtcatgtgtgtgtgtgattattgcgtgtctgatgttgatcgtcgttgattgattattatgagattctgaacaatgttttgtttgattaatttggacgattaattgttactagaacgtatacacgtgcgtgtgtgtaatgttgatgtgtcttgcatttcgtccccgttgtatcacaaccgatccatgtaatttgcaataaaatcatcaataataatgtgtcattgttggatgtaacagagtgtttttttgtcttcagttattcgtctctattccattttccgtgaatttaatttattcctgtataacttgatatatatatctatccatggatgtgacaaactaacaacattatatctatctctgtcgaccactgaacggtctgggtttgtgcatgtgaaatcaattagaacaccatttttcagtgagcgcgcacaaatatagtttatagtttagttaagctaattaaacaagagccaagaaatcattcatcttcagttattggactgctcttgcaaatgtggtcaactcatcttcattctcaacggtcaatgaaacacgatactgttcagaacttcagacatgttttggcatgcattgtcggcgagacttaattatagcttgcatttctgatgttaattaagcttcctcacggtgtgcatcgtcgttggttgcaagcaaggtttctttctttttcttttaagtatttgaaatttggttgcaagcaaggtgatgatgaaaattggtacactagtttaatttaggctcgtctacattgcaaggatcatgaacttttcagacagacctcttacatggtgaaattgacgatggaaacggtttgattcagcagaaatatattcggacaatcttctttgttctcgatcaaagatcctgccttagtttgatgtcatcgtccgatcctaggtgtttttttcattggctgaattagctgtgtgccctttcttcgagcaccaatcatgcttttgcaactagggataccaaaaaatcattgcttgcttgaccaacacaacaccatatatatgactatatgagcatcgatcacatacatgaatatttggccatcgatctgggtcaactcatcgggctggctgctgcagaatgtgatctccaagttcaattctagtttgatctgcaccaaccctaagttttagtctgatcggatctcattttctttctcggatataagtccatcaagccatgatgcccgtctccaaactgcaggaaagtgtacgtgggctgactagctgagtgacgtgccaccagttagcaaattgagctgctagctactccatcaatgtactctctctatcctaataaaatgaatctagaaaagattcatcctagattcattatattaggatggaccacatgacataaattatttattttgggatgaagaaagtaagcacctttgaaaaaaaaatatcgattaagttgagaggtgaaattaaatggccagattcatttagataagggtatagattaaatgagagatggtctccccgtaggaaaaaaaaaggaaacaatttcatccaaaaaataagatttttgcaaaaaaaaatgaattaaacaaaatttattcaaattttgaaatatttcagaccaaaatatttcaaaatatctgcaattttcaaatgtttggttctatcaaataggccaccttgtgaagtagttatactttagtagattcttttgatcggttggaacatgtcaagctcgtgatgggtcggtcactcaccgatcaatgcatccatccgacgatgacgcattcacgcagaaagaaaactaaattgtccacggcgatgccaaaacggaaaaaaaaaagggagaagaatttcttataaacatcttcatttaatttggtcagccttgagacttgagagattaatttgcatggagatggagccatggatggccaaaccaagaagaggagagctttatctctcattcttttcgtcgtcacattgcctaactagctccgatcgaaagaggtaggagtagaatagtagtaggatggatgaacaggacggctgtggctgtgttcggaagcagccgttcggcccgttcccaacaagcacagtgctaaaaaaaagggagcacagaaaacggagcagtacattatcgtgtgattaattaagtattagctattttttaaaaaaatggatcaatatgattttttaagcaactttcatataaaaactttaaaaaaaatataccgtttagcagtttaaaaaacgtacgttcggaacacgaggaagatgagttaggaacctgagcgaagaacacagccgaattgatgattgcctcccctttgcatatgtgaattatggatgtgtttggtatccagaaagaaatagtagtggggtctgaacttatagtccccctcccatctacatacgataaaaaaatttaatggggttttcgtggggctcttatagtcttcacgccagtagtgggggctcgagaccccgccgcccccatgctggatccgctcctgcatgtgcacaaaccatcagattgatctgattgtctgaaacttaataaattattcagaaatggaagagatgctatttaagtgcttcctaggtgtgggtcccggatgttttcgtgccaatcggtcaagcattttgactcatcagtttgtagtttacctcttgttaaatgtgagttgcacagtttagaaatcttggatcactggacttgtctcgtactttcccttgttttcttttacagttttgacatgagtcgcgtatgtatagtgtgtatactgcggcgtacatgccggcatatcggcacaaatgccgttggtgatattcggatatgtttgacgccttgacgtcgtgatcgatggaacagcagacaaaagctagagcaagttgggggtggcctgatctgatcatagttcagaagctagctgccgaccttttccagctccaggagagtactccatccgtctaaaaaaacataaatatagattttcgtgtccaacatttaaccgttcgttttatttaaaaaaattataaaaaaaattaaaaagacaaatcatgcttaaagtattaatcatgttttatcatctaacaacaataaaaatactaattataaaaaaaatttatatgagacgaacagttaaacgttaggcatgaaaacctaggtttatctaaaattaggacggagagagtactcctgagcagcagctggctaggccggccgacgacgactctgttggattggatcgatctgtgctggattttcatttatttttaaaacttattttataaatagatctttgaagaaatttattttatgagaatggactttttctcggcgtcagtaaccctagtatatgttgtatcggaggacccatttgtaagactttttttatattatagttatttttaaaatattttttgtaaatagattatcaacgttaatgtcattaacgccgttccccttcgtaacagtgatttagattccgcaaaaggaccagagcgtcagcgccagcgtcattggcgtcgagacgttagacctcgacaacaataaccttagcaccgaaaaaaggggttgatatgtgaaataagtttttacatatgtatatttgtaaaatatttttttgaaaataaataaaatgtaaaaagtccagtcgattgatctgtgtgcatgcccttcttcgtcgcgacgttgcaggtcatggtcatcgagaattcgagaaggacatatgcatgagtgtgtctttgtcatatgtatagtactagggccgtaagggaataagatgtctcatcggatatgcatgcatgtgattgtgtgtcaactccagctgaagtctgaacatttttttttaattatacacggaagagtgatgatatggtgggagaggcataggtggtgtttgaatctcctagagataaaagacgaagataaatattaagtgtttcacataaaacgagataataataatgtgtaattaattgagttttaatcattataaacttgaaaaatgattaatctgatattttagaacaactttcatatagaaagttttcgtatgaaatgcaccatttaacagtttgaaaagtgtgtcacttttatccaaaagtttatttggagaaaataacagagtatggcctgttttagttcccactttttcttacttccaacttttccatcacatctcaaaactttcctacacacacaaacttccaacttttccatcacatcatttcaattccaatcaaactttcaattttgacgtaaactaaacgcgccctatgtttggtacatctccacagccattcagcctgagcgattttttaaattacagaactgcgacctcttttgtcaaacactttgtcagcgagagcacataactttttctagataatggaataaaatattttggcatttgcttcaacaagctccagccaaatattctggcctttgctcaattattccggcctttgcgcatatctttttttgcctccagtcttgtgctactgatcaactagtagtgggtactatgtagggtggaaacgagccgagccgagccagttacaatggctcataacaagttaggcttggtttggctcggctcggttagggaaacgagctaaaacatgagcttggctcggctcgtttcctggctcgagccagctcgagctggctggtgagccttccgttgaagctgtataatttgtaatcattaagaaaaacaataacaaatcatcaacatgtaaaattaaaataactttatatattcaattcatcaaatatagatgataaattacatattgacaaataataactccactaataaaataaaatcatccatataaatgcatgatggtctaggctcacgagccaaataaaacggcttgcgagccagctcgggctcggcttgtttcagaaacgagctgaaaaagagacttgggattgactcatttggcattcaaagccgagtcaagctaaacgagctcgagagtgtgcagcggtcagggccggccctgagccagtgcagacggtgcgaccgcactagacctctaaaaattaggggcctccaaaatatatatattatggtatcagacctgataggcttagaggaaagacagaagaccgatcgacgatcgagcatattatgactgcttggttgtattttagacttattagtgtgaaattcgttaatgacaataagcttttaaatattatcttgtatttttatggtgaatgggggtttttattttttgttccgcaccaggccaccaaaaagttagggccggccctggcagcggtgtactcacagctgcacgagtgcgcgtggcgtcgcgacggaacaaggctagcggcaacggtggtagccgggccggctagccgtgcgcacacatcactgatcacatattcacttgtggtgtggttgtgccgtgctgtgcgtgcatcggtgcatccgaggcatcagccaacaaacaacgcgaagaagatagaaaatcacgtcgctgatgggcttctcgtaatctaggattaatttgtggttaaatctgaagttcgtccatgaaccgtaataccaaatacgacgcgttcctaaactcttagggcctgtttagctgatattttctgcagctgcacggcaactagctgcagcagcaagcaacacaacacaattacagctgcacgaacacaagcactgcagctgcagcgctgccacatgaatgacagccgaacaggctcttaaaattagtgcaaataaggtctcatggtaggttggacggcagttttagttaatgtgacacttatttggtgttgacgtaacacttaaagtaaaaaattaacatgagacccacgtgttaatgaatctacttctactatactacttataagaaataaaaataagaggtgtttccatcatccgtctaaataaaaaaatagaaaaaaaacctaaaataaaaaagtccgattccccataagaaagtggcgaaaataaaaaaaactaccgtatccgattcccatctaattttgttcgttttctctttttttctgtttttttccgttttattttcttttcccgtttcttttttttattcactttttttccggttttctttgtccgttttcttttcccctttttgcgtattttcttttcgccgttttttctttcaccaatttttctgtttatttcttttatcgctatatttttttgcggttttttcatcgggccaaacccagcgccgccgccacgttgattttcctcctcatatgcttcctcctcctatttactgcaataaccgattcctcactactctctcattattttccccatgaatctactctctcattattttccccatgaattcccctttcgattcagctttaattcaccagattgaatctccatttaatcatcgttattttttatcccaagtatcccaagttttgcagattgcttcgattttgatgaaccatttaattgtcgtcattttttatcccgagttttgcttattgctttaattttaataaaaaaaggggaaaagggagatcaagtggataaaaatccctcaataattttggatatggagaaagattcgaccggatttgatagagatgatcggcttcgttagtcatcgtacgggtacggaactaagcgagctcgagtggattaccgtatttgatgggaggatcggctccgtcatggtataagactatgggagctcgagcggattaccggatttgatgggaggatcggctttgtaatggtatggacacgatactgttcgacttgggcctacaactccatttgtggactgagccaaagagaggtagactaagcagagggagatagcggactgtactaagactagagctgaaaaggacagaaggaatgtgcgtttgtttggtccaaaacgtacgggcattaaagggagtatagtgcgtaggataaaaaatatttttacccgttacaacgcacgagcatttttttttagtatgagttaaaaataaaaattgcagtgtcacccacattgccgtgacaccctccaacctcccactcctctccggcatccacgcgtcccgtgatctaatagtcccgttcgccggcccaactttgtaggactaatacacagccctgttccggtgatcgggctgaaatataatgggccttacgtccaatggaagctaggctgtgtgagcaagctggatgggccggtaggcccattatacgcctgagctgattcggcttgtcatttttcctttgagggctgctatataaggaagggactacctatacatttgtcgacaaattttttcctaaaaatttgacagatgtaattatagtacaatcgtagtgtaattacactgtaaattgcatgtaactacagtgtaacttatatgtaagtttcacataattttgaatcgttagatctattacaagatttgttttggtgaggaagaaaacaaatcatagcacacacatatgtgaaagaatttgttcccacgacctccattttaccgaaataacatgttacgtagagatttttgaaagttacatacaagttacactatagttacagtgtaattgcatgtaagatacagtgtaattacactacgattgtactgtaattacatccgtcaaatttttagggaaaaatttgtcgacaaatatatagcaaaatcgataatggaatcccgttttcgaacgggatgatactggttagttatcagaaccggcatcgggtgacacatatcaggtatcaggcgattctaccatattttcaggtgaaactcacgacgtatcaggtgatacctatcagatatcatgcgatttttgccacatataaggtgatacttacgaggtatcaggtgatacctatcaggtattacgcgatgcctattagatgatacttgtgatgtatcaggtgatacctatcaggaatcacgcgataccagccaggtatcacgcgatacatacccgacatcgacgctgacgaccactgccgccctagtgccccttcctccctagctccggccatcgccgccactccaccgccaccccctcccatcccctagatctggctaccaccaccgttgcccctccctcccctggctccggccaccgtcgttgctctctcctccagctccggccaccgtcgccgccccctaccctggctccagccaacgccgccatcccctcccatcccctggatccggctaccaccaccgttgccccttcctcccccggcttcggccaccgttgtcgttccctcccccggcttcggccaccgccgttgctccctcccccggctccggccactgtcgccgcccccttccccagctccggccaccgctgccacccctccctcggctctttggctccggccaccgccgccgccctatcccttcgctctctggctccagctgccggtgcccaggctccggccaccgccgttgctctctccctcggctccggccaccaccaccgctctccccccgtcgctggctcgggccttgtgccttgtgctcttgcggctgatggaggtggaggggaagctatcccgttagagcaacggtatcccgtcccctagcattcctgttttcctttctaaaaggtagatgtttttctaatggatttagtagaagttcattattattattttttcaacaaaaataaacaactatcatattgatcgatcgatggcatggagtatgtggatctatgatagatcgatggcatggagtatgtggatctcaagaaacaacgtgatattcagaggcataaatccttattttcatatatgtaaggatatattcaaaaaataatttgccttggttatccttagggcatagggcaaaagatagtctcaaactcctaatgtcggaatggctagacaacctttgatttttttttaatgtacatatgtaatttgtaatctttttatactatatatatttactcaatgtaggagcctctccgatatttccatttttttttgaaaaaaaacctgttaaactgactcaggtatgcagaagtagttgataatacatggtgcgttcgattgtaccttttcccatcttgtattactctctcttttttacacgcacgtttctcaaactgataaacagtgtgtttcttataaaaaatttatatagcaaagtatatttaaaaatcatattaatttatttttaagttttttaagttcatacttaattaaccatgcgcttataagatacttcattttgcttgccgggaggagaaactaccaactcatttcagtatcagctgatctttcagacaatccaaatccgtagttaataatctgctagtgttttgttaggaccataccagtcagagctgactggtcatggtgttcgattaattgttgatggagtcatatcgtggagaaagtaattatgagttattcttttatttttttcattgccttggttttttaagttccatctattgttcgtctccatttagtttttaggttttttttatacaatcctcatagattagatttgtagataatttagggtttgtcttccatgatatttttggagttaggcttcttcaaagacttttgtcttttctatttcttccttggtggtggctatttcgtccaaaaggtcatccattaagacgtactggggttaatttgtttgaaaggttgttcgatgatcagatcgacacaatgattttgggatcatcaactttttatgatattaatttgctgttctgttagaaattaattttggggtttttcttccattttacttatctcagaattggttattgttgtgactgcaatcgtccgttcgtattgcttatggtatcttgtggtatttcaagatgtgaagcatctttgttttattctagtttttctagtttttcaagagatttaatttgtttctagtttttctaacagaagggttatactttctcctcttatttaataaatctaccctcctttgcggaaaaagtgaaaaaaaaaagtaagcacgacaagtaaaattagaacaccaattgtgagaagaagcagacaaaacagatatgtgcattttttccacacttgtatttattttgtcctcgtgaagaagagacaaaagcaataccgtaccaccaggtcctttagcacgaacacaggcaaaaaaacaatagtgtatttattgaatatatgtgcaaccaaaacttttgaagattcaaatttcgtccaaattttctcagaacagttatatggttctccagactataataactccatatctttttttagggaattttttttgagggaagaataactccatatcttattctttttctgtgatttttgtgtacatgcatgatcagatgctgcacatgtatctatcgttgaaagcgtctatgatcatttgatcgagctacggttggtaagccgtaaggaaataacgaagtaaaaaaaaatctatgtgcgaaatttttatatcgatattatttgtagtttaaaaatcaatacagattacgatgaaaaaagaagtacgaaactggcttccttgttgtgtatatgcatgacgcgtcagcttatttggcttatgattttcctttaccatgtgcttttctaaaggatttagtagcattttttttattttttcaacaaaataaagaagtattaaactgacccaggcaccatatgcatatcggctgagaatatgtggctgcgtcaaattcccaggaggcgaccaatctatatcaactgatctttcgggcgatccaaatcatgtttaataatgctagttagtgttttgttaggactcatcaggaccatacatgatacatagcagtcagagctgactggtcatagtgttaggtggttaattactgatggaatcaccatggagaaatgcggcaggcataagccaattctatttttcccttgcactgcaaattaatcttgtacgacaagtaaaaactccacttttttagaagaaacagaccgcaattagatggttctatttttttttctatctgatcttgtgtgccattttctcttgtctaggagaagaagagatattagcaataccatcatgtccttccgcgtgaagaaaggcaaaaaatttctattttttttcctgttgaacatataaaaagtaggagtagtaaaacttttgattattccagccaaaatttcctcactgtttcatttattctctagactagaaaaatgcatccttatcgtgttcttttctttacctccagcatcatatgctgccaacagataagtgtttttttaattaacaacatcagacgatgcaatgatttatactgatagagtatgaaaaaaataaaaatattatcaccgagagcaataatcaggaaaattataggtgttttgttgaatgtagcgtaccaagggtttaccacagcaatgaccagccaatcaaccctccccctggggcataagccagtctagcttatttctttgtataacaaaaactcttttcctgctaatatattgacgtgtaatttttttacgttcatgaaaaaaagaccagccaatcaacgctatatattgatagtagatctgtagaacaaaatctacccccactaatagcatccatacgaaattgtcatcacgtacacatattcagacattcagtcaaccgctcgaccaccctaaccaccccctggctcaccgtgccaccttgccaccctaaccacagtcacgtacacagtgttagggcatcaccaatatttactacctactttgagaataagggtgggccctatgttaatgggtattagttcttgttatagctacaatggtgaaataacaaaagtgggtagtaagctgggccgcacaaccaatagccatgagagagggatgagaaaaatcatttgtttattacttatggctaggtagtaagcatattacctagtatttattacttactactttcacaatgtatacaacctgatagaagtagtattttattttttattacccactttatatgcaggatgcaattactgatggaagaaatgcagcaggcataagccaattctatttttcccttgcactgcaaattaatcttgtatgacaagtaaaaacaccactttttgagaaggaacagaccgcaaaatagatggttcttttttttttcttctatgatcttgtgtgcctttttctcttgtcttggtgaagaggagataatagcaataccgtcatgtccttccgcgtgaagaaaggcaaaaaaattctaatttttttcctgatgaacatataaaggtagtaaaacttttgattattccagccaaaatttcctcaccgttttatttattctcttagactagaaaaatgcattcttatcgtgtcatttccttttacctccagcatcagatgctgccaacgtataagtgtttttttttaacgaatagcatcaggcgatgcaatgttttatattcatggagcatgaaaagaattacaaaaattaccaccctagaggataataataaggaaaattataagtgttttgttgaatgtaacttaccaagggtttaccacagcaatgaccagccgatcaaccctatatatcgatcgtagatctctgtagaaaaaaaaatctgcccccactagtagatagcgtccatacgaaattgtcatcacacatcttaagacattcagtcaaccgctcgaccaccctaaccaccccctggccccccgtccaccggatcccactcgcccctctccccaccgtgagacacatcaaattcaaccgagaaatgcaaaaaaaaaaaagaacggaggagcagtagagaacaaggcgcaaatgacaacaaagacaaaagacaaaagggagaaaggaaaaaaaaaacaaacgttgcctccttccaaaccccgaacgcgaccgcacgccaagtccccacgctgacccacctcgctgcgtgcccgcccgcgacgtcgccgtccgctctcccccccgccacgcccaacccccgaacctcccgcgaaccatctctctcccccacaaacccaaaccaacccgttccacgtctttccccacgaccacgaccgttcatttctttcccacttccccgcgagaccgcctcaatttcctattttttcctttccttccttttccacgcgactctctccttccggcttccgcgaaccctccttccttcccgccttcgcctcgcctcgccttacgcccagagctatatatgccgtccccgccgttgatcccggcaaggcacacgcaagacacaaccggcaacccaacccaactcggagacgcggacgaagcaaaggtagaggagacaatctctcgagagaagagaagcggacggaagcaactgatttatttggccatggaggcagcgtattcggcgccgagcacgtcgtcgacctactcgttccacttctccatggcgcaggccgtgctcaccatctccctcaacgtcatcgccatcggcctctccgccctcgtcaaatcctcctcctcctcctcatcgagttcgtcttcccggcgccgcgccgctgcagcgcccgcggtggcgccgccggcggcggttgacctggacacggttcttggcctgatgggcggcgcgggcggcgccgcgccgtcggtggggttcgaggaggcgtccgcgctgttcgagtaggaggaggccaccctgggggaggccgcggcggcgttccgcgtcttcgaccgcaacggcgacggcttcatcgacgccggcgagctcgggagcgtgctcgcctcgctcgggttcgccgccggcgccggccacgccgagtgccagcgcatgatcgacgcctacgacgcggacaaggacggcagggtcgatttccgcgagttcctcaagttcatggagacggctgcggcctagggaatccacaggattcccatggcgtcacttctctgcaaattctttgttctttcgttctatttttctctttaatcgacttcgatcgctcagccgaatgaagaacggcagcatgtgtatgcttatgatcagtttaggtgctgtttggatcatggcattacaaagagccaagaaacgggttgtgttttacttgaactgaaatcgatggaaatcgaattgaaatgacaatttccgtgcttgggttctatccctgaatcaaattccttacccttggcttaaaaaacagaccgaacagtttttctatcctctacctaaagcatgtgcctcatctgcttatgcttatcagacaaattttaaattttcaaccttaaattttaaagttgattttgagatttttttcattgaaatttatttttagcttttgcttttaaatcgctaagaacacgtatataaaagtctatttaccaattactttttatttgcaaatatgccaacgatggctccgtacatgtggaaaggacttagtaagagaatatgaacgaggtttaaatttcactgattcaatttgatttaattaagcctttatataaatggtaaacatgtctccgatcattgaactctcattgattttagtttacaattgatattcaggcccatcaaaaccttccagggctcctttagattgaaggaaacttatagtagaatttttagaggattaaaaatttggaatctgtagagaagaaaaacaggattgctaaaaaaaaggtcgctacatttttcacttaattttagtccattgttctcctatttgtaggtataagcttttaattctcatatctcatctttcatgtaaataataaatactccttttttttaataatgggaataattgtattagaactgaaattacacccggtctctgcatcgactggagatgcacacgacctaaaataataaacacgtttaatcctaattttcttatacattgtgtgttagaaaatttgcattgtaaatgtttcttacaatgtaattataaacttgcagtgtacttacattataggtgtagaggtaatttacaaaagacgacttcttttttggaaattgtgatgccataacaaaaggcacactttctaaaaaaaatgcatctttataaaggaataggattgtaaaattctcaaggatatttttctttactaagtccgatgctatactgctcttttgcatgtgttttcctcccaaattctttctgtttcaattcctctgagccatctaaacacattatctcgagtgttattctgttctgaaatcttatgatattacatagcacttcctccgtttcacaatgtaagtcattctagcatttctcatatctagattcattaacatcaatatgaatatgggaaatgctagaatgatttacattgtgaaacggatgaagtacgtggtaatatattcctatgttttcatgtttcaaagctttggaatcatgggtttataattgctcagttaacatccctggcaagtccacgcctcttaggtcttataatggacgcatatcatatcctctacaataaatacagagaatatgatatgtttaaaaaatgtatatttttactgtaggttaaatgtatctgatatgctgcaaatgtatattcaggtatatttgtatatgatatactcatatatatttgtatatgtttaaaaaatgtatatttttactgaaggttaaatttatatgatatgctgtaaatgtatattcaggttaaatgtatatttgtagtatgatttaacctactgtcagggttatggataccacatatctaatagtagttgactaaatctcggcaagacccaccacataccatgtcctatacgaaagcaaccttcggatataggaggagttccgaataaggaaagacaaccagggttctacatggaaacgacaagtactactcggattgtatccatattggtttccttagttctacttggacaagggaacacctatgggtataaatacaagactccctaggaggggaagagagcggacacccaccagagagaaccaacacaatcaacatacacccaccagaagccacaacatacaagccaacatacgccaagacaagccgccggatatcgacatcagagatacgcctggatcgaccctatccggtaccttcagaggccggccgtagggatctagcactgtctctgattccgtcgggcgcgagctcgaggaggaaggctaccctgttgtcgactacgagtcagaccttcagaccgccatgtcgacaacagttagataggctaccccatatattgtactggtgtgattatggtgaataaaaagcaacatcggctccggccaacaggatgtagggctattacctgacaattcaggggtccgaacctgtataaaaatccctgtctccatctcttttaccttaatctcgcgtataccctagcatcgacgatcctcataccatgcaaataccagaattgcgacatcaaacgtcgacacctacaaatatacatttagcatatcatattcaggtaactgtagatgtttttagcagggtggctagtgaacagcacagcagtacagtacagaagtcccgcggatccttcctcctctttttcggatcatagttgggccaggcgaagaattttggcccatccagatcactccataaggcccatttcctattcggctcggctaagttgtcgcttggtgggcttcgggctcgtcgtcgtcgtcgtctcccctccccccacctgacttgagacggggagatgcggaggccgtcgccttcgccgccggcggcgaggggcccggcgctcgccgctgcggcggccgtcgtcgtgctacttccgtccatcttccccgcgatcttcaccccgcttggccgcgccttcccttccctcttctcggtgagcccccctcctcccctctctcctcctcgcgcggcccgaaattggagccgatgtgctgtgaagtaagattcaaagctactcttcgtagatttatgattggtagctccagggacccaatcacttgggatgagcaaaggtcgtcttccattttggcagatagctagttccttgtagtgtatgagggaagaattggtgtgtctaattgatgagaattttgcttgtgctcttctagtttaggttttatgatcttatatttgctttgagggttaactaggcagggttttgtcaattgtttgcaggagtggaatgcccctaagccaatgcatgagtctcttctgaatgaggctttgcggcgaacaattgtgagtacataatacttagctgaaaactggagtatttatgttggagcccatctgtaacttgtattttgtacagtcaaacgaacaaaagagagagctgtggtcaccattgccgtaccaaggttggaaaccatgcttgaagtcatcaagtgttcacggtaacctactgaaatggcatgattccgacagccgcagcgatagaaaatcgattattgatcagttgttctgataaattataggggtacctttggaacccactggatatatccaagtatttcttgatggtggactgaatcagcaaagaatgggggtaacacacttcttatgcattgatgctatgatatataacttaacataactggcatccttgggactttagattatccaactctttcctttctgttctttagatatgtgatgcggttgctgttgctaaaattctgaatgcgtctcttgtgatcccacatcttgaagtaaatcctgtttggaaagacacaaggtgcttttggagtctcggagcactatatttttaatttccattttccactgttgaattttaagtatagtttacctttttgtattgtagctcctttgaagaaatttttgatgtggatcattttatcaacaccttaaaagctgaagtttcaatagtcaaagttctcccaaaaaaattttcctggagcacaagagagtactatggtacaggcatccgtgctacaagaataaaaaccgcacctgttcatgcctctgcaagttggtatctggagaatgtcagtcctatccttcaaaggtttgtgaaaaaaattgacttggattgtttctctattagtcaaacatgcgctttgtttattgagtcagcttcatagacttctctgaaataattggctcaagtcacgccttgcaatggtcttcatatatgtagctggtggtcaattaaggttacggagaaatggtcataacatttagcctaggtcaatttccactggtctagctccatatgtgttaacatgacatcctgtcattgtttaataactttgttagttggtcaatttacaaggcaaatcgtttagcagtcatcttaccttccatttgtttccttgcagctatggcattgctgccattgcccccttttctcaccgtcttgcatttgatgacttgcctgtggacattcagcatctgcgttgcaaagttaacttccaagctcttgttttcctgcctcacattatctcactgggggagactcttgtgaaacgcttgagatctcccgtccagggccaatctggtgaacttatccaagaagttggagaagacacaaaccaagccggaaaatatgcagttttgcatctccgttttgataaggtaaatggaaacttctccaatacattttttctgtggatccacagtgtatgtgcattgttgtgccctttaaaacatttctgcttctgatcaatttttcaggatatggctgcacattctgcttgtgacttcggtggtggcagagctgagagattagctctggctaagtacagacaagtcatctggcaagggagggtattaaattcacagctaactgatgaggagcttcggaacttgggacgctgcccattgactccagaagaaattgggctgttactggcagctcttggatttgacagcagaactcgaatctatctagcctctcacaaggtttgactcttctgtgtgtttaccatttttttttctggtggtattaggaaggtctaatatacataacgtattaaggtatacggcggggaagccagaatttctagcctgcgcaaacttttccccctaatggaggacaagaggagccttgcgtcggaagaggagctgactaatgttgaaggcaaggcttctgttctagcagctcttgactactatatcagcatgcacagcgacattttcatctctgcatctcctgggaatatgcacaacgcactggtatgttctgttcgatcttgaatttgcttgattgcttcctttgttactggtcctgactagaataatttgttgaaatttagatggctcaccgtacctttgagaatatgaagaccataaggccaaacatggcattgcttgggcgcatctttgttaacaagagcatggagtggttggaatttcaggaggctgtacaagcagggcacaagggtagatacgggcaaatcagactgaggaaaccaaagcaatctatttatacttaccctgctccagactgtatgtgtcaagggtagactgctaaattttgcaacaaaagactagattctttagtgtgtgaagctgaaggatttttgctcggcgaccagtgaatgttacaatgaggttctaattgttgtcagtttcttaggacgacaaggttctttggatatagggttgggaagaagttttggttgacccaagcattcagctgacttaatttttaccctagaaaaaaaattcagtctcgttccacattcagtgtaaaggttgtagtttcgtgagtgatgtagacttggcatattgtatctttttgtcctttccgtactacattctgtgcatatgtaagtaaacatggatctttcggccgtgaacttgtaagcacacatgttgagtttccaccagggttgaacttttcgatttcaagttcgaggtaaaaatcacacctcacccgtttaccgaaaactggtaaaaccgatggttatttggtcaatgccatacgaaaaccggctagctaatagcgatcggttttcacaaactgagatctctatcagtttccactgctctacttgagcatctgtttaatcccattttgggtatatacaattctaccttttgtatttgtcatcgtagcataaaaaacgtttccaatactgtgtgaaactgtgaaagtgccatttgccatgctgaggataattaagcgatgatgctaatgtgtggtggaacctcgtgtttctggggttcatctctagcttccaattgaagcagaatctgtgacatcaggttgtttggattggattgcatccattctcagccagtattttggaaataggtggggttgttttacatcaggttctcgaaccaggaacccagtaaccctagtaaaatgtacggaaacggaaagagattagggcatgtacaatggtgtttaatagcgggctcttttcgttatcatgcaagtaaatttggttacgtggaggaaagagagggaagaaatgagaaacatcgttgctatgcatttattaacggaaagtttgttgcatgagggtatagtaaaggaaagaagtataataaaaaaaatatttagtgcattaatgatttataaatcttattgtctctactattgtaggaggacggtctctagtgatattaattaatacagagagctcatattagactctacctttgtacatgcccttatacggaacccaagcctaaaccctaaccctagtaataaacggaaagagaacttatcaatcttcccagaaataacaaaaattctaaaattaattcgaatcggatttgatttaatttggactccgcaataaatacagacttccaaacagatcgtcgagcaccacagacgcttcaacgagttcgtccgtgatcaacaacagttcacacgcgtgttctacgagaaaactaaaccaaaatctccaatggcggaagcagcagcaaaggaggtcgccggcgccgccgccgccgccggcgacatgatcctgctgatcagctccgacggccagagattcgaggtggcgcaggcggtggcgagcatgtcgaggctggtgcgcaacatggtcgaggacgagtgcaccgacaacggcgtccccctccccaacgtcccctccgccgtcctcgccaaggtgctcgagtactgcagcgagcacgccgccgccgccgccgccgccggcgaggaggtggaggagctgaagagcttcgacgcggcgttcatcgaagtggacaacgcgacgctgttcgacctgatcctggccgcgaactacctcaacgtgccgtgcctgctggccctcgcgtgccagcgcgcggccgacctgatcagggggaagacggtggaggagatcagggccgagttcaacatcgccaacgacttcacgcccgaggaggaggcggagatccgcaaggagaacgcgtgggccttccaggactagattatcatcgaagcatagaatttttagatgtttctgatatgattctactatagaagccatttaggtggaagccatttaggtggtttatgtgtttagtcaccctcgctgcattagtttcttgctttgcagtaacagtttcgaggcatagtttatttattatcaatcgaaatcgaagctgtagctcctcgcagtgcttttggcccagggttagacaggtttcaatttcgatttcggctaaaatttcggtcatttcggcagaaccaaaattttctaaaattttgacacaatttaactgaatttgactaaattcaagaaaaaaaaccgaaaatttcgaccaagatattgacttgcgggaggaggggggtccgaaatttcgaaacaaaatttcaatcccgggctcagacatttcagctaaaaaagaaaacaacacaacaaaactacggattgatccgagcgagtcataatgcatatataaaacaattataagttgtaaaatagaatgtcagtcattgaaatcttggagctctcctcacgtcatggtggatcatttggtttgaacaaaatagaagaatcttcctggacacaagcacaacggaaagaggcagaagcaaatttcattgtagaagatagatatagatattgaccaacgagctttagcctttaaatccccctaaatgcttttattttactagctaaaagcaggtgttacaacggatattgtaaaaaaaatgaaaggaaagaaaaaaattataactttatagcatagttagttgattaagtatataggggctgtttatattgatgtcatttttaaccataccattttttgacaaagttaccaaaaaaaatgtctacgtttagttcgttgccaaatttgataaaaacataagaaatcctgccaaaattttgtcaaagacaaattttggtaatattgtcatcttactaaaattttggcatggcttattttagctacaatctgaacatgcccataatatcatatccaaagcaaacgcattcatgtgcgtagttcttataatccctatatatcagcttgtatttgttgcggactcgataccaccactatagattatagcctgttctgcaggacctcagctactgagttgcaatctcttctaaacgggaaactattctaatccctcgaggggatgtttccttgtttgctcaaaaaccatctaaatggttatgaaaaattctggaaaaatttgacaacattcatacaacacatatatataacttcacaaaatcttaagtccaaactcaactcacacgtcgagaaataaaaaagacaaattcagcgtatgaatagtagcgtactgtttatatctaaatttgtcttttttgtttctcgatgtgtagatcgaatttgaagatgaattttggtcgactagtaggtatcattatactctacattgtcaattttttcagattttttcacaactatttacatcgaatttgaaagaaaaaggtatacgaggggatatcccctcgagggattagaatccactccccttctaaaccccatctttgtttgtaacttacttcctccatcccaaaatatttaacgccgttgacttttttaaaaatgtttgaccgttcgtcttatttaaaaaaaattaagtaattattaattattttcctataatttgatttattgttaaatatacttttatgtatacatatagttttacacattttaaataagacgaacgattaaatatgttttaaaaagtcgacgacgttaaatatttagagaagtagggagtattatttttattccttctcttgccgtcgtttctttttgccgaggaagggggttcggccgcgaagcgcgacggccggagagagcagccaccgcactggatcgtcggcccttctcgccgctcgtagtgactgccaccacgtcggatactccggatgccttcatgctgccaactgccaaattccaggttcccacaggctttcggcccaatacaaaaatcggagcagcaaagcccgcctccagaaaaccctagcacatggccccccaccccacgaccacgagcgctatatatacatctcctcccaatggcttcatcccatcgccgccgccgccgcccgccgggaagctgatcccctcctccgattcgtctctagggttctctgattctcgccgtcgccggcgtcctctcttcccgctcagctgcttgttcgcgcctctcgtttctctttcgagcaacttcctgtttctttctctcttgggatttgggatcttggttttgggggattttcgatgggttgaagcaggtgatgaaagcaagacagggacatcagcaccctcttctcttttgagagagatgggaatgatcgactaagtctataatgggaatctctctgatgcttttttaccttccccccaactcagatctgctttgttttttttttcgttatttctcttctccttttggttttgattggtgttctgtggtacttagcttaattaatacgtgaatttgcggttcgtgttgctgccagtgatgcataaacaaatgcacgtattatcggattcttccgtgacgatctcacacaaatattgtcactaccactgaggcagctcagctcagcctttcttttttttttcagaagcatctactgttgtgcttttgatttgccaggtttttttatttcgtttgtttgttttttgtttgtagtttttttgtatctgcagttcgtttggtgcaaattgcctatgatggtgttaaatatactttgagcagctcgctgtgaaaaatacttacaatctgaggccattttcatctcgaatgcattgttaaatatgagttttttggtacaatttattctgaacagtacactccaaatattttcaggctatcttcctcaggggattgctcagaaagctcatgaagctaatacatttttttttgaattcttcacggaaggaaaacactagaaatttgtaagctgcaacctgattaattagggatggcaataggactggttgggcacggttagagcaaaaccatatctgacccgattcccaatattgcccacttaaaccctatccactagagttagtgggtaaaactccgttccgtatccatgcctggtgggcacggatatgtccggcgggtatactatggatcacatataaataataacttgaaagatatataatttaacaaagaaaaataagatcaatatttatcaaattattggttatcaacaataatttaaattatgtcataacttagtatcagttagcatcacaaatgaaccaatagaaagggtataagaaataaaaaataagtcaaaattagctaatataaatacatatgtatcgatcgggtatgggctacctacgggtaaaaaatgaaacctgtttgttgcccatgtcgtctttgggtctcgggtgggcgtgcccaagaaggtgaaccatcagaaagggtataagaaataaaaaatgagtcaaaattagctaatacatatgtatctgggttacctacggataaaaaatgaagcttgtttgttgcccatatcgtcttcgggtcttgggtgggcgtgctcatgggtaaaaagtcacaccatacctatcggattgggtctcgggtgggcgtgcccatgggtaaaaagtcacacccatacccatcggatcgggtaccacggatatccggacccatggataaaattgtcatccctattaccaaactctgtatgtattgaaagattccatctgcagcagaaacgcttcaagatttatataaactagcagaaccaaatgaaattcaacctaggcatttcacccagccacgaaacaaccaaatatttttctttttcgcccggaaataaaatcagctcagcgagatgtggagacggagaccgctgcgcttttctgatgtgttgattggaccgaaagcccagatcttttatgggcttcgaattgatgaggtgtgggcttttcttcaaaggaacacgtctattttgcatcctttcttcttcctcctgattgtattgcgtctctcaacaacaaaatcaggtgtataacgtatccttcagctttgagaatcggtacaaattgactcctatatatggtttaggaagcggtttctgcatatggtccacttgccagtgatatatgataaccaacatatatggtggtcccacgtgtcaattccttttctccttccccacctctccatccgccccgtctcgctcaacccgtccaactacgttgaggtccgcgagaaccggacggcctctgaatccgccacaagcatacacttagggcccatttgaattaaatgatttatctaggaatttcgtaggatttgcccatttgaatcaaaggatttatctaggaatttcgtaggattcaaatcctatagtaaattttcctacttggccctttgattcaaaggattgaagttttccaaatcctatgaaattcctatggaatggcacattgtatgttattttgacggaaatatagcaagagctctaacctcttggaaaattccctttgagtctatctctctcatccgattcctgcgttttttctgcgctccaatcaaacgaccattcctgtgtttttcttgtgttttgcaatcctctgttttacacttccattcctattagaatcctgtgttttcctatttctccattttttcaactctgggattcaaagaggcccttaatttcatagttgtttctacatgtcgccgtgtcggcagcaatgctgtgcttgttgatgtagtgggtggaggtgtagaaaagtacagatgccgatgtagatcagcatggcggtgggtaccagcgtgatcgacgaccggcacgacggcgacccaccaccggcgccccgcgagcagccgaggcggacaagcttgagctgcacgatgttgacgacgagcaccatggtcaggaacctgcacccaagcacacggagcctaccgccattgccaggctcccgacgcggagcgccactcggttgatcatcgccgccgcgagttctcttgatgagaatgctcgtccccgccgccgccgccacctcctgcacaggcgatcgaatcgagctgcgaagcgaagcgaggggttgctcttcggaaagcttttaccaaacgtcgagcgaggagcaaggcagcgacgcctcatcgggtagcggcggtaatctgtggagtagctcccggccgccgctcccagcgccgactgcgagctaagggaggcaaaatagacctttttcctccttcaaaaatcaaaactgaagaatctccttacaagctgatggatataggggcaaattcatactttttgcattgtttctctctatttgcacataataaaataatacattcaatgtctagccagcagctaattatcatgttttttagtgtaatgtagcaaatacgtgtttttccgtgttctatagcaaagactgtgaacctttgaatctcggtagcaaattttgtctaatttgttcagctctttaaatcaaacatcaactctctattttgcgaaaaattaataagataaaagatacatactccctcagtacaaaaaaaaaagacaaaccctgggtttctgtgtccaatgtttgactgtccgttttatatgaaatttttttataattagtattttcattgttgttagatgataaaacatgattaatactttaaacgtgacttgtctttttaattttttcataatttttttaaataagacagacggtcaaatattggacatgaacattctcagggtttatctttttttttttgggggggggagggatggagtaataacacgattgggtactaattttaaacaggagtaggatgaaaacactgctccagacaaatttattgtgaataaagaaccctgcgcctggtttttgactagacaatgggcaacatgccctgcttccccggcttttttttgctcgagcatctgcagtacagtactaggacgcatgactggcttactagggaacagcaggaacttgcattactgatgagcactggccatatttctctgcattcacgcatgacatgagttagatatgaagtgatgaggcagcccccatgcaacagcttcccccactgttgtgagttgacttgagtttatactgatcatgtatacgtaatgcttgcagaattcactacccccgtcagcttgggaaagacaagaactgaattttaacaaactccattactaacttcctattctctcttactgtcttataatccctccgtactcgtaaaggaattcgttttggacggtgatacggtctctaaaatataactttgacttcttgtttctataaaaatatttattgaaaagtgatatatgtatatttttatgaaagtattttcaagacaaatctattcatataatttttatatttttaaactcaacaacttgagagttatttgtgatttatattaccaaggtttgacttaaacattgtcttaaatgacttcctttatttacgagtacagagggagtatgcatgtagtaactctgaatttttctgattcatcgtgcatgtccccattgtctacataccattcagcttatatgctgttaccaaaattttattttttttaattttagtgtttttaatggttttttagcattaacttttaaatagcgaacaaacatagatataacaattttacgcataaattattttaaagttgtttatatgccgttttacggcttatatcagctgtgtaggccaaacgatcagctgtaggctagctttattttgagcaaaacttgctaaattgttgtatgatttgtattgtggttcgttctaaattctaaatttccgacgggaatgtgagcgaggacaaatgttactatttggttgcatggccgatcgaaaagagcagcgagtagggtagggtgatggagttgcacgctcctatctatctctacacactcggctatggccgctgggggtacctggcctccatagtagagccatttaattgctactgctctcccacgtcgtcgtatgtccaatccaacaacgtcacatgtatcaccagatttcgttctaccggtcactccaaaatccaggaaattagggcatgtttagattcctgcaaaaaaaaaaaattttacaccctgtaacatcgaacatttgcatacctgcatgaaatattaaatatatgctaaaaaaactaattacaaagattgcgactaatttgtgagacgaatcttttaaccctaattgctccatntatgataatatggtgctacagtaaatatttgctaatgacggattaattaggcttaataaattcgtctcacagtttaccgatggattttataattagttttttattagtgtccgaacaccctatgtgacacgttaaaattttacacccggatctaaacaccccttagactctgtgctagctgcattattgcaatcattccctgtgtgtataaaaggcacagcgaatgcttctcgtcagctagctgctatttttctcctctctgattcatctgctgctatagcttcttctagctagctccatgatggatgagtaccaatgcctgaagaacatggttttttcttttgagcccagcgacgtctttgagttcttgcatgtggggaggaggccaatgatgatcatcaggatgatcgaatttatcgtgtagccaaggatgaattgccggcgtttcacgctgttgatggtgcgtgcatatataagttggcgccggcaagtcatttcaggctacatgtttgcctcctcctctcatgctagatcaaagatgtcaggttttccaagctctcgatcttctcctatgtacgtatatatgcatctggagcgaaaaggtgcgcgtggattgattttcattacacgctatccatataatcagaagatcgaatttgttctgtgatcgatgcatgcatgatactactaatgcattaccacgaatcactacatatacattggtttcttctcatgcagcttaccgtgttcagggtgtgatcataattaacatgcaaagctgcagcctgcagccttgcgaggagatctcattgcaagtgtacacgaatctataaaagtttcttgatgtactcagacgtcaaggcctattagctcagctggttagagcgtcgtgctaataacgcgaaggtcgcaggttcgtgacctgcatgggccattttttttgttttattagtttttttattatttttttattttttgttttattagtttttttttgtgattttctgttttattagttttttttattattttttgttttattagttttttttttgtgattttctcttccccttgaacctgtgtctggaactagccacacattcccctgaatctgtgtctggaactatttattattttttttttgtgattttctcttccccctgaactgtgtctggaactagccacccattccccctgaacctgtgtctggaactagccacccagtgggtagtgcagtaattatcgaagtgatttttttaatataattatagtataattataatataagtactttaaaaatgtataacttgcatgcaactactttaaaaatgtatataaatttttttatctaaattgtatagatattatgatgtagttacagtaccaatgagttataatcattgcaacttattgtaactataatataattataacttatgcgctacgttagtgtagcgcgaaatttgacatatcatcgtacgattgaaaatttaaaaactagggaagaaaaaactgtcacatgttttctagcagttcggactaataaatccactaaccatgcacacaagaccatatattcaagtttaaaaagatatatattgttttgtttgatttatagacaatggcgaagcagccaattaagcagggtgtagactgcagagtatttttttttcttgaccagccgggacaggcggttgttgactagccgaatcagggctcacagccgccgccgacgcatgcaaagcgcacaaaagcagacaaagctttcgcggtaatccatccattaatcccttataaatagtgtactagtgcacacgttaattgccctggtagagtggtaattgctcgcgcgcattctgcatgcatgagcgcgcgcggcggtgtcacgatggcaggaggcggaggcggcgaccgcgcgccgtcgtcgtcgtcgacggcgatgatctcgcgactcctgccgccgggcttccggttccggccgaccgacggggagctcgtcgcccactacctcgcccggaaggcggccgacgccggcttcacctccgccgccatccgcgacgccgacctgtaccgcgccgagccctgggacctcctgccgccgccgcgttgttagtcgatcgattgcgacgagacattgctgcgtgcgtgcgttggctttgatcgatgtgtcgtcgtcgtcgtcgtcgatgtgtgcaggtgatgcggcggcggaggaggaggaggaggaggaggagcggtgcggctacttcttctgcacgaggagcttcaggtggccgtcgggaacgaggacgaacagggccacggcgaccgggtactggaagtcgacggggaaggacaaggcggtgctgcacggcggcggcggcggcggcggccgccccgtgggggtgaagaagacgctcgtgttctacagggggagggcgccgaggggcgagaagacgagctgggtcatgcacgagtaccgcctcctgcacggcggcgccgccgccaccgcctcttcttccccgacgccgacgacagttgtcgcccgcgtgagtgaaatgcaacagttcgaatgtcttgtgcgactgaatttgtaaacgttttcactaaattggatcgaattttctgctgaattctgttgtttttgttagagtgagtgggtgatttgcagggtgttcgtcaggaagacaccagatggtaacaacgataggggaactacagaacatcatcttccctccgacgacgctcatctccgttcgtcgccggcgccggcgaactctgtggacggcgcaggccatgcgagctgcagcttcttctccggtgctaatgagtccatggcgccaagcgaccatttcaacataggagacgacatgatcctccatggccacgacgaggaggagttgctgatgatgaactgttcttcggcttttgatctgccagagcttctcgactacgagagcttctcgctggacctttgatccaacgagcaatggcatgttctaaaatctaaagtatgatctggttacttctcttaatacaaaagatacataagtcttttgcgtattctccaaaaaaaatctgaaggatgatgcagctagctagctagctagctagatcgatcaatcgagatatatatgaaggccataatttgatcattagatgcatatgcatcatccatgtctacttcttcagatcactagctacttaatatgtcccctctctgtaattaaacttgcacgtatctgtatatatatttgtactgtagtcattcatgtaatatacgttttgtgtttgcgtattttatacacccttctatttcaggcgctcttagcatttcttttactttcttagattataaaaactagtgtgtggttgtgtgtttttgctatgtacatcttacttatatagagagttaaataaaaactctactatctttaaaaaaaaaagtatacatgctacatgcacgagtatacactagaaaaaaaactattttttgcatacaaccaaaactgattttcgtaggcggcacatgcggtcacctatgccaactgcaggcgaaaataatttcgttgaaaaaaacaaaatttcaaaaaaaaaatcaaattcgaaaccctaactcctttgttcatccccaaaccctagcccaccgctagcacaaaccctaggtcacaagctgatgtcttcgtcgcagccaccaccaacgtcgtggtactcgccatagtccatcctaccgccgacgtcgctgcccgctgctagatctgtgcaggagagggcgggggagtgttgttgccgctggattggcgcggggagggccacagccatcaacgcactgctcctccgtgggcctcccactcgagcccaccatcggatctgcgagggggccacagccgttgccctcgccgccgctgccaccagagcccgcgtttgccatcctcgcccgccaccaccgtcgggatggaggagaggtatggttgtgaggagtagggagagtgaaggagtggagctgtgagatggacgggaaaggggagatagagaggaggggagaaaaaaaagaatgggaagaaaatggggtattttcttatgcaggccgcttaagaggactgcgtggaaaaataatgtttttttttcgtatgcgggcctgttaagaatctgtgcaggggagatcaattttttagacggaatcagttatagtttgcctacaacctaaagagtgttttgtccagaaaaatcgatattgtaatagtgatattccggtaaggacatgcggctgtgctacatatataaatagattattgttgttgtgaagaatgtataggtgtgaatttttatacatgttgagggtggactctctgaagtgtaagtcaccagcgcgcagcgcgtatctaggattatgtatatgtacgacatttttgtacgtctgtatatacatacgtacgtacataagtatccagggatcgatgttggtgtgactttcttgggttctgatggctcagctgtctttttcttgaagtgagttaggccttattagtattgtccttcgatgtcaatgttttgtatgaattaacttaactcgtttcaggttaattagttgcttccgtgtgtgtgttcaccttgttttgagccctgctagtctgcttgcatcactgcaggatcaggacagagggatttgtaggtcaacttgcatcacacactctaacacacattccctcccccgaggaaaaaaaataaatgtgagattagattttgcatgacatcatatattttttggaccaagtcaaattaatattagaaaattggattatcaatatccccccctctctctctctctctatatatatatatatatatatatatatatatatatatatatatatatatatatatatatatatatatatatatttttgtttggtgctccatggtgcccgggcaccattgttgaaattgagtatatacctaattcaaatgagtatgaaactttttcaattacttaggtattaacattaactactttactctctctctctctatatatatatatatggattggccatctcaaggtatatgctccaaagtgtttagcatttcactccaaaaattgccatggaaaaaaagacacgagatttaaagagagagacgtcgtccctacaaatatttttaaagaagaaattataaacttgttaggattgaacacgggacctcgacgttgaaatcacacacctcttgccactgcactatcaagtactttctccgtttcaggtcataagattttctagcattgcccacatttatatatatgttaatgaatttaaacatataaatgtgtgtcaagattcattaatataacatctatatgaatgtaggcaatgctataaagtcttataacctgaaacggatgcagtacatcacaacaatggtggcaagaggtgttcaccaaactgatcagtgcataaggttcaccaaactgttcttgagccaaaaaccgaggttcaacgtacggttttcattccctacaaaatctgatcaaagtgtaggaaaaaataaactttcataattgttttttgttcttcctcccattttccgataaagatatctggacaaaatctccagttctcagttgcatgcagtttaagggtctcttttaattgtaggaattgaaaaaaaaagaagtaatataaaatacataggattttgaaatataaatgtaaaacaagggattgaaaatcacaaaaataactggttaattggtttgcagaaaaacacaagaatcaaataaaagatatagaatcaaatgaaatttttcaagagagaggagtttttgctaagttttcttaaaatctacgtacatgtgatgaaacagaatgtttcatagaatttgtaaaactctatttttttttatcaaaggggcaaatagaacattttttcatatataggatttgatttgaatcttaggaaattactacataaatcctttcattcaaagactgacccttaacctgaagttggcttgcacgaaacagcaattacgctcatatgacctaacacactgtttacctaccatgatatcttggcatcttgcttctgcaaccacggtatatgttcatatactcatatgcatttatatgtcattattccaaactactaaataactctgccagcgatggccaagagcgtaactgatcgagcctaatgatgggggctaatataatctcccagttaagatctgagtcaaagccttaatggcgcggtggcggctcgcgactgggccagggcggcgatcacctgaccgccgcaacagtagttaaacggctgcaggctttctcgaagctcacaagctctgaatcaaactgaagaaattaaactgcaggccaggttcagtgtccctcccgtttctgaagaacttcagattaattacagacgggagcgtgatctccttctagatcgcggcttgcgtcagtcacagtctcatcacagatattgtagtatacattcttctagcttctctcacacagcacttgaatggagagagaagaattaatagaattctctcattatctggctgattatttagagtccgagccggcattcttcagacgtagacaggtctgctattaatataggaattctctcatgcaggctgatctgctgatgaagcacacaaggcatcgtgccggcatgtcaaagataggaaataaacaacgatcgatgaaaacaaatctaaatatcagctcaaaaattaagtttaaaacttaaattttagctgggacttgcaagctgaaagacaaacgataggatcggagtcctagtttccaactgtttctttccaccaaatgaaggattcaagggagaggtttcaaggtattccactacttcctctatccacaattataaacattcgaaggatttgaaatttatctatagatataagcatttgaggagtactatttatcataccaatcataactcactcaaaacaccccttttaaataagaggcgtcaaagttttttctcattgatcttaatctctgctaaagaatctataggtgcttatatttatgaacggaggaaggtaccttgcaaataaaagggggagaggtttgaagtaaagattattcttagctacattggatgagttttagattaagactttttttttcacacttcttagacttgaagaaaagatagttagttttgaatgaatcagagttcgtttgcttgtcatgatagaatttgaccctccacagaagtttttccttgaacttggactgggcaatagttcaatgcgagcctaatttaatattccttgcaatctacgctgagttggattgcatttcaaaatttgttataaattttgcagttatttcatgcatttacttttaaaatgcaattaatatcaaagtgataattttattcagttttgtagatgattttgctctattctatttctaaatgctccttccaaagtctcaatagcatcaaaacataggagtaccttaaattttgaacttgtgaaaattcagttcctcccaaaattcggcccaagttgcacttatcatgaaaatctggcccattatgccaggcccacaaacacaaggccttcttctaaaagaaaaagaaaactgggcatctcaaaaaaaaaaaaaaaatcttggtcgtctcgtcgtcatcgcctcgtcgcctcatctcgatctcgtcgattctatccgagcagtagactagggtttttgctgctcgagcggagagcagatggggaaggactccaagccgaaggacaaggggaagggcaagcaggctgccggctcgtccggcggcgatgacgccggcggcggcggcaagggaggcaagggcaagggcggcaagtccgccgacggcctcggcacctgcacctacgtcaaaggtatctccagttctctcggtcggattacgagcaatttgttctcggactcgatcgtgattggtaagatcggtttggattggcgcgatattggattgggatcttggtgcgcgggaggggggaccgggtgtccctaatcgtaagtggatggatttagtctttggtactgaaatagatgtgggcctgaacctaccttgttttcggtgctgatttattgttagctttaaagctcttttggttaggattattctgttcgtggtaaatttcatgttgtttttttttttttgggtacttgactgctgtgttgttactggtttttcagctaggcacgtactgtgcgagaagcaagggaagatcaatgaagcttacaagaagttgcaggatggctggttggacaacggggacaaggtccctcctgccgagtttgcaaaggtaagcggcagatgtacatgcagctcagcttgaaaactaatgtggttggcccaaagagagagtaaggaattacagttttcaggagtttggtacattcgtatggtacaactttattatgtatgttagtattgatgattcgatggttcaattgctaatctattccaccaatcatgcatatctgttggatttgcacagctgaatgctgcagttccagttatctcctatgaatcacagatggtatttatgagaagtgtatctaacattcaatgattttttggctttgatgtgatagtattgcatattgatacttgaagtggaacttggtatgtttggttgtatgattgtatcgggctggaaaaaaagtactattgcttaggacaattggttgaataataactagccaaaggactgtggtaggaaatcttaggatattttgcttggccaggatcaatctgttttttgaaaaatgagatcccagatctcattattcattattacaaataatactattagaatattgtggttaaacagtacacacttaaaagatggattacctatgtggaataagcgtacaatagtcagttgttgaacaacatataaatttgattgtaggcctgccttctatgggaattacctatgtggaataagcgtacaatagtcagttgttgaacaacatatagttttgattgtaggcctgccttctatgggaattgactcactctctgtatgattgtgtaatcactacttgagagttgagacttctattttaccttacttttgaggctttgtgtgtgacatcagaaggaaaataaggacaatatttctacttgatttcaatttcaaacaaatcatttatttgacttacagggctatccacttacatgttgcttgctgtctgtaggctcaggctgctttcataacccactagacactatgtatatatccgactgatattactattttgatactgcagatagcccaagaatactctgaatgtccatctggaaagaaaggtggagatcttggatggttcccgcgtggaaaaatggctggcccttttcaggatgttgcatttagcacacctgtgggagctactagcgcaccatttaagtcaacgtatgtgtataattgtattactaccctttttcctccaatcttcggtctattaacaatgcaagtagcgcctatgacatgagtgctgatctgtgcgataccgtagtgttccttttggcctagcaagtaggttctatgaatttcttcaacaagtggtctatgacaaaaataaaaggacttctaaattatttagcctgcactgttatcacctttagattattaatcgcctgcctcatcattaaccagttaacatgatcattgtttgtttacattcaggcatgggtaccacttcatcctctgtgaaggaaggaagaactgatcagtctgcttcaggttggaacagaagcacctcagtctatacaagatgcagatgcctcgtgtctctgtcaacttaataagcactgaatgacgggcatccatattctatgtttagcctttctaatgctctctgaaagagtcttgaaaaactgtgctttctgtaagtaacctgtggtgtcaagcatgacatctatttgggatatgctgagatttagcatttgtctgtgtctcttatctaattggcatcttgttagctattgttatgtctctaattggatggttcctcctcttacgacaaggcgggtcttgcctgaaaattagaaaatgcgtaaaccttgtgcgccatataagcaatttatcccgagtaacatagcatttgtagatgtggtttcctgttgctggcttgctgtcctgggaatctcccgaatgtcaagagcttttagacgatgacacttatattcagtcaactcagtgtttagaaagcataagttctactctccgtttcatattataagactttctagcattgtctatattcatatatatgttaatgaatcaagactttctagcatttgtccatattcatatagatgttaatgaatctatacacatatatatcttgattcattaacatctatatgaatgtggataatgctagaaagtattatgatatgaatcggaggaagtacttgatctcagcctgaattgaaccataatactactgtgtaaacttctccacaacggaaatggcgtgggtggtgaaaatcaaggaggaaggtgaaactcagttggagtgaaacgtctgtcggagctcatcctcagttttacttttttggatattttctttcacgactatacaaactttttacttctgttttattcaatgaaatctggtacgtagcttgctttgagctaacgacaccgataagcagaatttagaccctctttatttaggcttataagccaatttataaaccgaaaagtttaagactaaacaaacaagtaatgtctttttaaaatcataagccactctaacactgttaacccaaaaacttggttggagaagttttttttcttatgtgagatagatgtataacttcatcactaaccttaaaacattaaattcatcggtttataaatcatatacaaaccaataaactagtaacttaaaattctaaacaaataagctaagcctaaaactaataaaagggccttgacggtcttgacggagcagctgtgagcgactgttcatatccatagtcccccaagagcgcgcggaaccaacggtcgtcgtctcctctaatccgcaaccccgctctcgtccgccttctggctgcgcgccatggctgctgccatccaccaccaccacctcctccctcctcgcctcctctccgtccaccgcagcctccccgcctccgcctccggcgcccgctcccccgccgcgcggccgcgtccggcgcagcggccgggacgtcgtcgtcgaccgcggccgcgccgccgcccacggacgccgcgctgcaggagttcaggcgctgggtgtcgtcccacggcgcggacgcgggggccggcgcggcggcgcccgccgccgtccccgagggtggcctcggcctcgtcgcggcgcgggacctgccccgcggggaggtgctcgccgaggtgcccaagaagctctggctggacgccgacgccgtcgcggcctccgacctcggcggcgccgtcggccgcggggggctcaggccctgggtcgccgtcgcgctgcttctcctccgcgaggccgcccgcggcgccggctcgccgtgggcgccctacctcgccatcctcccgcgccagaccgactccaccatcttctggtgagttgaggtgatgctgatcgctcatcgctcttcatgtgttcgacgaaatgctcctttttgttttgggtggttcatcacgattaacctcacattcctctccgtgctgatgcttttgagtggtttgcttcgtgcctccagtgcaggtcagaagaagagctcttggagatacaaggtgggcgtccattgcaaaaagttcaaaatccatgaatttaaattacaaagcgagctcgttttgttcatactggttgctagtatctttgttgaaatctgtatgcttttgttccttgcaggaacacagttactgagcacaacaatgggtgtgaaggagtatgtgcagagtgaatttgagagtgttgaagctgagatcataagcgagaacagggagctctttcctggtactgtaacattcaatgatttcctatgggcattcggcatactcagatcacgggtgtttgcggagctccgtggagataagcttgctctcataccatttgctgatcttgtaagatcttgaaatgcaatcatgcctgcattttctatttgcttttccaacatgctgtgaaccgacttatctttgcaaaatagataccactggaaaccatgcctgtaatttgtcatgccaaaacgttcagaatatttttattatacactataatatgctctttcaatacttttccctcgatatataatacaaatccaaccaaaatattgggaaaccattatgttctaatcattttggtgctttgccaaaccaggtaaatcacagcgatgatataacctcaaaagagtccagttgggagatcaaaggaaagggtctttttggtagggatgttgtgttttctttgcgaacaccggtgaatgttaaatctggagaacaggtacaagttcccatttattcattttaaggaaatcatatagttgtgcagctgtgacttttgttcactgacaacatttatatactaaataatgttttgacagatatatattcagtatgatttggacaagagcaacgcagaattagcgcttgattatggtttcaccgaatcaaattcatcaagggatgcatatactctgaccttggagatatctgaatctgatccattttatgatgacaagcttgacattgcagagctaaatgggatgggggagactgcatactttgatattgtccttggtgaatctcttcctcctcaaatgctaccttacctgcgattactctgccttgggggaacagatgcatttctcttggaagcactcttcagaaatgctgtttggggccaccttgaactgccagtgagtcaagataatgaagaagcgatatgtcaggtcatccgaaatgcctgcaaatctgcccttggtgcttaccacactaccatagaagaggtatgtttataacccgaataagcattgttcattttcttttttatgttattatctccaaattagtattacgaaacatgtcaaaatatatgtaggacgaagaactgttgggaagtgaaaatcttcagccaaggcttcaaattgccgttgaagtcagggccggtgagaagaaagtgctacagcagattgatgacattttcaagcagagggaggaggaactggatggcctagagtactaccaagaacggagactcaaggatattggtttagttggcgacaatggtgaaattatcttctgggaatcctagagactttttattcattttctgagggtagagaaggttttgtaaaatgccactgtgcaatagcaaattaatgaaagaaaaagagaaaaaaaatgatattctagcacatgcaccttgtgccgtaaccagtgcaatagtagtagatgtttacggagtactccacaaagttggaattatcgccaacattcaaaattatgacttccactctaccagtagtcatatcacttcaattcctgaaatcaatattttccttcatacaaacaaaaattggacatcattgcacatttgcactagtacttgtagtgttattgcatttcaaacacgtcaaccgaacttttttttaattaaaaaagcctataaattgcgcttaaatcggttcaaattgacgaggcacatttcacattttggccactttgttacacatttgtggcagagtccaaactccaaactgtatcaaggtatttgtgggcgcttctctttgttcgatcgga

SEQ ID NO: 75943 - DNA, 9987 bp, Oryza sativa
  unsure (1)..(9987): unsure at all n locations
cgagttgcgtcgcgggtcgatctgcgcctagcttttgggagaaagcgagagcagggagggaccagctgcgtgctgatcgagtgagagtgtgagagtgagctgagctcgatcgcttgtctgctctgctcctcggactctaccgggaggagatcgatcggacccagctgaaatgaaacggtggctatagcttcagctacactgctagccacaccctctgcctttcatggcttgatgcatcttcattagatgctctaggatatgctcctcttgtaccactccatcggtcaagaatcaacgttacgatccattagtactacctaaatctctcggatgaatcatgcacctctgcgtgagactcgttataatcatgcacctctccgtgagactcgttattaacgcttgtgagaaactattctaaactctttgggtatatgtactcgttatatatttgcatatcactcaaatgtaaatgttaaattttaacttttataagttgcagcagagaaaacaaatttaactgtaaatatacattaattagctatagtttaaattttttcgttgtaatttgtaaaagttaatttttaacttgtattttagagtggatatcatatactaatctatcttctcatttttcttaaagaaaaattataactatgtagatgttatgtaactaacgagggaatatcctttaagagtttaaaattcacttccttacatttattgtatataaaaaaggagcaagcagatctctccctctctcaggtttcctgaattccagatctttaccctgatgcaatcttgttctgaatcacaactagcgccttttttataaccatgtcagcagcagaacatacagaaaataaaatcaccactaagaactcgtataaaaagtacttaggagtacatgactccttttgttgtacttacaaatataatccctccttcccataaaaaaataatctagtatcggatgtatcatatccggtttctacattcactttttataggacggagggagcactcaataattccattataaatgaaccttgtttagatcattcgcagctaggcaagcttgtctatatggatcatggaacgattgcaactgcggaggggaaaaagaaacaaaaattcagctttgattgttttcgctaagctacatgagacagacaggaggtatggtgacatctctttcttcgatcgctacaccagcattgcaacttggttgacgacgaactcgatatgccgcagcatattccagttttttctaccacctgcccaggcgccgcctacatgcattgcatatatattgcattgcagctgcaggtagaaacagccactgaaaagagatgacgtcgagagctagagctagggaaaattgacggctgagatagatagatatggatgcattcacctcaccaaatgtggcacatatatatctaggctagctatacaatgattgtcatttttgcacaagtggaaaaggtctgattgatcaaggcatgtacctgtttgtttcaaagaggcataaggaaaaatagtaagggggtgtatagatgtaaggatataaagttttggcatgtcacatcagatattatatagggtgttacatagggtgttcgggcactaataaaaaaaactaattacagaatctgtcagtaaaccgtgagatgaatttattaagcctaattaatccgtcattagcaaacgtttactgtagcaccacattgtcaaatcatggagcaattaggcttaaaagattcgtctcgcaaattagtcgcaatatgtgcaattagttattttttggcctatatttaatacttcatgcatgtgttcaaactttcgatatgacagggtgaaaaattttagagtgggatctaaacaaggccttactctctcaggttgttttcaatgtaacactgttgattttgatatagtttgagcatttgtcttattaaaaaataattattatttgtcttatcatgatttgttttataaatactccaagcattacttatatttttttatatttgtaattttttaataatttgagtgatcaaatgtataactcaaagttaacggcgtcaaacattaaaaatcgaatggagtactataaaattgttgtgtcaatacatatacacgtggtatattaatatgtacatgttttgaatttccgtgtgcaaatgagcataaatattccgttcgatatatgttctctacatgacaacacaaataaaaactatttagctaagttggcaatctagtctatgaattggtggaccttaaatcttctttttctagtgtaatggtgtgtgttttggttgtgtgcatcagagttcgggagtattctcagtatgattgtatcaccttaaaccttccattatcttaaaaattattttttttcatcgctaaagagaatcaaagaatcatttgttgagcagtaccattgacatgtaagtaccgacctcagttttcagcaatattctggtagccctggaattgggaagaaatatgatgtcagtctagccctatcaaagcgcattgtttaaataaaaatgtatttcctccatccaataaaaaacaaatctagaataggatgtaacatattctagtgctattaatctgggcagatgtatgtctagactcgtactactagaatgtgttacattcgatactagattggtttttttatgggacaggaagtactgctataattgagaatagaacggcagtaacgtaaatttgtagcctgctgaactaatcttgtcctttattggatctgcatcgaccaatcctaggtcgaggttgaaagatgccctgccaccagatcaattagacagtgtacaaaagctttcacatttttttctctaggcaagtggattaatggtggggacaacatccaataaaaatggagtaatggaacaaaggtggatcaattaggagtgcatgaaggaagatatctgcctgactgaatgagaaaattgctgtgtatacatccatttgacaaaaaaactacaattagctaacgagccagggcacaattgagatatgaatagtttacataccttataaaatttcccaaataatgcaatataatatggtagggtggaattaatggtttaattagaaaattatgttcttaataaaatatatggtaataagcctatgaccagatgtccagatctaagctataacatagtattataatcctattcttcatggttatggatgtaattacctgatgttagcctttttcctccattttaaaacatactgtagctatttacttgttcacatatatagtcagaagttatattttgatatgaagagagtacgagtgtataatatgaatacatagatgcataagactaacgaagacctccgtctcacatagccacatgccacaatttgtaaaataccccctttgtctaaaaaaatttaatctctaaattcgtagctagagtttccctttttaagatatagtagcttttttcttacacgcaatacttgatgtcccatgactcttttttgctatgaaatcacctcacataggggtcatcctagacctacacaaactagcagctagtggtgttgaatattgatcatgaagcaattggcccatcttatccaatgctattctccaagtggttgtcttaacactaattgaacccaaaattctggctgacatcatctaaactaaacgaacctccaccatctccttgtcacaattttcatgatcaattgcatgacagaccagccccaccactaatttgtggatgcatctatcactataagcttttagtatagctaagagtgattcttccaaggtaattattgatcatatatattaataaaacccgattcctcagtggtcatgtctttgcaagcttgtcggcctctcgattacatcagaggttgctgggattccatctctcattagcttattgcagctagctaaccatgcttttgttaagagtcaaggtacattaattaactgaaggactagttccctaatggtcacttgaaaaatgcaaccactataagaaaattcctttcgatcgatctatgctggttactcagatcgaacggtttccattcatattttactatattatttcatttgaatcttttgctgaatttatgcagttcaaactagacaaatgttcttcggtgaattttcacggagctatttgaagtagaattgcatttcattataactcttgcctctgtttgtataaatataaatatttttgcctttttttgtctctttgacacagtggccggtttaaatcctaaaaatgacacagtgtttttttatataatcatattgatcaatttagaccatatccactttattctttatcaatatggcaatttctagacactcaaagctaacagagtgactctttttagccttctcttgataatcagactctaacaatcatgcgttgcatcaggcaaattaattcccatcctttccttgtctttatagtgacaggtgataagtacctgtagcaaaggccaaaagtttgcctctcaatatgttcaccaaggtatttcactactacatagtagctgttttctttattaaaaaaatcactttctactgcttattggtttctgcacgtttctttctgaaatataacaaagcaaacgtatttgaaatattaacaaagaaatcatagtagttccatgtaccaatcgtctcatcatgatctaagccaaatctaaacaacttcgtgtctaccgctcctgttttctcgtacatggtttgcaatagaacaatattaatattaacaagtagccaaacatctttcctagacagcaaccgggtgaatttgctttatatataaaaaaagggtataatagtagcattcaaatcattgatgcacactagcactaaccacagccagaaatggcctggttagagcccccaaaatattaccagaaatgcttggtgggcttttttgagggaccttaactctctccttgcttcccaaacatggttaaattaaataaaaaaaatgtgctgacagggagagcaaacatggacaaaattaagatacaatcagaaaatgaaaaagaaatgcttcaagaaagggtagacaatattaactcctccaatgaccaaagcaaaacagccagccaaccaacctctgagtagtagtcacaccatgacaccaaaggaaggagtagtcactggccaccaatgatttgcagtagtaacagatataggtcttaggcctccctgagaggctgagagagagagagagagagagagagagagagagagatttggtgttggataggagaagagagtggagacagtgggggtgagaggattggaagcatccagattctgaatctcctgcaagcctacttcctgttatcttctttgggctttcaggtgaggctgagatttcaaagatccatccttttatctgcactgctgctgttctctctgttctttggatttcttggcatcgttcttgcgagattcaactgctttcattcataatttctgctggtcttactaatttgtcagggattcagacctcatttcttgctttaatcctctcccatttctgattctgttcactctatctcatttcatatgctttcatgggaatttcttcggttgttgtactagatatgagagatatccatgtgtgattcacttgaactgttccaagaatttcatgctgatttttagttgttttttttcttctgcctctgaatatctgatgctgtgaatctgggcttcagagtttgtatatgctgtccatgcttctctcggacagacaggacggcatatactcaagctgtacacgggaaatttctccaaaaaagagtgccgaatgtgagaatctcgtgtgtcctttttttttcttcttttcttttttgctttttgcgaaactccaaaaacgttcctttgtgattttttatgtattgaaaagaaatttctgtaactcagatagacagttggaaaattactgtactgtagtcaacagacaagtaatgttatctgcaacttttacatttttttttgagaggaaagctttttttttttgtgatttttcgtgttccttttactagtgagcaaatatgtggaatcttatccgtgatttttctagggaactgatttttctgagtatttatgttaatgtaattactgcactaccagaacttaatagaaatgattaataactcagatctaaatatttcggcgtaatacataacatactcagggtctcagacactagaacctcctcttgtgtaaattgctagttatctacacaattttttttattataagcaagcttcttatgaacgcatatatctgagaaatatttagattacgaatatgtttcgctgactattaaaatttatctcactgtactcttgcagcaagcatccattgtgatgcactggccagtggatgataaagccatcaatcaactgaaccagcatgagctcccagagtgttgttgcagtgaagcagattactgctccggacaaaatagtggaaacctgtccatccacaaaacattctgcacataagctgttcgatgttaaaccggattttcaagggttgatagatgacaatttgtcatcctccagtcagtcctcaagcatcaagattgagctgatcagatcatcaagcttgccaaatatactgccgtttcagaaaagaagctctgaacctgaacctgaaagtccactgtctcatgtttcacatcccaatgtttcagagccagtttactcaaattcttcaaccttctgcacaagtttgttttcgtcgtcgtcgatggagacggagccgtgccggcaattgggcactctaccattcctgcctcaccctcctaagtgtgagcagcaggtttcagcagggcactcatcaagctcctccctgctagtacctggtggtgatggtgatattggcaatgctcatgatgaacctgaacagtcagatgatctgaaggatttcctcaatctctctggaggagatgcttctgatggcagcttccatggagaaaacaatgccatggcttttgctgagcagatggagttccagttcttgtctgagcagctagggattgccatcactgacaatgaggagagccctcggttagatgtgagtttattcattgcctttactgaaacattttcttcactgtaaattgagtagtccattgatcttcttacacaacaattcttttattttcaggacatatacggcacgccgccgcaactttcatcacttccagtatcatcttgctccaaccagagtgtacagaaagcaggatctcctgtgaaagttcagcttagctcgcctcggtcatcttcgggatccgcgacaactaacaaggcgaggttgaggtggacactggagctccatgagcgttttgtagaggctgtgaacaagctagatggacctgaaagtagggtggccataaatgctttgcaattttcagtaccttaaaaggaataattttgaagttgtctaaatggtttatttcattatctcatacagaggcaactcctaaaggtgtgctgaaacttatgaaagtagaaggcctgactatctaccatgtaaagagtcatttgcaggtatcagtgtatcactttatattcatttactaccatttttactggaaaatcaagcacccttctatgttttcatattttgcttacagtttctctgtccttattgtgcagaagtatcgcctcgcaaaatatctcccagagactaaggaaggtaaattgagaaaatagttgatatcttttttagattgttttgtcattctgaatactgaattactgatgcatgctatatgcagacaagaaggcatcctcagaggataagaaatctcagtcaggtagcagtggaaatgattcagtcaaaaagaagtaaacccttgcntaattgctagcnagcanccagaaagctgcagagaacaaataagagcacatgtagatcttaagaagcttacaactgactaaatttccnattgtacccatttncttaggaacttacaagctggcagaagctctacgaatgcaaatggaggttcagaaacagcttcatgaacagttagaggtgcgtatcagaaactctagaatgcagggtttgcaatccgtctgatgttgtagtatcattcttcatctgcacttgtgatcattgttcatctgccatcactatagtgaatttggtcaaaatcaaataatatgctgcaagtgttcagtgaccaaattttcagttaaatcagtacacatattcaggaaaagcatgcggctcacaaataatccgaactagatatccccaatccatacaatttatacctttttcaatcaccaggtgcaaaggcaactgcagctgcgaatcgaagaacacgcaagatacctgcagagaatactggaagagcagcacaaggtcagcatcagcagcaactccctctcactgaaacccccagccgaatcgcaaccggaatcgccaaaaccaacatcagaaaagaaggaggccgaatccgaagcaggcgccgccacttcagctcagccatcatccgaggataaatcaccagacgcagaatgcaagtcgtcgccgccggtgggtagcaagagagctagggttcatgtcggcgatgagcaccagtgttcatagcttgtgtagagaggaagaaggcaaggatttctcagctgcatgcaaatgcatctctcttcttgagaattttagccactgtatataaatttggacttttggggaatgagaatctgaatttggaagcagataaattataatcaaaaatcaaaatatggacttacaaaattttataggatttgttttgcagcaagtaataaattgaagctaagactgagtgtgaacgcgtgctagggatttcttggtcaagccatggtcaatggggagtcaatttctttctgccccctttctttccatgtttttaccaaaatgcccctcgacctcacctgaaacggcaaaatgccaaaaacccgcttcgatcatcttgctccaaagcttacccctttcgggctttctcctcatcgcttctcttctcatctccacccgtgaagagcgaattgctcaagccctaggaggcgacgagggggagtacggcgagggggggaggtcgcggggatcgtcgtcggcgggaggaggcgcggcggggctgccggttgctgctgcgcgcccccctttgcttcgttcgcgcatgggagaagaggaggcaatggtaaaaattcttttgtagatgttggggttttggagtggattctggtggtgatccggggatgtatgtaggagtaggagcccatctatgctgtgggagaaatcggggttggagcgtgtagaagccgtacccccctcctcccctttttttttactcgttttaggttttaggttttgattgtttaagagttacttagtttgtataatgttggatttcagtaggcttttgagtcgattagattgagagatcatacggctaggttatccgaaatggagaattttagcaaacgaggatttccaggaagggggtaaataataatagttcttaacaactttggatcagtgcacagtctcacatcttttacacgctttgcgagcgaaacggaatggagaattttagcaaacgaggatttccaggaagggggtaaataataatagttcttaacaactttggatcagcgcacagtcgcacatcttttacacgctttgcgagcgaacttgtttcgctgcataaggtaattttggcatgcccatgtgttgcctctgatgtattatcactatagagttagatatattttataaattttgtgctgaaggtggtttccacgtttgccgatagctttcgttactgtagagtatagactaagagaggaacattggccatgtaatgatctatttacatgcttacagaaggaagtatggtgagagtggaaattcttgaaccgacctgtcatggttgctgt

SEQ ID NO: 75944 - DNA, 6569 bp, Oryza sativa
cgcccgcagctccagcagttcctgcagctccagcaccagctccagctcccgttcccgtgtcagctcctgcatccgctctctccttcgcgcctacatcagccgtcagggtccctgccagtggcaatggaggttggttgccagctactcccagtggcagtcgcgacctcagcagcagcagctccagtggctcagagccgggcagcggcgagacttatccgccaggctccaggagtcgctcagagggacctggtgacgagcaggaggacgccttcgactccaccgaccgcaggagccgttccgagcattaggctcgttttccattagtttatcgactgtctagcatttatttgttagtttgtgtgtttaggttgcttgcttgtgggtcagtcgacggtcgatatcatgtgcctatgatatggttgtcttaataaggatttttgcttgctttttaagtgttttaattcagatcagaacaattgcagtttaaattcctatataataaagcttagttcttgagcatctgtttttcttcttttccccgtctgctcttcctccagatggtctacaccaggaatggtagccgtacaacaggcgagggcaccaacgacgaagagcgcactgatggtgtgcatcccaacagcgattccggcaatggtccgccaccacttcccgagaatccgacgctagcccaagtgatggcacatcagactcagatgatggcagccatgatgcagcagatgcagcaacagcaccagcagatgcaccagaggatgctgcagcacgccgaacagcagcaccagcagtttggtccccctccccctcagtccaagttgccagagtttctacgtgtcaggccacccactttctccagcaccaccaaccccatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccgccaggcactgaagtcacttgggcggagttctgtcgtagcttcaggaaggcgcaggtgccagacggggtcgtggcacaaaagaagaggaaattccgggcactccatcagggaaacaggacagtgaccgagtacctccatgagttcaatcgcctcgcgcgatatgcatcggaggatgtccgcactgacgccgagaagcaggaaaagttcatggcaggtctggatgacgagctgaccaaccaactgatatctggggactacgcggattttgaaaggctggtggacaaggcaatctgtcaggaggatcagcgaaataaaatggacaggaagagaaaggcggcacagttccggtccaaccaaggaaaccatcagcgaccgcgcttcgctcccgggcagcagggtggacctaccaccatgatcgtccgccagtaccgcccgttcaactctagcaacttccaccagggcgccagtggcagtcagaaccaccatggaggtcagcccaaccgcggtgcagctccacgcccaccagtggcaccggcacagtcaggcccgtccgcgcaagccaagaaggagactggaacaaaaccagggtcttgcttcaactgtggcgagcttggccactttgctgacaaatgcccgaagcccaggcgtgccgggccaaggtttgtccaggctcgtgtcaaccacgcgtctgcagaggaggcgcaagcagaaccaaaggtcgtactgggtacatttcctgttaactcaatccctgcaatagtactttttgattccggtgcaacgcattctttcatttcaaagaaatttgtggggatgcatgggttaaggaaagaagagcttaatacaccaatgagggttcataccccgggaaatagttcaacctcggtcagttttagcccttcagtgctaatagaaatccaaagatcaccatttctagccaacctcattcttcctgaatccaaagacctagatgtcattcttgggatggattggctgaccaagatcaagggagtcattgattgtgcgaatcgcacagtcaccttgaccaacgagaagggagaaaccgtagtgtacaaatcactagtctcaccaaagcaaggggtctccttgaatcagattgaggcggaaatcccagtggtcacgaaggagaagaatccgaggaaattggaagagattcccatagtttgcgagtacccagaagtctttcctgaagacctcactaccatgccacccaagcgagagattgaattccgaattgatttggcaccgggaaccgcgccaatttacaagagaccgtacaggatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaatgaggtcacaatcaagaacaaatatcctttgccatgaatcgatgatttgtttgatcaactgaaaggagctaaagtgttttctaagatagacctgcgatcaggctaccactagttgagaattcgggaagaggatattccaaagacggccttcatgaatccatcgaacggttatgtctttcggacttaccaacgtacccgcattcttcatgaatctgatgaacaaagtgttcatggaatttctggacaagtttgttgtcgttttcatcgacgacatacttatctattcaaagtctgaagaagaacatgagcagcatctccgtctggtactcgagaagttgaaggagcaccagctatacgccaagttcagcaagtgtgacttctggttgacggaagtcaaacttctgggccatgtcattacagctcagggtgtggcagttgatccatcaaacgtggagttagttaccaaatggaccccactgaagaccgtgtcgcagattcgaagttttcttggactcgcaggttattaccgccgattcatcgaaaacttctccaggatcgcccgacccatgactcagttgcttaagaaagatgagaagtttaaatggacagttgagtgcgacaagagttttgaggagctcaaaaagaaattagtatccgcaccagttttgattctgcctgaccagatgaaagacttccaagtctattgcgatgcatcccgccacggacttggatgtgtcctaatgcaagagggcagagtggttgcgtatgctcgcggcagttgcgtccacacgaagggaattatccaactcatgacctggaattggcagcagtggttcatgctttgaagatctggaggcactatctgattggcaaccgctgtgaagtatatacggatcacaagagtctgaaatacatattcacccaaccggacctaaatctccgacaacgaagatggttggaattaatcaaagactatgatatgagcattcactaccacccggggaaagccaatatggtggcagacacattaagcaggaagagttactgcactgccctatgcatcgagggcatgtgtgaggaattgcggcaggagtttgagcatctcaacgtgggaattgttgaacacgggttcgtagccactctggatgcacggcctacgctcgtggatcaagtcagagcagctcaagtaaatgatcctgaaatagcagagctgaaaaagaacatgagagtcggaaaagcccgggatttccatgaagatgaacacggcacaatctgattgggagaaagattgtgtgtacctgacggcaaggaactgaaggatctgatactcaccgaggctcatcagacccagtactccattcatccaggcagcaccaaaatgtatcaagacctcaaagaaaagttttggtgggtcagcatgaggagagaaatagctgaattcgtcgcactctgcgatgtttgccaacgagtgaaggcagagcaccaaagactagcaggtttactccaacctcttcaaatcccggaatggaaatgggaggagattggaatggactttataacaggactgccccggacatcatctggtcacgattcaatctgggtagtcgtggatcgactgactaaggtttctcacttcataccagtacataccacgtatacgggcaaaaggttggtggagctctacctctcgagaatcatgtgtctacatggagtacccaaaaagattgtaactgatcgagggagtcagttcacctcaaaattctggcagaagctgcaggaagaattggggacccgtttaaatttcagcacggcctatcacccgcaaactgatggtcagaccaagcgagtcaatcaaatcttggaagatatgttgagagctagcgctcttgattttggtggagcttgggacaaaagcttgccatatgcggaattctcgtacaacaacagctaccaggctagtctacagatggcaccgtttaaagctttatacgaccggaagtgccgcacacctctcttctgggatcagataggcgagcatcaactgttcgggacagaggtattagcggaagcagaagagaaagtcagaaccatcagggaaaggttgaggattgcccagtctcgacagaagagctacgcggataaccgccgaagggagctcacttttgaagcaggggattacgtgtatcttcgtgtcactccgctccggcgagtacaccgttttcagacgaaaggcaagttggcaccacgcttcgtgggaccatacaaaatcttggaacgaaggggggaagttgcttatcagctagaactttcatccaatatgatcggcatccatgacgtgttccacgtgtcccaattaaagaagtgcttaagagtacccaaagaacaagctgattcggagcatattgatatccaggaggacctgacatatgtggagaagccggttcatatacttgataccagcaaaagaagaaccagaaacaaggtcaccaggttttgccgagttcagtggagtcaccattcagaggaggaagcaacctgggaaagggaagatgagttgaaagctgcccatccgcacctcttcaccagctcctccgaatctcggggccgagattccgtttaagggggtaggttcgtcacaccctgaagttctcctcccaagcctaaaatttaatttataaatgaccctaagaaaatgccggtgcaaatcaagagaaaaccctaagaaagtaatacaaataataatcgaatctggcatgtggaatttttcttgagttctacatgtcgaaattcactaacaggatttttagtggaattttcagagccctagaaataattttaaccaattaaaattgagcaagcaatattttaattccagggaaaatccttttcttcctttttctttttctttttcccccttttcttttcgagtgggccgccagcccattctccttcctcctctcccctccgctgggccggccgaaggccaaggcccagctaggccggccgcctccctcctcccacccgggacgccgacaggtgggccccacctgtcgggcccgtctcctacctcgcgcctgcgccgccgtaaccgcaaccgccgccgcgcccacgcctccgccttctccaggccacgtcggtcacgcccgcgcatgcgccgcacctcccgcacccactcccctctctctcccaccctcggccgcgcccgagatggccgggattcgattttcgaatcccgcctctctctctcctctcccactcccccacattggccggcggaatctcgcccctaccggccacgtccgagactcccctaccctatttaagctccgccgtcgccctctctctctttttccccatttcaccgaactccctcgtgctccccatcgctcccgcgccgtgcacccacccgccgccgcctttcctaccgctctggccgccgctagccgccgctaggctcgccgccgcaccgcgccgtcgccgccgtcgggttcgcaaggacgaactccaccccgtccgcccttcctccgtcgggattcgtcgccggaattcgcatcccctcgcgctccggtgagttctacctctaccgccgccttcggccatggatgccggccgccgtggttcatctccctctctctaatctctctctccttcttccttagggcaccccgaagcccgtccgccggttgccgtcgtcctcccgtggcttgccgtcgtcgttcgccgtcgtcttcctccgcgccggccaccctcggtgaggcgccctctcccctatactcccctccctttccttcctagccgccggttagcgccgccgcctctgccgctggttgccgtcgccggcaacgtgtgcccgcgcgtcgtcgccatcaccgtggccggtcggccggccttgagccgagccgagccaggtcgccgccgcccgtccgatcagccccgggagcgatctgggccgttggtcccgtggaccggcggtggaccacccgcgtggtccggtccacggtggccgcccccccttgagccgctgccgagtggggcccgcgtgccggcgccccttttccctctttcccgagcccctgaccgg

SEQ ID NO: 75945 - DNA, 4494 bp, Oryza sativa
tggctattagattgattatagatgaattggagatagtagcgggctatacatttaaacttgctcaaaaaggtgttactagttaattaacacgaaacctaatgctaatctacagtactatctaatcaccacgtggttagcttcgattaatgtgcacgtgcgtgggggaagtttcccgaagagtctggagacgagtgccaaaaaaagaaaaggaattgaacgagtcaaaagaggttttttttttaattatttttgccgggtctcgccgcgaagacgccatcggaggcaggcagcccggtccagcccaccaagcaggtgaggggcggagatggaggagacggcggcggcggcggcggagaaggcgacgtcgtacagttactgggtgcgggaggccacgggcgacgccgcgccgcttcctgcgccacgcaagatcgacgccgccgacctcgccgccaagcccgcgcccaccaccctcggctccgtctggaacaaggtcccgcctcgtcttgctcttgcactgcatcctggaaataggggggagaaaaagaagtcgttgggttgattgattactgtagtatcggggaatctggaatttgattgattactgtgtccctgaaagtggaatggttcggttttgttgttagttttgcatctgaaatctgaaatggaagttgtacttgcggttttgttgtagttttgcatctgaaatttgaaaagaaacttgtagttgcaaggagggtgatatcatcgttcatgctggggagctagttcctatgcccatatcgagctatctatgtcatgggcaacttaagggattttcaacctggaagcatgctttgccttgctatgcagtaatccctgataggcaaaacctcaaaagcagccaagaagctgaatcactagaacgtgccatcagaatagttcaaacttcaaatgcaacaacacctcacaaacatgtttgagtcatgttgcctttagccctttgatgcaacattgcttcgacgaagcggtttcttgactgttggcaccatctttcctagccaattcttatgcctgtggctgtatcttaaatgatgtttgacaccaaacagggcgtagtgtattatcagctagtatttctttctttggtattgctatggaatgtttattatcaccatttgtttagactatgctactaatacatactgtgcaacaatcaacaagataagttcacaatggtaaaatgagagcacagtatagagattagctttttttaaaaaaaaaaattcataaaacctaatagctctgtgactatatatctaaccaatttcccatgttttctgtgcttcttgtaggctggaacctgggaggaaaagaacctcaattcatgggccaacggtaggataaaggtgctgtagttcagcaatcaaatgcttgaaatccaaatgtcctaactgtaatgcttatattgttacacatttcatctgagtgatcttagataattttaaactacaggatttgctgggctcattagaccctttggaattttctactgggaaggcatctgtttacgaagtatccaagtgttcaggcgatgtgagtagtgtatttcacagagccatttgatagttttcatcacaagtgctttgtcgtggaataaagtgctcttattgttttaccaacctaatgccgtgtggtactgaacctgaaaacactacttctaatgaataaaaaaccattacttctgatagtaccgtctgttgttaacatataccgtaattcttttttgggcttttagggaactcttacatctttagatatccttgaagataacctacaaaactatcaaatgctaacataaagaggaattttttattcatggctgttggggcaattcttgcataccttgacatccttgaacataacaaggacactgttgaaagatatcaaagttaataatccttaaggatatgaaagacaggaatatcaaatttaataatcctatattgatcttacagagacagaagaattttatattatcagcattcatcctcagtgtgtacttctcagcaagcatgagttgtggtcctgatatttttgctgtgttagttgttggtttgaacattgaaaaatggcgtggacaaacccattaaactaggaactgatgagtagcaaaaatgtggcaactctccgtgggagctctgcaaaatgctggtaataatactatgtggattcagcatgagttcagctttgttatccctgggggagatctacaaagcttttctctctgttcagtaaaacattgattagggcctttctcaatccaactggggaattcagtaacatgtagcagatttgttttctcgatttggtagtgatgcttgttcctatattcgagaacaaaaatgtatagctgatggagtgccatgttcttgaatgtctcactgataatccagctagggaacagtgctttcattttcatgcaccccttgtggttccaaatccattggtagtagaatttattttcatgaacgtactgttttacggacccttcgtttcgcttattccccgaataagcgaaacggcatatttgcaaacgaaaaataattatgaataaaacttttatatacatgttcttagcgatctaaaagcaaaggctgaaaaataaacttcgatgaaaaaacccccaaaatcaactccaaatttaaggtcgaaaattcaaatttttgctgataagcataagcataagcgaaaagatgaggcctttacttttatgacgatttaacattgtatactactatcagtggaatgttgtgttttgaactttttatatattctagttttcagtataacacatgttcgatgttgtgtctgaaatcaatgtgttggttactttggcaggcatttctggtcactgtccgtaataagaagagagtaggctatacttatgagctgggcttaaaatttaaaggtaaacaacctttagttctggagttcacatcttcacatgagctatctcctgctgaaaattggcactcatgggagtattcttcaggtgaatggttaattaaggaagaaaacaagaaggtgaaaggctatctggacattccagaattttcatttggtgaacttgaagacttagaggtacattattgctttccataataatattagtagtattcttttcctgagcaacttcgaatgtgcccttttaaaacgatgaatctgaagatgatatcatctatggaaatgaacattttgcctatgttctgtcagagttcaaatggtaccttttgcttattcctttcaggtgcaaataagttttaccgacatcaaggacctctcgtccgacaacaaggcacaaatcagcaaggatttgaagtcgtttcttgcaccgatccgggagaaactgcgcaagtttgaagaagagctcaaggatagatagcaaagctgcaaacttggttggaagcatcacgtatcaaaagatgatggcttaatctatagccatttcacgtatcaaaagactgcttcagacgtttactgctaaaagtttgttccaatacttgctgcaatatgcaccgtgtttgtttcattgccgatacattcatacttgtgccactgttgaacttacaagaccaattgagcagaaattttctgaagctatattcctgtcagttctgtagtttgtattcaggtagccaggcccatgggccacaactcgaaacaggtttcggcccaatcggcttgtatatctgattcagtagcactgtggcaattcaccaatcagaactcagaaattcagaactgaacagtttgttttccatatgaaggagagttgcaaaggtccaaatacagcaatgaaaaaaagaagtataacaacgtagtatcggattggaaacaatctgatactacaaatttatgtataggcataaaggtctaatccagatctatactacaacttgtatactacaaatttagagacagagatgagctgaagtgaggtgagctcagcagcaatggcgagaggaagaaatggttggctcagagtggccaactcgtcgctttctccctctcggttgaagcagatgcaagttgaatgcggtagtatttgattctgttgcactgtgtgcgactgtgtcgcgctctgtccatgacgtcctgcagctccacttgcacgtgaaggaggacccatctccaaaagagaagggacccaggtagttttactgaatcactgccgatgtacttctaacattccagtaaaactttgaatcgttgccgatgtacttctaacatttaggcccgttcttttctttaactctgaatttaaacttcctcttttttattagcacgttttttttaactgttaagagatgtattttttttcaaaaaaagttttatataaaagttgtttaaaaaataaaataaatctattttttaaatttataatcattactacttaattaattatatgctgatgagttttctcattttgcgtacaactaaggccttgtttagtta

SEQ ID NO: 75946 - DNA, 587 bp, Oryza sativa
aatttttgctaccagtacgtctactggtctcttgacaagcgaattgaattaaattaaaatgggacaggaagccatgttgttcttggcaaatcaaattgttcttgacaagcgaattgaattaaattgaattgatgtagttttgacccaatgggccttctatcttaggccctgcatcatctatccaacccctatataatagcaaggaaaaggtccactttgactcccttaattgtacgccgaatctaattcgtacccctcaaccagaaaaccggatagaacgactccccgaactattgaaaccggtgcaatttgactccctcagcggtattggagggcggttttgctgacgtggcgctgacgtggcggtgttgacccggtcttagtcccacgtggcgcttaagtggcattagaattaaaaaaaatgtgggacccatatgtcattcacacacacaatatattgtgggatccattgacatgtggggggccacatgtcatcctttctctccaacccttcttcctcctccctctctctctcccttctttatcttttctctccctttttctcttccccatcggacggtagtacc

SEQ ID NO: 75947 - DNA, 15067 bp, Oryza sativa
ccacccccccccccccctaaaacccaccccgatccgcggccgctattaagccaaggccgcgcttccgccgctgcagccgatacgggagattggatcggaagcttctagaagtttccgtgggcgatggcgatccgcgcgaggtcctcctcctacgccgccgcggcggtcgcgctggcgctcgcgctggcgtccgtcgccgctgtcgccggcgaggtcttcttccaggagaagttcgaaggtgaatggctgacctgctcccgatcccgtctcgatcgatctgatccggttcgctgcgcgttgcgggtctcggctttggatgtagtggaggcgtcgcgtgggggtgtttggtggtgggtttgtttggatctctggggttttcgggatttctctggggtttatacgactaggaggcgtgctggttgttagggatctggagtgttaggcgctaaattgggtgctgatcgtggtttgtctcgccatttttggatggttgctgctgcggtatggtgggatctgattgatctgacgtgcatttgctcgtgggaatgggatctagttgcgtcgtctagtaagcgtgcgctgtgacgctgtgtcgatctgctttatgtgaattggttatggttttttgttagattgtgggaaaaaaaacgtggttgggttgattcggatcgaaaaatgttaggtttgtttggtatatgatccgcaggtttggatacttcattgtagggagtagttggtattctgctgtataatgtggtgaattttactttactttatactgcgaaatgggaaaatttagagcccagacttggtgatgttttgtgattgaaccttatgctttatgtatgttgtttaattctgatgtttcatatgtttaacctgaatatgaataaatgtttaagatctgcctatgctagtgctacatttgaagcatactagtgagaattggcagcttatgatggttgtcacctgtccgtgtccattagaatgtgatttgccacttatctgcatatgggatatggcattatgaaccaggtgcattttacacttcaggttttggcgtatagtttattagttctatacggtatgtctggagatccataattcgaatgtgttgatctgtattgctaatgtcgcctgttaaaattttgtctgtactactatttaaggaaatctccgggcagataatgaatttgcgtgatcatttgctggttctgcacatgatgcactgaacatggagttctgtgttatctaaatgtattctattgtgtgcacagatggatgggaaagtcggtgggtcaagtcagaatggaagaaggatgagaacatggctggtgaatggaaccacacatctgggaagtggaatggagatcctgaggacaaaggtaaattggaagatcaatacacctcattcagacactaacagatgatttttactgaattatttttcttgttgcaggtatccaaacctctgaggactacaggttctacgctatttcagcggagtacccagaattcagcaacaaggataaaaccctggtgctgcagttctctgtaaagcatgagcaaaagcttgactgtggtggtggatatgtcaagttgcttggtggtgatgttgaccagaagaaatttggtggggacacaccgtacaggtaatgattttcttctattgtagctctgattctcacttttctcaagattagtactagttatctaacttggtacttttgaatgcagcattatgtttggaccagacatctgtgggtacagcaccaagaaggtccatactatctttactaagaatgacaagaaccatttgatcaagaaggatgtcccctgcgagactgatcagctgtcccatgtgtacactttgatcatccatcctgatgctacatacaccatacttattgacaatgttgagaagcaatctggcagcatctacgagcactgggatattctgcctccgaagcaaatcaaggacccagaagctaagaaggtattttgcatattcctagctttcttggaatgccttgcttttgtgtctcttgaatgttaagatattaccttatgattacagccagaggactgggatgacaaggagtacattcctgaccctgaggacaagaagcctgaggtacttttcctttgttctgacttccgatatatcttgtaaaaatgactaacttcgtatcttgcatgaatgagaaacgggaaccttagctgacctgaattagaaaagttcacactatattgtactcttgtaatactatatgtcttaatagatttaaacgtgatgctagaaactaggaagaagctacatgtttttgttgtgtaatgacttgtggtatgctgtttccagggatacgatgatattcccaaggaaatccctgaccctgatgctaagaaggtacttaattgttataccattttatggtttatgttatatatgatgagcgtcattctaggttttaaaatttctttgatgtgatttctgtagcctgaggactgggatgatgaggaagatggtgagtggactgcaccaaccattcctaaccctgagtacaagggaccatggaagcaaaaggtgtgaatatctgtttactgatgcagatgcacttgaaacacttgcatatttctggtttctgacataaacatgtttctttttccagaaaatcaagaaccctaactaccaaggcaaatggaaggcaccgatgatcgacaacccaggtataattgcctttaattgaacaacttggtattacacatttttcagatgttgaactctgcattctgaactgtttcctttgtggttcacagacttcaaggatgatccatacatctatgcttttgacagcctgaagtacattggcattgagttgtggcaggttagttaagcaaagtacagtacgcctttagttctgatttattttgctgggtcaggaagacagacataaatagttatgaacttatcccttctctcttctatcaacaggtcaaatcaggtactctgtttgacaacttccttattactgacgaccctgagttggccaagacattcgcagaggagacatggggcaagcacaaggatgtatgtcgttcttcacctagcttttaccgtgtaatagtttcgttatcgacccaacattctctaacattagtgaatcttgtaggctgagaaggctgcttttgacgaggcagagaaaaagaaggaagaggaggtaaattccttcaccttacaatgttctaatatgaggatgatggatgtacaactgtccttgtcattgcatttcagtctgtgctccatttcactgtctttgctatacgttttgatttttgttggcatgaacaccagttccttgatgatcagtgggccattgcttccacttaattatactatggtgtgatcaaaaccttttaactcactggcatggttctgttatttgtagttttacgtattatcttctgattgttacaccagcatagctttaagcaactgaaatattctcctttgctgaactgccatcactcgtggttattgtggatgtaatttgcttaccattgattatcaatgtccttgttaacaggaagctgccaaggccggtgaggacgatgatgatttggatgtaagatttgcatccgttcttcctccatgttctatattttccttttgggcttgatctaaacctcaacaacatttatatttcacaggacgaggatgctgaggatgaggacaaggccgatgagaaggctgactctgatgcagaggatggcaaggattctgatgatgagaagcatgtatgtaacactcctgcgttttcttgataccttctggattctggtgatgcatttcctgttaacctccatgtgtcctgatcaccgtccttcctttccaggatgagctctaagatggtgaggatgaagaatggaggccgccttcgcgacgatgccaggatttgctagttctcccattgttatgaagttccctttttcgtgatcagaaacttgacaagaaagtactctgtagatgagcattgctgaggaactttaatttggtctttgtagctctctctgtagtgtcatttttcccaccacaagaaaaagaactgataacttattgaacaagagaaatcttttgcacaatcgctctgcatcctgctgtgattgtatatgtgcttgtgccatttcccattgttttgccatagggaaagcgtcttcagtcgttactcgttaggcacctggtcacctatggcatggagtcgaatcgatgagaaggccgagatagaaatgctgggcaagtttgcgttccaaacttccaatgccaagtctttctggttaatcaaagaaatccctcacattgcctgtttattgataccatcagaaatagtttgtttgcattccgctattgtggcaatattctcccacgaccgcaaataactaaatatgggttgatcaattgagcaagatccaaagcaatggtggaatatgcttgtccgaagagtggtattgctttttttgaaaaccaagggggttaaccacaaaattagccaaaacaacctaatggggatataaagttaactgatactccatccgtttcacaatgtaagtcattctagtattttccacatttatatattgatgctaatgaatctatccacatttatatattgatgctaatgaatctagacctttaaaatgtaagtcattctagtatttctcacattcatattgatgctaatgaatctaggtctagaatgacttacattgtgaaacgaagggagtaggagataagattagggcagacagcgcttggatcaggcttgtagttcgtcggtacatgatatcgctatatccgcatatatttagtccttaactagtgcatagtattttaattatatcaaaattattcgtatttactgagttttttatttagtgtttcttattatactaattatgattaaatagtaaatttaaaattattaatatgatataaatgagatataacaactagtgcttagtattttaattatatcaaaattattagtatttaatgagtttttttggttatttagtgtttattatttatactaatatatgataaaatagtagatttaaattattaatatgatatgagatatagctcgttgacgagattgctatctcgttaagataatgagcttaaacgagtcttagccttaacaacccgagctagctctttatccatctcggataagatacctactagttaggtcataacctcagtggcttagagtaagtgttagtagctataccttttttgactgataatacttatcattttgtactatgacgaggttaattttaaaatctttgactataaatattttctaaagtatttattctaaaaatatagagaccatattaataaattggtcttaaaaggtacttcaataaaataatatatttgttgatatttctatatattataaataaaaagtggtcaatgttgcttttgagaccgtgtaattgttcaaaacgataagtattatcatcctgaagagagtaagggtttaacttttcgatttggaagtgaaaacgctcatcaccggtttaccaaaatttaaccgaaaaccattaaaaactgatgactttcggtcaaagccgtacgaaaaccggctaaggctgtgtttggcagcccctcttcccaacccatctccctcgtttttcgcgcgcacgcttttcaaactgctaaacggtgtattttttgtaaaaagtttctatacgaaagttgcttaaaaaatcaaattaatccatttttcaaaaaaaagcaaataattaatcacccgctaatcgctgctccgttttccgtgcgggcacttactgttgggaaccaggggttccgaacacaccctaataccgaccggttttcataaaccgagatctagcagtttcaccacagcccaccaatttttgtgaaattccatcagttacgtgatccctgaagagagtactaagtagagcataaataatgatgtgatgtcagcatctcatagtaaatgccacgttagattttataatgggttcaggagagagaaataggttagaatgaccgttgtttgagtaaatgccacattggatttacaatgtgtcaaattttacaactttttacatcctactccctccgtcccaataaaccctccgtcccaataaaaaataaatctagagtgtatgttggtttttttatagaacggaggaagtatgttttattttggatcactctttaaccaggccgagccgacccatcagctggcctagcaggccgaggcaaactaacctcgccccgcgctctgcaactgcaaaggattattttctgctttcgtgttcactgaatttctgctggtctaatgaccaccactttatgcacatctcaaatgaaaattgaagctccttccaaatcagcatcaccatcgtataccctttttataaaaaagaaaaatcataaatgtttcagaactacgcttatgcactgcctcgagatttcgccttgacctcctcgtgctcggcaacacaagaacaaaacaccccacactgcacagcagctcttgagccatcaaggttgacaaaaacacgcatgctgcatactaaccacatcacgatgaaaatcagaggaacaccaaatcgttttccagtacatgataacacttgtaatagctgtgatgttcgacaatgatcaaaacaaagcccaaagatatacagaaacaaataggtacaacaatcagaaaagcgttgcattctaaatcacaacccatccaaagtagaaatgcagctgatgtaaagatactaagtactaaacaataggtgattgaatgttctgttggtttgcttgcaaaaaaaagaataggtatggcagaatcttatcaaaatgtgaatatgccaaaaaactgaagccgtcacacaatcttcctactgctcagccttcttcacctcttccgatgactcgggttttgttggctcaaccttcatcacctcttcccattgcccatctgatgcttgcttccacagagttatgttgttctcaccagcagctacagataatatgtttccagtcaaggaccaggaaaccctccaaacaggggacccgaagtcgtgcatgacctttccctcccacttatcaccaactttccctctactccaaatgacaaccttcccatcttgagaagcgctggcgatggtcgccttagctaagcccaacactggtgcccatgcaacatctctcacacagtctgtgtgaacatctgaaggaagagcactctccagtttccagccaccattgacaaatccccagaccttaacaactgagtcaaaaccaccagagacaagcttataaacaagctctcctgaaccagccagagaaccaagtgctgttgctggagcccaggagattgctgtcacaccaacagggtgagctcgctcaatccttgcagtgtcccatcccccatcagctcgcatagtcatgacagaaatggttccatcagaagacccacaggcgagacaaagaccaacctcatatggggcccaagcaatggagttgacagaggacttgtggtcagtaaatacatgggcttgagaccagtggcctccagcaccctccttccaaatgatcacacgcccatcatagctgcaggatgcgaggatagtaccatacttaggatgggcccatgcgacacgccacacagggccatagtgcccgctgagtgttgcaaggagctgggatggggcagatttgccgcctatgctggagatcttgacagtggagtctgaggaggcagttgcaaggcgcttgccatagtagtcgatagctgaatcatggaccatgtccttgtggtccaactctattttcttcgatgacatggttcaaagctgtagtgtgccacaacctctaagtcctccacaattctgcacatgattaaataaaagtttcagcaccaattcatgggcatagcagcctaaatttgcgaaactagataatagaatcccacccgaagtgccctaaacggttaacaaggaccaagaaatagtcacctcacaaacttaatattaacaatctaaacaccattttttgtcatactcccaaagagacagaagggggatgcaatagaacaatgctggtgtatcatcgcctcataaaatcaaccatggaattaaacacaacgagactgtaaataagtatgtagacgaggctcaagggtcaccattggcaaatggtactaattcacaaactttgttagacttgtggcaaaccactatagtaaatgttggtggcttcaaaataataacagaaccacttacatgctaacctcatgaatgagtataacaaggcattggattaattcgatgaattgacttaacaggatgtaacaatttcacagctcaaaacacgttcaaacatggatttgaattcctcaggcatgagaagaacagaagtttcgatagactataatctaaaaaatgaaaacaaaattaattatacccctcattatttcacagctcccaaatctatacaattctgattcttctctatcatgtcaaaaaataaaagaaagatagctgatctggtgtgacctacacccattccctcattccacgagatcttgcgccccccagagggcggatccaacttgggacatgggggttcagttgaacccccaaacttttgggtgaacaaagaaactgttacttgtattaaggttaaggctctgaaattaagagaagagctccttccagatctagaagagaagctagggtaaacgaacggaacgcaagcgaattccagacaaaagtagtcccggtgggagagagatgaatcagaaagaggatgtggatgctcaccaggatcccctcccctgccctgctctgctcgccggatggagatcggcgcccctcccctgttcagccgcgactcgtcttggcgcaaggagcggaggagacgggagattttcttttttgacgcctaagggaaggggaagatactcgagttaagacgtggcagttactgggaatatttaactattagccactttttagacgtggcaattaaggatttgacactaaaatactaaggctgagttcgtatgggggagatgggtacccaacttctgcgtacggaaaacggagcagtccattaacgcgtgattaattaagtattagctattttttttcaaaaagggattaatttgatttttttaagcaacttttgtatagaaactttttacaaaaaatgcaccgtttagcagtttgaaaagcgtgcacgcggaaaacgaggggaagaggatgggaaaaggtgcatgcgaacacagcctaagtgtgtgtttagttcagcgtaaattttgtattttggttaaaattagagatgatgtgactgaaaagttgtgtatgtatgacatattgatgtgatggaaaaggactaaagtttggatctaaacacagcataaacccatatatcgcagatagagaagggtatagactatgagtggtaaatagttaaatgctatattttaaaagtgacgaatagtcaaatatcctgaattagatggatgaaaacagttcggaaatggaaagcgtccgtccgaattttttcgaaaataaattcggaatttttttctcagaaacggaaacaaatatgatgatgctactatccgtcgaaaacgaatttgtggacttttcgaaaacaaattcagaattttcttttctcggaatcggaaacgaaatatttctcatatacagctgattatcttcagacttttctactccaaatatttagatttatactatgtgccatagtacttataattggagttatggatgaatatagttatttttctccaagaaattaaactgtataactagttgtgttattattaattgataaaaattagaaatattgatttattgttttacaaaagatattgaggtatatctcttcatcgatttgagaagtttagcttaaggggtttttatattctaataaatatcattaccgtattagcttcgattcgtattcgctccatttttatattcaataatattctattcctttttttttgtatctgtggttttcgatttcgaaaagaatatggaagcggaaactataaaagtggtttccgaaccgtttccatccaatcgagtactctacctttatatctttttcttactactttaaaactagctttatctttatgatgactagtggcccacagatcagcagtactcagagaaaaaagtacaacaaactccgttggggattgtgttgacagcaacctcatcagaccactagcaaccactagctgatgcttcacgaatgtcacaccctgaagttcttcccctaagcctaaatggaattaataattggtctcgagaaaatacctgtgtaaaagcaagagtgaaaccctaattaattaatgtaaataataatcggaattggcatgtggaatttttcttgagttctacatgtcgaaatatgctaacaagatttttagtggaattttcagaactctagggataattttaaccaattaaaaatgagcataagcattatttaaatccctggaaattcttttccctttttctttttccctttttcccctccttttttcctaatgggccgccggcccatttcctcctccctcccgtaccgtgctgagccggccgaaggccacggcccagctgagccgcgcctcctccctcctcccgtcgggtcgccgacaggtggggcccacctgtcgggcccgtccccaacctccggccacccgccgtccgcagccgccacctcgcaaccgcccgcgccagccttccccgcgccacgtcggccacgcccgcgtgtgcgcccgcctttcccgtgcccctcaactccctctcccgctcgcccgcgcccccgagatggccgggatccgcctctctctccacctccacctccccatgtcggccggcgaaatcgggccgctcccggccacgtccgagccccctctcccctatttaagcatcaccgctctcctctctctctttttctccatttcgccgagctcccccgtgccctccactgccctagcgccgttgccctcctctccgccgccgccgccgccgctccggtcgccgctagccgctgcgccaagccgcgccatcgccgccgtcgggttcacgagcccgggggccatgccgtccacccctccgccgccaatttcgacatcttggtacatcttggtacatttttctttgagatcttagtacatcttggtactgcctggatgaatggagtactgagtctgatgagcctcggtgagtatcagatctttcagctctttgtcatcaggtacgcacaatctttctcccaaccagattgtgccgtgctcatcttcaaggaaatcctgggattttccaaccctcatattctttttcagctctgctatttcaggatcatttacctgagctgctcggacttggtccacgagcgtaggccgtgcctctagggcagccatgtacccgtgttctacaattcccaagttgagatgttcaagttcctgctacaattctttacacatgtcttcggtgcacgaagcgttgcagtagcttttcctgcttaaggcatctgccaccacattggctttgcctggatggtagtgaatgctcatatcataatctttgattagctccaaccatcttcgctgacggagatttagatcaggttgggtgaagatatatttcaaactcttgtgatccgtatagacttcgcagcggttgccaatcagatagtgcctccagattttcaaagcgtgaaccaccgctgccaattccaggtcatgtgttggatagtttccttcatgtggacacaactgtcgcgaggcataagcgaccactctgccttcttgcattaagacacatccaagcccgtgacgggacgcgtcacaataaacctggaagtctttcgtctgatcgggcagaatcagaactggagcagacaccaatttcttcttgagctcctcaaaactcttatcatactcggctgtccatttgaatttctcatctttcttaagcaactgagtcataggtctggcgatcctggagaaattttcaatgaaccgacggtaataacccacaagtccaaggaaactccgaatctgtgacactgtcttaggtggggtccacttggtaaccgactccacattcgatggatcaactgccacaccctgagctgtaatgacgtggcccaagaatttaacctctgataaccaaaagtcgcatttgctaaacttggcataaagctagtgctcttgcaacttctcgagtaccagacgaagatgtcgttcatgctcttcttccgacttggaatagataagaatgtcgtcaatgaataccatgacaaacttatacagaaattccatgaacactttgttcatcaggttcatgaagaatgcaggtgcattggtgagtccaaaagacatatccgtgcactcatacaacccataccgagtggtgaaggctgtcttgggaatatcctcttcccgaattctcaactggtgatagcctgatcgcaggtctattttggaaaacaccttggctccttttggctgatcaaacagatcatcaatctgtggcaaaggatatttgttcttgatggtgacctcattgagtgcgcgataatcgacacacattctcttcgtcttgtccttcttctccacaaaaatgactggagcatcccaaggtgaagtactcggtcgaatgtaccctttctgcagctactcatcaacctgcttcttgacctctgctagctcgttggctgccatcttgtacggtctcttgtaaattggagcagttcccggtgccaaatcaatgcggaattcgatctctcccttgggtggcatggtagtgaggtcttcggggaacacttctggatactcgcagatgatgggaatatcttccaatttcctcgaactcttctcctcggtgaccaccggaatttccacctcaatctgattcaaggaaacccccagctttggtggggctggagatttgtacaccactgtttctcccttctcattgatcaaggtgaccgtgcggttcgcacaatcaatgacgcccttgaacttggtcaaccaatccatcccaagaatgacatctaggtctttggattcgagaaggatgaggttggctagaaatggtgatctttggatttctattgttacagaaggcctgaattgaaccgaggtggagctatttgtggggctgtgtcttgtgggtacagttgtacatctctgattagagtagaactattcgaatagccgtgcccgcggttatgggcggtcaaccagattcaccgtgattagtctcaccctagtttagtctaatggaattgattagttcaggtagatggttgggcctattgcaacgtggagtagcgttggacagtggatggttaacattgattaattattacaaatgttttactgctttcaactattgtttataactgctcgctttatgcaaatgtaccgctctacctatcctttggttatatcctgcatcataccccctgttccggtatgacttgctgagtacggtggttgtactcagtcttgctctacttttccccaaccccagagtttgagtatgcgtcagatggtggcttttctgaggagtaggcttcgtccgtgccgttaaggatgcctgtggagtggtgttcccgctgcagtcccagtcaaggattagctccagttatcttttattttccaatgcatttatgtaagacttttataatgtttgtaagacgtggatctgtatgtcaactttgtcgcttgtgtaccccggccggtcctggacaggggttttaatgcacattctgcttggaattctactcgggaatttctgggcgtgacaacgcaccgccaccactgctctttctctttgagccaccatcgttcctcatctccacctttgcatgcgcagccgcaccctctagtcactgacatgactttcctcctcccccgtcatcatgcacactattgtcgtggtcatcattgaggtcaggggtgttgggcttacagggattcagaggggcagccatgcaggagttgacccgacaaagagcagagacactagatccgagctcctccttggtggatctgacggtttcccaacggtcaaagggaaaaagaaaaaggagaaagggaattagtgtgcgaaatggctgtagagtcaccgaacttggagatggatagaatagggtggtctaaattgaaatgtaaagtttgatgttgtgtaaatgaaaagaatggttaattgatgatataatatgaaaacttttaaaaatacatagtacaaactacccgatagtctcgtgatatgctaagcccagtacagttttatcgtctctgcacattatggttgggttggtgtatttagctattactaataatctcataatatattgatacatgacgatacgaacttctactaacatgagttgattaattatggttagatagatctggctaaaaaaagataaaaataataccaacaattttgcccaatagtaaagcattcgattgtggtcttcttttctcattgcatgattgttgacggtcgttagcgactagtttcgaccatcaatactacccaaataaaggagaactagtcatgcttgcaatgcatatttatgttcaataataaaatattccactagcactaggattactaacctcttgcagagaatggccataaaatagaggataatcgacatcaaaacaggcgatcaatcaatcggacgatgttgagaatcagacttatcaatgaatgggccaagaaagcaaaaatgacacgaccaattggaccaaaatttacaagtctgcatttgggagcaaaagaggaggccacctgccgaaattgggccaggccggaccagcccatggttcggccaaatccaccgcagctccgttcgatccaggttttggttggacggctgggattgatccccaatgatggttggagggtactaccgacctttccaaccgtcattaccagcctatataaacccttcactctc

SEQ ID NO: 75948 - DNA, 1701 bp, Oryza sativa
tgcgatggtattctcttgcggaggacagatcgactttgcagccttcaacttggcagtatgagctttgtgtgctctgctgagacaccttcatcttcttgaccacagtagatggacaagtcacacctgaagctgcagaggagctcttgacattctgccctccacaaacattttcaaagtaagttctcttccctaacttgagtcctattaccggctcaccatggctaactgccacagctggagaagtgcccgagtcttcaactctaccggcctcgccatccttgcacatgttcttgccatgccctttgacagaagcaaacctgaactctaagctgttccccagcttggatgaggaatcgaacgacgctgacaaggagctcttcgatgaaccattggctagctccgagctagaagtgaacgtgccaccggatgaattggtggatccatgatttgcggccgcgacaactacacctcttggttcagggtgaggtatgctcttgggattttccattgtattcggaccgaaaggcgctggattttcccagtcccaaaacacagggctcttctgattccagttcatcccaaaagaagccatggctgaattaaggatctcaactgctgctgctcacacttgtatatattgcaaatctgataggatttcaagaaacaagaaggaacagaaagaacacacgtcacaacaaattgcagaacttggatgagaaaggcaataaacatatctcgggtaccaaaatcattttgtctttcagataaaaagacaagtacaacataccatccaaaatgaattatacgcgctttattgtggggatcatagcaagagaagaaaggcgaaaacgatcaattacctcaactttcctttctcccagaaaagaaacacagtggatccttcctctccctgcaaatcttgccctcaatcagcatgaccatgcatagcacaaccttgagcataaatcaaaccgatccgaggaggtgatgaataacaagtagcagcgttgaaagttgaaaccaattggctggcagaactaaagcaacagagactccattgttgttcttggctgagttctcactcacctcgacttgagagagatcctatcccacttgtttccccgacctaaaagacgacagcatcaaccccatcaaggctggcccccattcatcaccacaaccacccgctatttaaaccctttccaatctatcaccacaacaactaccccaagtcaatcagagctgcattatttgctccttgttaccgcacatgaaccagttgcttgttggggagcataaataaaccaaaccatatatgaaataaaaagcaaagaaactattttgaaggaagtaaaagaaagaacaataatacttgatgtgaaaccaagaatctcacctcctttagctgagagagaatcgttatccccgttgtattctacctggatgaaaacaatagccataagttttgtggcaaaagaagataggagaaagaaaagaaaaaacacaagaaaaagcaaaagcaccaagataaagaggacatgactcacaaagtatccaacacacacaagatggcaacctttccctcctaactagtatctcccaaaacctttcctgtgagcctgagagcctgagactgaacagtaacaagaggaggaggcagcaacaagaggagagtgaggcccagtggatggctgcctcctc

SEQ ID NO: 75949 - DNA, 19445 bp, Oryza sativa
cgacctcccccgcgcagagtccctcttcctcgccgcccccgcggccgagtgctcctcctccacctcgtcgtcgacgcccaccctggccaacctcgttctccgcgccgccgcgtcgtcccgcgcgccgccggaccggctggtggcactcttctcgcgcctcgtttcccgccacgggttccgccccaacgccttctccttctccacgctcctcgctgccctcgcggacgcgggcgccgcggcgctcccacacggccgcgctctccacgcccgcgcgctagcgtgcgggctagtgctgtccagtgggcacgtgctgaccagcctccttgatctttatgcggcggctgggcaactgggggaggcccggagggtgttcgacgaaatgcctggcaggaccgtggcagcatggaattgcatgcttgcggcgtatgttcggtgctgtgagatggacgccgcattgtggttcttcaatgagatgcctgggagagactctgtggcgtggacaacgatgattgctggttgcgtgaatgccgggaaggcagcagaggcggttgagctgttctggaggatgaggaaggcaaatgcgaaggttgacgctgtgaccatggttgctttgcttacggcctgtgccgagcagggagacctgcggctcgggcggtgggtgcatgcccatgtcgagcaggaaggacgacagtggcggactgttttgctggacaatgcactcatcaatatgtatgtgaagtgtggggctgtggaggatgcgcaccgcttattcctggtgatgccaaggaggagtaccgtctcatggacgactatgatctcagggcttgcgatccatggccgcgccgaggaggcactagacttgtttcacagaatgcaggagcgtcctgatggtgctactctgcttgcagtgttgttggcatgcagcaatgcagggagggttgatgatggacgacaatactttcagagtatggaaagattttacgggatcactccagggatacagcactacggctgcatggttgacatgctctgccacgggaagcaattgcgtgaagcaattgagtttgtggagacaatgcatttgcagcctaatgatgctgtgttgggcgcactacttagcggatgcaagagggaaggcaatcttgagctcgcagcacaagtgattgaaaggttgattaggctgcagccagagcgagcagctgggcaccttgtcctgctggctaacatgtatgctggtgttggacaatgggagcaggctgggaaggtaagagaaagagtagctgccctgaatgctggaaaacctgcagggacaagcagggtgaatccgaaccaatccagcatgttggtacatagcatgctggcatgagcccaattgattctgcagtttcgttaacaagacttcggaggaatctatgagtaagcatgggagcttgaagagaaatggcaagcacaaaattatttggtgttctcgtgaatgccttgggaaaaaaaaaaaaggttgagctggggcaaaagtatagcatgcattcctgatcttctggtgaagccatgaaattatgcagtagtgttgcttcttttcaggttagcatattatatgttcttacttacccttaattgtccgagaatcctctttttactgaacttatagctaaactgctaggaacatgtatatttcagtaaattatcgctcagaacttctgataatgagatgctttctttttgaatcccttgtttcatcttattaatcttgtgctcaaaactatttatgacaactcaggacattgtcataatggaataccaaaataaagtaatagcagaatacatacacaagctgatctaatgcatctcattcttgtctatatccttcctaggagatgcaaatcactattctgttccaagttaaaaaatgcttgaatcttctcttctgtctgaacctatgctgtaaattgttcttaatgtcgacaaattgatgtttgctaaattcctttgtctggcctcccgagtaactgaagtcaactacttttgatactagcagttcctcatatcactcaagaagcttgttacatgtaccgatgccaagcgcagcggcgagatgccatgcagcatggatatagggagtctctgggaagcaatcatcagcgatgaacagcgcgcctcctaacagagacgacatcttgtgcaggttatgtgccattctgagctctggttcaattgatgctctttttgcaaaggaaacctggcacatagaaaatgctagatctttagagaagtctagatttatgcagcaaatatgcctagtgatcgttgaaatgatgattggttttatttagccaatatgccatgccattaatattacttgcctccatcattccagtgtgaacaactgaaaccatcaaaggctgaaatggtaggagcaatgctgatgctgccattagtaatcgcgggttctcattccgaagtgctcttgataaacactgcacaaaacacaggcttgtcacaatggcatgatttgcatcagtcagataatgtaacaacaattatccatcaggtcacgaaaacttactacatccgtctcataatataagggattttgctcgtacaactacatgcatgggcaaaatgccttatatttgggatagaggtaatattgttttggcatgccttaagtcaaacatttgaaactttaaacatgcatatctctttatatatgtttagattggatcataaaaaatgtatgtagagattcattacggaaagcactttcataatattatgataattgtttgttgtaatagatatattgttatagaatatagtggttaacattgtatgttcaaaacaacatttttttgtgaacagagagtactagagtactccatccgtctcatattataagtcgtttgactttttttcaagtttgactaaattcatagaaaaatatagtactattttcaacacataacaaacatattgtcaaattatattcaatgctatatttaatgaaactaatttcatattttaaatgttgttaaaattttctattagctcggtgaaacttaataaagtttgatgcggaaaaaagtcaaatgacttataatatgaaacggtgggagtaataagtaataccgacgatatgacttaccaatgtagtggtggctatcatagtatagtctgcccaccgcaggagttttctgatttctcccttggaggaatggtacaagcttgaagctatccctactccgactagcgaattcgcatagagcgccgtgtttaagttcgtcctgcaaagctggtagcagccccgttagacgggaagcatagaatctaaaccaaaaagaaccagaaattagctagagtagctcgccttggcgtttgcattccgagaataatgaaggggagcgaggtgactacattagctatagtttcaccagcatgcttgtcacctgctcgcaggaaaattcagttagaaactgtatactgagaagagctatgttggtgcagctataacttggatgctttaccgcatgagattctacaatggacgggcttcaagaacgagggcctgtgctgccacaatcgcctgcagtttgcaacaacggtatatgaacgtcagactcagcaaaccaaagggtataaatttttagagagcttttctactgacggcatgttcacttcttatgccagttattttttgacgaaggccatgtttagtgcatctccaactacccctaactttcaaccttccatcacatcacatctaaaactttcctacacacataaacttctaacttttttttccgaactttcaactttcccaaaacttctaacttttttcatgaactaaacacagccgaaatggaattacctaatcggcaatctctgcagcgttgtgccgtccccgaacttggcttcagaatcagagattgccgagtactccacgacggtcgtcctgacagcctcctcctcctcctcgccgccgccgccgtcgcccggcgacggccgacggccaagctgcaccccgtagagcccatccagaactccgggagacggcttgacccccatcaatcaacgtacccgtgtggcgagcacagtttcacagcttgcagaacgagcaagatcagggttggccccctcctgctttgctttggctagcttcttcctcctctccggccgatgcggtgcagcagccgcggctagccggcgggaggaaataaatagtgcgcgtgtttgcgcgaagggggaaggaaaatgtggaatgggatggagagacccgtgtcgcggtgctgggttgaattctctcggcagtgcgcgagacgccaagagaacgggaggcgagacgatgctgattcccaccggatcttccgttggcgagtcccccgcgggctgcagcagccgggaatattctcgcccgcaaccgcggcatccatcgtcccgcgaccagggtgatgggctgatgatgaatgagcccggcccacccaaacttcgggcctgttcagattgatgtcattttaaaccataccattaatttggtaaaattaataattatgtagttacattgagagcttgtttggtttgatattaacttattgccctaccaaattcttggtaacttcaataatagcaaatgcatgtttggtcttgtcacaatagttcaaattcaacactacttaatttggtagtgtcaaagcttgccacggttttggcactatcaagattttggtagagtaaaaattagtttcaaactaaacaagcctttaactagttattaaatattggtgatgtaaataaaatttcgacgatagcctatcatttttagtattactactaaattttagaaatgttcattttttaccaatgaccttcaggaaacgaagccgggaacgagatttgtcgagagagagagaagggagaggcatctggtatgtcgctcgtcacgtcgtgccgggagacggggagacctggagctgacactgggctttggctttggctcggccatggccggcagagtagtagccgcatcggtaattgtttccgctgcttggggcagcgtagcgtcgcagagagtcgtagctgcacggagagacaagacggacacgcgcgcgatccgattcgattcgaagcatcaaccaacctggcaaaggtcgcgtctctctatcgcctcgatccgtgcctgcgttgcgtccagattggccgttgttcctcggtccgtgtttcagcttgcgtggccgactttgtcaggcgagcggcacggcagctagaccacaacgccgcgccatgggaatccttgtgaagggaagatgatttcctcgcttgtttcgtctttaaggttattgcccgcgcaagtttcatacgagcaagttttataatagggatagcgataacatctaattttatttaaattattattaatttagaactaacacatacaacaggttgccgacttcatcttttcgtttatacttatgtttatgtttatgagccaaagtttgaattttcaatcttaaatttggagttgattttagggttttctcatcgaagtttatttttcagcctttgcttttagatcactaagaacacatatataaacgttctattcacaaattatttttcgtttataaatataccgttttgcttattccctaaataagcgaaatgatagggccatgcatctatctacactactcccaatacactctggctgtgtttagttcacaccaaaattggaagtttggttaaaatttaaacgatgtgatggaaaagctaaaagtttgtgtgtgtaggaaagttttgatatgataaaaaaattaaaagtttgaagaattattttggaactaaacacgtcgtctgtaccaatccacttctctctctcattccttaaagattggatagagattgacctttgcacgagagaagttgctcattctttttccttttcttttctctcttgcacattatcttatggatctacatggtaccttggggctagtgataaggggcttagagcaggtacaaatgtggactataagccagctataaacatatatcgagaagataaaaaaagagagagatgagcaatgggctacagatttgtaccctggctttaagatacaatgtatgtatgacaggtgtgagcaaatactaatagtgtagtatatatttataggtaactattgtatcaattggctatagatgatttggagctattagttggactatactattaaacttgctcttagggtgtgtttagttcacgccaaaattataagtttggttgaaattggaacgatgtgatgaaaaagttgaaagtttgtgtgtgtagaaaagttttgatgtgatggaaaagttgaaagtttgaagaaaaaagtttagaactaaacaagggcttagagtagtgatttattattttttaaaaaatcagatcaaatttttcattgacccggctttgaaagaaagcccaaaacagcgaacagagtcttacacaggctgaaagtaaacagcaaaagcaaaacaaaagaacagacgccagtacaaagactggttctctctggaccactgctgcaaatcttacaaacacctcacagacttttcggcattgaccctcctaaacgcgaaacctttccccaagatattatcccacccgaaacaaaagcctacacaaactgaaaaacaacagcatcacactgaagcagggaggcagcacggcttcagccgttgaagtttagccatcagtagatcaccccatcctttcatagcagcttgatctccttcctttagcatgatacaccaccgctgaacaaaagacatagctttgtaagcaacttgtaagggagattttaccaaaatatttgagaacacccaatcattcctaactagccagatagcccagcacacactagcaaagaacatcacccacacaccctgaacattttcccctggttttagcctcaagcaatcccttatgtttgtaggactattagttagtcccaaagcgtctctcaccacacaccaagtaaacacagccagagggcacttaaaaagggcatgatcagtagactcaatcttgccacacaatttacagaattcatcccctccttgccatttccttttgatcagctgaagagcacaaggcaacctgcttagagtagtggcttataagtcaactataagagcagggtcaatagtaaagtagtcagttggctacaattatacctaacttatctatagctcactttgcaacctatacatacaatagttagttatattgttggtccttacacacttcacatcattattaaaaaaaaatgagagaattcacttagtacctttgaggttttccccacttctataatctactactgattttgttaagttgaacaatataccatcgtgttttcttgaacctctgcttcatgccatcaccgtcaaagagccgttagttggcatccttttgtgtatttaattttcttttagtgactaaaataacctttgacttgttgattgaaaacattagcacaccgtctaccccgacaaattgatctatccctgtctcccaaagttccagtgaggcggcgccgactccccatcgatgcaacgccgggactacccgacgcgccgccggccgctcggatgcccatcgacgcgcggccaggcgccaggctcgccatcgacgtgtggccgggcgtcgggctccccatcgacgcgggtgggcgtgggcggcggcggatgaagatgatgggtggtggtgggtgagctgcaggtcggtggcagcacggatgacaagggctagcgcggagaccatggcggaggcgttgtggtcggtgcgcgccgcgtagtagtactgcacgtacgtctccggcgccagagcgccaccgccgctgacgaccgcggcgagctcctcctcgtcctgctacttctgctttgctgctgctgctggtggtggtggcggcggtggcagaggcgcagctgtttgctgcgtcgacgaccacgggatcgagctgtggatcgatttgggctttggaggcagcgcgcggagacgatgaggattgaggacaacgtatgctgataagaacagccaagagagagaggagacgaggacaacgtatgctgtttttttttttgcattacgtacatttatttctactacatttatatagttcaatcagtttgacagtatatgcattcatatgtcgatagattacatacatatctccctggaaataaaatgtcagttaggggtaaataggtctttttatagcgctaacggatgcccaactaacggctcgtggacggcgatggcacgtagcagaggttcaagaaaacacgatgacatattattgaacttgataaagtcagtggtagattgtagaagtggaaaaaactcagtggtactgagtggattctctcttcaaaattgcagcattgatcccatgctgcaactgctgcaaagcagcatctctctcacgcccaacacttttgtctaaagaagcgtgctacaacccaacgataaaattatctcccgctcgcgcccactcacgttctctctcttcagctcttttctccatattagcattgcaatctacgtggacttggcgtcgtcgatattgtacctgctctaagcttatgtggaaaaaagatataaagaaaagtgaggagttggcacttagagcaagtttaggagtatagctgactactatctccaaatcatctatagctaatttaatagttcattcatataatagtttttttttcgaacggtcgatcgttgccaacgttttatataaagaaggtgccccattttaagggtaaaacggtgccaaaccttacattacgctcaattaattaggggaaactgagtgaaaaccacaactacaacaacccaccaactaacctaacctaagctaccacgacggagcccatcgtgagacatcggcaccaggcatgccatagaagcgacacggcaactcacatgtgttattgttaccgagcttgtcactagcgacacgacagttccaacttcaccttaaggaagcctcaacgccaaaaaaaaaaacaaaacaggttggactactcacaaaggacagcagcacaagctaccaaggagccgcttcctacacacggctagcactaacaacccaagatagagattgtagtgagtcatcgttgccaagcttcattgcaacccaacaacaaagcagctccgactttacccagcaaaaactaaaaagaaatgatggttactcgccgcaatgcaagaaaagaaaccaaagtggcgagggcctcatcaaacaccctaggcttgtagagtttcggagccgttgcaggaatccattaatgaccatcattgcacgcggttggtgttggaagagagtggtcagcatcataatgatgcctccaaggagaggaacgacgcctaatggcgtcgccgtcgtcaagccggcccaaggcccaagcaaggctttcgccaacgattcccaatcaaaaccccacacaaccatcttgtacaatgaccatcgccggaccaccgtgccatcccttcagtagggctgtcaaaaaaggtcgaggcttgcgagctgctcgagctcgacttgtcctaggctcgatttgagctcggctcaagctccagatgagccgagcccgagcctctcccaaatgtcacgagctttgtcgagctgagctcgaccttccaacgagcctactaatatataatttttgttgttacttaatttaaattagtagattaaatatgttatctgtatgccttgtattagcatcatatatttattttattcttttttcctcttctattaatatgatgaactagaaatagggatggcaatttcacccgcggggccgggtccctgcgggggtggggacaggtgaagatttcgccccgcgggtggtcggggtcggggccccggagttgggcgggtgcggggacgggggatgctttccacccgagggtgaccagcggggccccgatgagagtatatcacctcttaatgtacagctcattgcaagcacaagaagcccattgctgagatatataagcaaaaacctaaccctatcctctcactccccaatcctccacccggacaccacgcagccgccgcccgttgaggccgaaccacgcgcgacggcacgagtgcctcagtctccctctatcgccgcgtcgcttccgcctccgttcatcgaggggctgccaccacctccacctccgcttgtcgccgcaccgccaatgtctctgctctgcctctattcgtcgccgcatcgcctcctttcgtcgccacgctgccgctgtctccggaccacctccgctcgtctcggtccgtctccactcgtcgtcgcgccaccgccgtctccggtctgtctccactcgtcgccgtgccgccgctgtctcgctccgcctctgcctgtcgccacaccgatgcctcctgctgccgcacagcggcgcctcctcccgtcgcctcgccgactccggtcacctgcgggtgtagcgggtccccggtcgagtggcggggccccggaggggccggggacggggatcgatttcaacccgccctccacttcggggccggggccgggtggacccgcagaggagcgggggcagggctgttcctgcccaacccggccctgacccgccccgttgccatccctaactagaaattaattattttttaaaagattatccttgaaatatgcattgttttaattaaaaatcaagcttgatagtcgagctcgagcttgatcgagcacgaatcgaccctgtctgaaagctcgaacattttataggcttggctcgagctcagctcgttggcagccctaccctttagcgaccaagcccaacaccaccccgcagctcaagctggctcgatgggctgctcattagccagtgtcgccgccatcccctgcgcataagccaacgcctccccttttcctggagctccccacgatcaaacctgaaatggtcgggccatagaaggggaggagccctatgaagaagaggatggttggccagcaacaaagaaggcgacctccactgtctaactgcttccctaattattgccataagccatcgaggttatcactggcgaccggccaccaccgcaggcgacccgagctgccggccacggcctcacgccatgccggacatgccccgctggccatggacaagcgttgctcatctcgccgcctcgcacgccgacagctgcggtcgtggtcgccgttgccatcggttctccaaccagatctggtaggagacgccagatccggtgcaccctctctgcttgcatggaggccggctcctcgcgcgcgccgacagtcactgatgccctctctgaggctgccccgcaggcttttcctgtgccgcagcggctgccactgttgtggagggtcctgagcaggagagggaaggccccgccgctgttgtccttgtagccacacgtttttctggcggcgaggcgggggagggaggagtggtgggtggtgatggtggatgaaggtgtcgcccgtgcagcccaagcctagagcgacgcgggtgattggtccaagaccgtcattgtggtgggccgctattcatacaatagttacttataaatccattaatatatggttccacatatcatacacacgtaatgttttgcagttcatactgtagctgattataaatttgtagcccgcgattattctctcctctcttatctcttccatatatttttgtagctgccttgatgcttccgagacgctcaagcgaaacagtttgacagtcatctaccaaggatgaagacaagtacttacctgatcttgtcttgatgagttggacggaggagatggagcgttggatccccatcggacggctcatgtagcccaactccttcgttgccattagtgccataaagttgggactcacgcgactcccagcacaagctaaaacccaaaccaaacaaacccgtcgcatatccaaacagataaggtcgcgcgcgcgtgggccacctctgccgcgcaaaccaagcctctccatggacaccaccgcgtcatggagtctcctccccctggccgcctcctcgccgtcgcctagaaggaagtcggctcttctccggcgccacccagcggccaccaccacctcctccaccagcaagcggacgacaaggctcctctgcctcctccatgacacggtaacatccatctctcgaatctcccactactgcatgatagattttcctagacgccgcccctttttgtttccatgcggttcgtaagtggaaccgcatggaaaaatagggggacaggcaccgggttatcgtccgcacgggaaaacgcattatctcgtgcgggcggctttagccaactgcacacgaattttcgcccgcacgggacccaccgcttttaaccgcgcccactcgtcttcccctccacccgctcctctcctcccacctccctctctaccactcctctcctcccactctcctctcctctcctcttttccctctctcccggccagccggcggcgtgacagcatgcggcggcgcacggccccttcctccctctcgctcgacagcgggcgggaagaagggcggcgagagcaggcggcagcggccgaccatggcagcccctcccctccctcccattgcagatccggcggaggggaggcatgggggggcggatccggcggcgcgcccccccctcccctcattcccgttgcagatctagcggagggggctggcggatccggtggcgcgcggcccctcccctccctccccttaaagatccagtggaggggaggaatgggggcggcaaatccggcagcgcgtgccccctcccctccttccgcttcagatctggcggaggggggcggtgaatccggggacgcgcccccctcccctccttccccttgcaaatccggcagaggggaggcatgggggcccggcggagcggcggcatgcgtcagcggacggcgtggaggtggggtgacagcctcggcgaccggcggatctatctctccccctccttctctctttgttgtttgtgattctttatgatttgtgagatgcgttcttagagttgatttgttgctgtgagatgtgttcttatgatgtgagagttcatttgttgatgtgagatgtattcttgtgatgtgagatcattgtgtgtcgatgtgcgactacagatccagcgccggcgacgggagcgggcggcagatccgtagccggtgaccgcgagggcgacggcggcgggcctcggctaggtggtagaggcggattagggttagggttttttttctttttttttgattttttgtttttccgtgcgggcgacttaagctcccgcacgcgaaaatcacgattttctcagatgactgggtgcatgcgggctgctctcctgcacgcaaaaatagtttagcccatacgggataatcggtattgtagtagtgtccccgatcgatcgatcaggctgaggtggtttagggatggtaattttacccgcggggacccgcccctacgggggaggggacgggtgaagatttcgccccgcgggtggtcggggtcggggccccggagttgggcgggtgcggggacgggggatgctttccacccgcgggggacccgcggggccccgatgagggtatatcacctcttaatgtacagcccattgcaagcccaagaagcccattgctgagatatataagcaaaaacctaaccctatcctctctctccccaatcctccacccggacaccacgcagccgccgcccattgaggccgaaccacgcgcgacggcacgagcgcctcagtctccctctatcgctgcgttgcttccgcctccgctcgtcgacgggctgccaccacctccacctccgcttgtcgccgtatcatctccgcctccgttcgtcggcgcgcagctgccatcttcgctctgcctccacccatcgccgcaccgccgatgtctccgctctgcctctattcatcgccgcatcgcctcctgtcgtcgccgcgctgccgctgtctccggaccgcctccgctcgtctccggtccgtctccactcgtcgtcgcgccgctgccgtctccggtctgtctccactcgtcgccgcatcgacgcctcctgctgccgcacagcggcgcctcctcccgtcgcctcgctgactccgatcacctgcgggtgtagcgggtccccggtcgggtggcggggccccggaggggccggggacggggatcgatttcaacccgccctccactccggggctggggcctggtggacccgcagaggagcgggggcggggccgttccagcccaacccggccccaacccgccccgttgccatccctaaggtggttcgagcgcaagttcgtcgagacgtacctgcagttcatgttcacctactggctacctcttcttccccgggtgagttccctcttgctaccacgtatacttacaaagaaattattaaagaacaaaatgcggcaacttcgaatcgatcggtgaattgtgcagagtgccgagaccaatatactggtactgtaattacctttcaatccgagtctttattgagcatcaatgcagcaataataatcatctactagtgatctggtccatccctctgggcaaaaaagaaaaagaattatcttaaggtcttaaggagatagtaagacacactcctaaaatatacggtgtagaattttattgtaaaatttgacatctatgagtacttttcggaaggattataaactttctaaaaagaatgtagttttgttttgctaaggtgatcggagttaatatgcatgccactgccagattttgtttgtctgaaccaaataaccgtgaaactcaaaattgccatatatctcttgctgtgaatggcctaatctatactttctattagaagcaaaaactcaacatgcaagcatggcacatcatcacccactagcaattactattctaacccatttaaaatcccatggaagcataccacatcttcactcactagcaattactattctagcctattttaaatcccatgcaagtatgacacatcattgccaatctcactggaccgtattcttatcgaaacaaaatagcatttctttgtatggatttgtaaaacatgcatggtgccacaatcttcttggatgtatcgagcaaagtgagatctcacataaaagaaagggaaatgataatgatgcaatattattgtatactagcccaggcaccgaagcatatgttgtgcttgagaaaagattgctagataagttgcaggtgttggcaaaatctagtaactagagtagcagcctgtctttctgtttcacagttaaggcaccgttttctcatgatcatcttcaaaaatactttcatactagctttacacctaaattataagtgattaatataacgaacgtcccaatctttcattgtatactaattcgaaaaagagtagattgcagcttggtctagatcgagctttgacctttcacgtacttcgcacaatgtgatttggaattccaattggataaaaaccttgacctctaggagtgtgtaagggactgcaagtaaaagttctagatttagattcccatatgagtattttgcaattgaacgaagtggtaccagattacaggctgtcctgcccttagcagagttcacaattcgtttgaatttcatcacccaaaattctcccaaaactgcgttctcagcttcataaaatttgttagtctcgctggggctctcatttcaaccttaaaaacaagattgtaaaccctgtctattgtttacatattaaactgagggtgagtgaaaaaatatgccaaattatgggccaaaggcatgggccttgttgatttcactctggggatccttagcaaagatattgctttttgagttgggacattacccctccgtaggacatggcatatttgaggttcgctcattgctcaacaacttggcttgtaggcgtatcattggtttacccttgcccttgtcacctttggcttgttgatcgatggatcaaattgtgcttcaattatgacattgaggtttgaccttgatttagcttaaccctccctaatatagggttgtatagtactccctctgtcttctaatataagggattttggctttttcttgcactgtttgaccattcgtcttattcaaaaaaattgggaattattattttttttgacttactttattatccaaaagtattttaagcacaacttttcgtttttttatattgtacaaattttttgaataacacgagtggtcaaacagtgcaagcaaaatgtcaaaatcccttatattatgggacgaagggagtatggggcgaagtcttgtctccagcttaagttcatagtattattttagcatgttttttttttcatttctgtactaacaagataatatgcatcaaaataaattaccaaaattttctacacaattgggtaaatatgtaaccccccacccgggcgccgcctctaacaagttgctttggactttttaaagtccacattacataaatttggttacctaggtctttagtagtataaatttatgaagtaacgtgagtgcaatattataaaagctcttattacagtaaacttgaatataccatttttcatatagccaaaacctatattataaatacattttatggtcaaagttaacttttgttgactgctctaaaacaacctgtcttttttttactcgagaaagtaaactagtcaccaatctgtgcgtggcacatgcacgcacatgctattattgttgatattataaatattcaaattcgttgagcatattggttaactttgaaagtgtaattgcttgtaccaagacaagggtctacattagttacagctaactgttagtttccgattttagaattaaattagtaaaatactaaactgataatccaagctctaccatatttattaattactggtttccgaattatcaaattagagtaaatattattatttctaattgcatttatttgagatatacactccatgatgattttttaagataatataagcttttatctaactcaaccaattatatcaatatgacataatcgtacttaaaaaatcagagtataacctactatcataaataaatcaacggccaaaattcttttttaacatgtgagattctacaaagtgtctagttaatactccctccatctacttttgataaggcatatttccaaatctgaaaaatttacttttgataaacatatttcaatccaatcacctattctcttaatgactttcttagatttaatacgtggctctccattcttctatgcaagattggctacatggacatcgagaaatgtaaatattaatgaatcgcttgtttacaaggaataacgtactccctccgtcccaatatgtaacaacctagaatgggattagatccatcctagaactacaaatctgtacatagagtatttctagattctctattttcagattcgtagtcctaggattggtctaatctcattctaggttgctacatatttggacagagggagtagcatgtttaaatagatgataagtagaattacttattcttggtcattgtgccaagatgaaatataactatcaaaagtagatggatggagtacgtctttacaatcatactaactactcactccttcccaaattgatcatcatatatttatgcatcaagaccaaggataatttaaatcgcatcaatcaagacaacatgcactagcatgcacacattctcccatactgcattaattgtattataataaaatccgtgtccatgcggttatatgatgatcaatttggaaaattttaaatttcattgtatgatgatcaatttggaaagaagtaatatatactactatcttatcaatttatagctttatagctagactcgccacaaataaccggcacttgctatatccttccaattaatgtgataattttaccaatgaatatagatacacttttcttactactactttcaatttttaagatggtggaaatggagtactactttactggtcccttttaaccgagtaaaaagaatacttttgacgaacacaaatcatcgactagcttgttggtgccgtaactcatggatgcattcgcgggtctacctagcgcggtatgatcattgcagcacatgagccccctgaaccggtgcacagctcaagcaaaaaaatttgtactactagtcgcactatgcccctacacgtctttatttcttttgctccctccttgttggccgaggaaaaaggtttaagggagaggagggtgctttgtactaggaaattttgttccggggaagaggagcaaggaaaaagtgcctggcactcacgtcataatggcgttgtgatgatatcaagcgcacgcgggacccatatgcatcacccatccagtggtgtggaaaatatactgaaagattagccttggtagtgctgggtgactgccaccatcattcccaattcaacatccccccagcaggatgctccatgatccatctgtccatccatccatccatctcaccacccacaaacactcagcaaaaaacacttcacattttgctccattagtggtggtcagctaaaggtgtgtaaactactcgagctatcagcattttgattgtaataaatcggttcggagtcgttcataccatgctcaaaagatttgagggagtgatgtgtcgtagtggaggatgatgatctattgatctagtagtgtggcttaaccagaagtcgacagcctcacgagccaacgcaatgatgcgggcacatacgaattgggacaaaaaaaaaggccgtgaaaaggactagtaacacgccgtcgtacgagccaaccatccaaacagattaaccaaccaaacctttctcccctgcccaaaaaacctttctaacgcccggccgcccacgagacgacgtgagatggcacatttcggccggcgcgcgcaggcgattctccgttaaaattttctcgcgcagcggcagcggcagcctgcggggggaggagggacgcaatcattcggtcgcgcgcctctcgggcggcgcgcgcgggggggaggagggacgagacgaaatcactgcgcggccagggcacgcacacctgccaaaaagccgcggccacggccagcgcccggacacaatcacgcggcgtcaacagaaccgtgcccccgcgtgcatgcacccgcaacgcctccctctctcgttggctcgaacggctcacacacacaacacacaaccgtagcagcagcagcatccgtagctgcgtgcgtgcgtagtagataggcggcgtggcgtgcattggcattggcggtggcgagatgtcaatggggggaagggaaggggaaaacgcaacgcatgccccggggggggcatcgtgctgttccctggcgctgcacacggggccttttttctattgactgtttggcagggctggtcggctttatactcgca

SEQ ID NO: 75950 - DNA, 30866 bp, Oryza sativa
gtcaaatcactaccctccagttcggctgcgctttgcctgcctgctcgagtaggggagtacattttgatacagcgaaagaatcagaataccctgtcattgcgttgcggtcaaaatgttgggcaaagtgacccaaattatattagttggggagggggagggggggggggggtctatggatttagcagcaatcaccgttcctgataaagtcattggacggggataacctagaaataatttcactttagtggagaactttacttccttccgagagataaatccctttctaattgctacccctagacactcatcaaagtatactactccagtactactgctactcgccattttcaaaacaatcgaaagcagtactaaccgtaccacattatttgtcgctttaaattttttataatgtttaattattcatcttattaaaaaatttaaaattattatttatttcgtttatgacttgttttattataagagtactttaagtatgacttattatttttatatttgtattaatttttcaaataaaatgaatggttaaactttacaagaaaaggcatctattatggaacggaggtggtagcagcaagaacacgtaggtatatgtaggcctgctgagccctcgaaacattgatgccagatgaccaccatcgatcacgagacacgtatgcatgcaatgtgtatacatgtgtttcgcagtcgtagagcacaaaaaggacagtagtaacaaaaagaaaacactttaagccagaggcaaaaaggcaagggccccttctctctagctcaagctacactagccagcgccgtacacgagcccccctggcctttgcctccctcgccgtctcgatcgaccactacccgcggcggcaaaagcacacgataaaaaggcccccctcctcctcgtctcctcctccgtaaagccatcacccgtttgaccgagagagagagaacgacgtggtggtgggttgggtgagctagcgatgtgggaaggcgggagccacgacgccgcggcgcagctgctgccgtggttcgtcggcgagccggcagcggcggcggtggggggatacggagggtgtgtcgacgtggtcgggcagggcggggtgttcgggttcggtttcgaggccgcggcggcgccggtggtaaccaggcagcagcgtggtggcgcggcggcggcggagggatcatcgagaggcggtggcggtaagccggcggtggtgtccgggctgctcggcagcctgcaggcggagctggggcgggtgacggcgagggagatcatggacgccaaggcgctggcggcgtcgcggagccacagcgaggccgagcggcggcgccggcagcgcatcaacggccacctcgccaggctccgcagcctcctacccaacaccaccaaggtgagccatgcacgccgttgcacccatcgatcgatcatccatacacacgcacacagttgcactcacgtacgccattttggatcatctctatacacttatcgcaatataatccgatctcgatttgattccggctcgtgtccatggctaaacaccaaatgaacaagaaatgcaagatccataatagagaagtaatttccagggttgcgatttttttttctttttcttggttatgaactttctaggattataatcttgtaatttttcttctgctctatcaataaaaaatatgaacggacttaactttgtctagttaacgatgggctgggattagtagctagctagtactagaatagttttgtgatgcttagtttatatagtactagttctttgattgcttatctagataaatctgacaagaaaagcaaatagcagaaactgagtattatcatcatagattgcctgaaaacaattagtatagtagtaagtttcagctttcttccatttagctaatggcatatatatcctgggagttgctactctaataggattgggccatcgagcaaatatagtacggagtactaagtggaatgaacacatggagtataactaatcaaaggataaacaccactaaccaggtggtggtggccattagttagtggcaaatgtggaaggacgacgcggccactgcacgcgcgcacgccatatgtgctcccgaaccccctgacaagacaacaaggggacaaaaaatatttcattcggcgaaaacgctgcctctcttggacactgtacacactgtacatatgtctgtgtgtgtgtcagtgtgagcgttagccatacactgttgtgtcagaagcttagaactccaacctagcgttcgtaaagctcaaaaagacatgagaaacgcagtgagaaaagctgcacatcgcgccacgccgcgcgcgtctgtatgtcttggtttgcgacgctagctcacacgcgccgatggatcgatcatttggtggccacggcgtgcgtgcgtgagtgctcgcttgttgatgagctcgtacttacgtcagtggctagatccagaaaatcaattcgttgttgttgtgatactcataacatgtttatcaatgttctagtatgctaattatatttaaattatggtgttataatatatgaataaacagttttcctgtaggttttaccgaaaatcgtcggtgtcctgatatgggcctttctactgtatatccgtccctgacttacgtttgtggttgtgatattgtatgtgtgtgtggcgtgcagacggacaaggcgtcgctgctggcggaggtgatcgagcacgtgaaggagctgaagcggcagacgacggcgatcgcggcggcagcggcggcgggggattaccacggcaacgacgaggacgacgacgatgcggtggtggggcggcggtcggcggcggcgcagcagctgctgccgacggaggcggacgagctggcggtggacgcggcggtggacgcggaagggaagctcgtggtgcgtgcgtcgctgtgctgcgaggaccgccccgacctcatcccggacatcgcccgggcgctcgctgcgctccgcctccgcgcgcgccgcgccgagatcaccacgctcggcggccgcgtccgcagcgtgctcctcatcaccgccgacgagcagcagcagcagcactgcgacgacgtcgacgacgacgaggacgggcatcgcctccttcttcgccacggcatcgacggcgccggcgccgccgccgacgacgacgacgagtgcgcggcgtctcaccggaggcacgagtgcatagccacggtccaggaggcgctgcgcggcgtgatggaccgccgggcggcggcgagcagcggcgacacgtcgtcgtccggcggcgctgtcgtcgccggcggcggcgggggcagcatcaagaggcagcgaatgaactacggagtgcacgagcaatgctcggtgtagcgtgacacacactagttgcagctaacgtgccggcattttagctagctaccactttccatgcatggcgtctatgacgagaaagtagcaaactttttagttatttttcaagctttcgggttggttttgggagtagtagtggtcctttggtataacgagagcagctgcttcatggtgcgaaagggaaaagttttatatgtcccttgtgtgtgttgttgtgcacacatgcgcgtgctacacaaattaatgcatgtgtgtgtgttgggaatgacttggatatgtaagggtgcaaagcagctgggggccagcgagtgggtgtgtaaatctactggtggtatctctcttggggtatatcaacgaaaggtggaattaattggcccgcatcgtttttagatttccttgtgaagtatatatacatggcttatggaacaatacatgaaagtgtacatggatctctcacactccaagcaaactagagtttgttcatggatttaattaagagtggatggtatagttgtatatgctcgaaacactactaaaaatatatcattccaaccggcaccacgggagcagcactgatgaggaggattcaaaggtgtcggtttaagaacgagcacaattcgagccaagccgacgcttcaaagccaaaaaaaatataaaccaaaagctgtaacagaaaaaaaaagacaagtaaatatcagagaatcaacaagttcatagatcacataatcaaatattcacatcaaagaattaacaagtttatagagaaagatcacataatcaaatattcacatgagagaataaagaggagccccgggcggttcgctatggcaacgtcacggaggagcagtacgtggcggtgaggggggcgaggatggcgatggcgctgtggcgcaagaggcgtaattgatggtgacaggcgccagcactcctgctccctcacccgatgaggacgacggcgccacgcttcctcttgcgagggcgtcgtggcggcggcgtgcggcaaggggggtgaggacggcaatggcactgtggcgcaagaggcgtggttgacggtgacgggtatcgacactcctcccactcccccacccgatgaggacgacgatgtcacggggtgcccctgaactggtttagccctatcagcgccgcactaccccttgcgactctatcggccttggaggtggaggggaggaggcggcatggtgaatcgtggctggtgatttggggaggagacgagacgagacgagaggagaggtgggggatgtggtggcttggggaagaggaaggaaagggagaggagcacgggttggacgagaaaggataagaaggaagcaaaaggggataagaaggaagtgaacagactgagaagataacgacaagagagcggaagacaggtgtcggttgtattaaaaaccgacatttttatctcatataaaggtgttgttttttaatagaaaccggcacctttctctgacaagaaatataagtgtcggttccatttaaaaaccgacaccaatttgtacagaaatgtgctagcttttgccgctggcgtccacgcggttgcgagtgggcggaaaaagcactataggtgctagttttagctatttcaacacctatagtgccgtctcctttgtggtattctgtagtagtgaaaatttgtagaagccattgttgaagcattgaagaatactgatacgaaatctattttaaactttttctttaaacttctaacttttttatcacattaaaactttcctacacacataaacttccaacttttccgtcacatcgttccaatttcaaccaaacttttaatttttgcgtgaactaaacccactcatatttttacgactcgctgctcaacaagtccttgtatgtacggtacgccgttaggacgttccaaaaatttttccatgaattaattttgttatcaccatgaacaggggaaacgtacataaacgaactttctgcctatcatgagcttatcagctcgtggttagcctcatcgtagacgataataaagcgtcagcagaaccccaagtgtccaagcagcccaaccaagcagtagtactccctccgtttcacaatgtaagtcattttaatatttctcatattaatattattgttaatgaatctatgcatatatatttatctagattcattagcatcaatatgtatgtgggaaatgctagaatgacttacattctgaaatggaggaagtagtaataaggtctagtttagttcctaaaattttttctaaaaacaccacatcaaatctttggacaaatgtatgggacattaaatatagattttaaaaaactaattgcacaattaggagaaaaaatcatgagacaaatcttttgagcctaattagtccatgattaaccataaatgctacagtaacctgtatgtgctgactgattaattaggcttaaaagattcgtctcgtggtttccagaagagttataaaattagttttttcattcatgaacgaaaactacttccgatatccgatcaaacatttgatgtgacactaaaaaaaatttccacgaagtaaacaggccctaagccaagctggccgttgaacattgcagctaaccttgctgctgacaacgtactgtatcgattcctgcgcacgcatcattgatttgcttggctttgctggtggtgtggcgatcttcgatcacttggcgcgaacagaattaaaatgtcaaaaagaatgacaaagacggtggcaaatcatggagcgtcgaacatagctgcgcacgccgccgacccactcgcctctgctcctcgtgcgtccttctgtctcacttctcatcagagagtcacaaaaaacattctcccatgacggacccaccgcgtctaccacaccagtccaccaacaccaccaccaaaggaaggaaaatccggaaaaaaggagcatctcgttgacttgccggtgagtacgtggggtgggcggtacattgtgcccgtcgttttctctcggcgctgtcctgccaagccatatgccattctcacctctccaccatatcgggtccatgcctccatggccactgagccaaacgacggcctgcctaccgcgcgagcatcatctcggcccatccaccagcgcggcaccggccgaaacagcggcaggcctcgccacccaagcggcccacgcatccgcacgcagaaaatcgcgcgcatggaacggagcacacgccacgggccgcgccccagccgcgcgttcagtccccctccctgcctctctatttatacatagggtatgttggtgtttgaaactcgtagataaagattaagattagttaaattttaattattataaacttgaaaaatatatagaaagttttcgcatgaaacacaccgtttagcagtttgaaaagcgtgtaatgaataaccaaattttcatccaactttagttggagaaaataacggggcctttgtatatatattttatatacatatacatatacatataaaccttctatatacatttgtagaaatatgtatacatatacatctacaaacttcgtatatataaaatacaaattttatatgtataagtataaacaatgtatgcatatatgtaagtttgcatgtgaaagtataaatattgtaatgtacatataaattttacacgtataaatttggaaacaaattcaaaataaaaaagttgaaaaaacaaaatgggtcatagtacctagcccatgaaaaaaaatcaagcccaaaaagggaaaaagaaacgtaggctaaaaaccaatcaagattcaaccccaaaaagaaaaatgcaaccggaaaacaagatatatgagatccctcaacttagaaaatcggatcactctgagtccctagatggtattcacctcaattttgtctgacgtgacggccgagtcagtgtgagacccacatgttatggtgaccgtgtcatcaccctctttctctcccctcttccccttcctcctctctctcactcttctcgtcgtctgggctagctgaccggggggcgaggcgggagaggagggtgttggcaaccagcgataggtgatgcagtggcggtggttgcagaggtcgcaggcgtggaggagggtgtcggaggccgacaatgggcgacgcggcggcggcagtgacgtggaagaaggggaagcggcggttgcaggggccgcgtgcgcggaggaaagccgccgtctcgatggcgtagaaattggcagagttccgttggagccccgctgatctcttccccaccctccgtccggcctgcccagtcgagaagagtgagacagaggaggaagggagagaagattggaaagagagagagttatgatgtggtcaccctgacatgtggggctcatgtggatcccatgctaactcgaccgtcacatcagataaaaccgaggtcaatatcatatagggactcagagtgacccgattttataagctgatgatcctatatatatatatatatatatctatttttttagagacgattttataattcaatgatcagttaagagatataagatgtactttttccatgaaaaaaataactaagcccatgtttaatactccaaagtaaagtagatggatcgacaaaacctcatcaaggcaaaaaaaacgaaaaaaagcagggtgatcacgcgcccgggccatcgtcaccggggtagcataatgggcgggtgatcaccttgggcgatcaacacccccgtccctcccctaacacgcacacgtctcctcctttctccccttcctgccacactatatatgaaattcaaaccaattaaaaaatataaaaagaaatctagtacacttaaaaacatattcatgtgaataaactttatacttataaatatatatacagaaatttcgtacatataaactttatgtatagaaatattctatataaaattatatttgaatctaaattcgaatttgaaccgggtatataaacttttaactataaactttggatgtataaactttagataactttgggtatacaagctttagatgtataaactttgatgtgtaaacgtgactttatgtatagaaatattttatacaaaaaaatatatttgaatccaaattcgaattcaaatttgaacctggtatataaacttttaacctataaactttgggtatagaaactttagatgtataaacttaatgtgtaccaactttaggtgtataaacttacaaaaacataaaagtaatgtggtgaaaaaaaaaagaaggaacgtggggagggggctgatcgccgcgcgttagctattccgatcgtcacctgggcaaaaacagaaagagcggccagggtgctcgcgcggcgggtagccgcgcgcgaatttagcgaattcggccggctgctccgcccgcgaagacgacgtgcagtgcagctgccgggggagaagaagcgtcactctcactcacatcggcggagcagtggctgtgggcgctatatatatgctgttacagcgtgttacatcgatcgatctgcgcagatgcatatggaaaagttattcgcagctggagtaactagctgtggcagtgacctatagtgaggggcgaagccaggataaatgatcgcaggggtcattactaaccagggtctatgttttcaaccaaaacggattgaaaacaacgcaatttcgatgttccaacttgggacaaaagtagattttgagtgaaatttggaatagtttttcaagaattcaaattttaaattgtaaaattaaaccaaattaataaaaaaaaacaaattttggtaaaaaaaatagagcgaggttaccacatgattaataaagcattattagcttataaaaaacttaaaagacaatagattaatatggtttttaaaataatttcctatagaaattattttgctagggaatttgaaaagttatgagccgctggccttatgcatagtctcaaatctcaaaaactcaaagtatatgcatattcggctgacgtataatcataaatgctaggtaattttctatttgccgctgctagtatcgtttctagttgtcaattggaatttaacacaacaatcaacaattaatgtcaccggggtctaatatttgttttcaccggggtcatagctggtaaaataaagaggatatgagaggttaaaataaaatcatcggggtctactgacgccggtaattgactgtaccttcgccactgcctatagtggtataaacatatgtgcgctagctatagataattaatagacctttttttttcagattgtgtaacagtggttttgacgtacatatatactcctttagttttaaaatatttgacaccgttgactttttagtacgtgtttgaccattcgtcttattcaaaaaatttaagtaattatttattcttttcatatcatttgattcattgttaaatatactttcacgtatacatatagttttacatatttcacaaattttttaataagacgaacggtcaaacatgtgctaaaaagtcaacggtgtcaaacattttgaaacggagggagtatatatataggcagtgtttagatccagggataaatttttttgccgtgtcacatcggatatacggacacacatttgaagtattaaacgtagtccagtaacaaaacaaattacatatataatcggccggtaaactgcgagacgaatttattaagcctaattaatccatcattagcaaatgtttactatagcaccacattatcaaatcatgaagcaattaggcttaaaagattcgtctcgcaaattagtcacaatctgtgcaattagttatttttttagtctatatttaatacttcatgcaggtgttcaaacatttgattttttttattttttttagagaagggtattttctacccggcctctacatctaaccggatatatacggccattgaaatagggaacttagcccctcaaataacccaaatagggaacttagccccgcaaataacccaatctgaaattcgctccataggagatttaaactcaggaccttgggtactacttaggtcactgtaaccactaggctacatgccctttcgttcaaacgtttgatatgatagggtgaaaaattttagagtggaatctaaaccaggccttagtaaaaaacgggccggggttctgccatgcattgtctctgattagaaatttgcacaaatgtgatcatatgaatcaaagctaggattcaatggtatgtacggtggttacgtacgtcgtcggatatttgctgatttagggcatgttttgtttattagttttcctaatccagctatactaagctacttcctccatcttttaagcacaaccacgtaagtttttcttatccaactttaatcgtcagttttatttgaaaaaaataaaatatataaatcacgcataaagtactattcatgtttatcatctaataacaataaaaaaataatcataaaaaaatttcaaataaaacagatgatcaaagttggaaacaaaaactcatagctacgtttaaaatgggacggagggagtactacatatcctttttaataataaataataccattgacttttggatacacgcttgaccattcattttattaaaaattttgtgtaaatgcataagatataaatcttgcttaaagtactttagtgataaaacaactcacaacaaaattaatgataattacatataacattttttaataaggttgtattatttcccttggtttgaatgaagattttcattacacacgaaacaataaaaactcattagtaaactcattggatgaggacctcactgattcgaatataacaatacttatgttacacatcgacaagctaaaggtgcatatgttcttatatcagatttacttattatatgcttgaagaaatgttattgcaccatgagttttgtaccttctcgtttgcagaaatacacttgtgtgggtgaagaaaagagaccgagcataaggaacacatcgatgatcaaataagttgattgaagactaaaccaaaatatttcttaagtatactcctacatcaccgcatcacttttggcctacacagaatgcaaaagattaagttctgcatattttggatttgattcgaacctcccgatagtattaacttcaaatggatttagttgctgatccagatggattcttgagacccatgaatacttgttgaaaaacttgtggagtctattttcatatggttttggtcccatgtcaaaatttctccttagctattgggaatctacaaaacaaaccacatacatcatctagtctgagtctaatttgagtcttggatcttgtaattatgtcctatgctaagcaaggggtggacgacctagggctaaccctaggatgtccctaatcatatttattcagtagacacctgttaacgactaaatttgtcaacaacaccatagtttagagttggatttgcttagattatttctgctattgcagtttcgtcgcaagtttggtttgtaaaacctcaactttgagatcttaattattcatctgcaaattgagttgcaatataccttgttcttgtttgtgttcttcgatccgtatatagggatttgtcttctcggcgaggtcaatcgggcagcgcacgattgataatcagaggagacatgggttgagtactataggggaaaacttattgctacttggccgggtgcagagtaacacggatgctagggaagcagtgcaacactagggtcaagctaactgctagataaaagaaattgtcttagtggattgcactttgttaatttttccattgatttacacataaggtgcattttgatataaaaagtcaaactttgtagattttaactaacaattagtcaaacaacaaaaacattaatatataaatatgtaccaagatttatatttcaaagtgtgctttcatacaatattggttttatagttatttaaaatatatcttatgagatatctatgatcaaattactactatattgaagattatttaaaaataaaatacgttacaaggaggtaatgatactttaaagcacgtttgggcctctaggtagtctcaagctatcttaagttcttaacaatatgttggaattgctataactatcctcacttttcataaattttttttatcgacgccttttcaaatggctggatataaataacgcattaatttgaaggacattaataagactagtaacatatgcccatatatactttgtaatttggtcatgcagtaaggattggttatatacgtggattgagactggagcaggtccatatatatatatgattgggattggttggttggatggattatgataaattaaagcactggattggttgtgggtacatgaggaggagggggagaggacggaaagaggacaactccgcttttaaattagtggagaaattgccatgcatatatacgctaattaatgactcacaaaatgatgtagaagctgaaaaatcataacatctatttttgttttggcaagcatttcaataatattgacaaacatgtgagaagtgacactttgtaataagacatactaccaaatcaaataatttagtgcctacatatatagcaagaacatgaaaggaataggtgaattcggtgcaccctctgaagcctaaaaggaagcagatccaatgcaacatacaaatcgtagaccaatgaagcgttcataaattcttactcctatctctgtaaagctagctatatattctcgtcattagaaaaagagtatcaaaatcgaggacatcgatatcgatcggaattaaaggtaggttgcgtgcatgcttggatcatctgcaaatatagatcgatgcaaggctggatgttgcattgactacgacgacgattgagcaagaatggaagcaagctggaggctaagctgctgcagagctgatcgatgaacagatcgaaatcgaagcccaaaacacggggccgagcctacgcacgtcgcggtgctctagggttgctccgcagctgttatataggacgccgacacggcacagatatcctccccggccgtactgcctgtgcctgcatgccatcagatcatcagcgggagacctggctttatttatttcatccaacctccctccatctcatgtgtccccaccacctaggaaacgatttattagctactcccggtctcgtaaaaaaccaacttctggcaacgtagttagaagttagttttttatgggatggatggagtagttttcatttcggtatgaaaagggactttaatttggaattgaaaacccatctttcttttcgaattctgaatggattttatttgaaattgttgaaattttggtagacttcaaacaaatttaaagtttgtttggcatggaggcacaccatgcatactggggacatatattgctgacctgaaattttggaaattttgttccgaaattgtgaatactggatcaataattatatactccatttgttgcggataactgacgctacctatatattttctatctctattgtattttgatcgcacattgcttttaaatgattgggtttcattgatcaaataacataacatattttcaagtatttataatttctttttttaaatggtcaaagtatgaaattgaacagtaccagtttcttatgtattagaatacagaggtagtaagattaggtcccctatgaatatatttgtggagggttggaatctcaggaaattttgtctctgaggtcatttggaacaaaggaatatgatgttcaaattctttgttggattgcgcgcctccctatgaagcaacgagataaaacaagtcaagcaaacattaactgattatatattaagatcaatttgatccattagtgaatcaaaaataatactaggtggagtaaccgaaacttcaccaccttgcgttgtgtaactgaaactctgttttcttctaatataatgacgtgtaattttttttatgcgttcgcgaaaaaaaatactattaaagtaataagacgaacatcgaagcaacagctgccaacctagatggagatatatatacatatgtgtagcgtgtctgccagtgttgatcgaagcgcttgatggccggccgcaaagctacagtggcccagatcgcgacgacgacgccgccatggacgacgtgccggccgctgtccatcgatcgaggcatgcagctaaataacgcgctacgatcgatcgatcgatggtaggccgaagcccatactccctctgtcctaaaaagactcaattcctgggtttttatgtacaacgtttgactgttcgtcttatataaaatttttttatgattagtatttttattgttgttagatgataaaacatgattaatactttatgtgtgaattatacttttaaattttttcataatttttttaaataagacggacagtcaaacgttggacacggaaacctagaaattgagtttttgggacggagggagtacgcatgtgtacaagtcttgtcgatccattcatcagtagtaatcagttgtagtagtagtacactagtactgcatgcatggcgaatggccggctatctgtctctagatggagatatatatctgctcatcggtgagagtgtgagacggtgaccgacgtgcacgtactactgacgtacatttcatataaacaatttgcctagctcgatcgatccatcatagagagggcaccacagtactttggcggcaacgtacgggtacgtattacccaatcaaatcaaggatgacggactaaagcaaaccctacatgacgacgtaattaacttcatgctgggctagctgaccattattacttcatccgttcataaatatatgttgtttagcagtaattaaggttacgaattgaagagaaggcttttattgtacccttcatttaaatgaccaaccaacaattgaagcgagataagaaaatgttaggtgtagttcagatagtgaaaaattttatagtccttatatttatcgataaatttaaaatgcttggaaatttgaatgcttctgtttatgtacagagggggcagtatactaaggccttgtttagttaaaaaaattgtccaaaaacgttacatcaaatctttggacacatgcatagaatattaaatatagataaaaaaaactaattgcacagtttgcatggaaatcccgagacgaatcttttgagactaattagtccatgattagctataagtgctacagtaatccatatgtgctaataacggattaattaggcttaacaaattcgtctcgcagtttccaggcgagttatgaaattagttttttcattcgtgtccgaaaaccccttccgacatctagtcaaacgtccgatgtgacacccaaaatttttcttttcgtgaactaaacacaccctaattgatcatgcgatcatcatcacgtgcattaattgtaggtatgacatgggtacgtgttgtgatgtattccctatgtcccataaaaataaacttagtatgagatatgacagttatatagtactgtctagattcatactattagaatgaagggagtatgtactatgtgtgagtacatccttttgtcgaatattaggccttgtttagttctcaaaaactttttcctgaaaaacatcatattgaatctttggacacatgtataaagcattaaatatagataattaaaaaaactaattgcacagttaggggggaaatcgtgagacaaattttttgaacctaattagcccatgattagacataagtgctacaataacccacccacatgtgctaatgatggattaattaggctcaaaagatttgtctcgcggtttccaaacgagttatgaaattagtttttttcattcgtatccgaaaatcccttctgacatccgatcaaacgtccgatgtgacacctaaaaaatttcttttcgcgaactaagcaggtccatataactcaatcttttttgttctattgaagaataacttgggtgatctattaattcatgcagctccatgctcctagctagttagctctccatcgatctctctcacctgtcacgagtttgattaatttgcttcaagtgcatgcgtgctagctacatatgtctcgtcagttcaagggaaacacacacattctgagctatatatgtagtatcatgcacgtatctaactttatatccctctcccagacactcagatcgatgactcacactcacactagagactagacaccttttgtcattattggcaggcaagacagaaatatatcatgtatgagatgatttgcctttggattgctcgctagattcttaatgtgattacttcggccatctttgatcatatgactcaatttgtgtttggaaatcctttattttcactttacttcaaaaggggaacatttgatgatattttaattaactttgtagtagttttcaaacaacgaataatagtactttgaattttttttttcatatgatctcatattttacaattacgaatgacattttatccatagatttttacaaccaaaattcaattttggagactcattgtttgcattaagtacatatggttaaaaaaatcaatgggggaattcttgttaatttttttttaaaaaaatacttataaactttatgtacaaattgaagacagagttcaagctaagaaatatagaacatatagaacaacaccatccatacggaaggtcaaggcaactagactgaggaaacttgattctcaggtatacaacacgtaaaaaattaatgttactagttagtaagatatgtcttgtgataaaataggtcttgactctcaggtatacataatatgtataattttccaacttaattcacatgattgacctatgcccataaataatttcattcaccgtgcaattcaatcttcttttaggaacatgatttttttttcgagaaggaacatgattttatgaacgtagtatttgacaatgtataagccatacattgattttatttacctagctagcttaatttacgaacatatatagctatggtagtagctatggatcttatacattaattgaagttaactcctaaaaatgtacttttgcaactatataattcctttatgaatggggacagaatattgcgatgcatggctagccacgctcaagtatgcatttagaataagtttgtagggaaacgagtgaggttactatataaagaaaaaacttataataaaatagaatgattatatgtctggtgtaaattgagataattaggagttaattgatttctcaataattttcctctacatgcatgaatatatatatatatatatatatatatatatatatatatatatatatatatatatatatatatatatatatatatataactttattattgtttatgattaattatacatcatatgagattatatgtatattcgttacatcaaccaatattataaaactcaagattggtagtcccgcagaattttataacacatcattatatacataatttattttaaataattaatagcttaaagtatacacggcacaaattaactcaaacaaaaaagaggtataacattggagatgatgcattagtttagcactatatattcagttataaaggactcatcaaatagctaattaatcacataaagttgtttaattttaacatgattacccgctaaactctccaaacgcatgcaagaaatatgtgaaacattacttcacattttgttgatttaggtcactgtgacaaaatagtttggccaatttgcatattaatttatatatatgtacagaaaataatttggcttaagctagttagccctaattgagcttgcccaatgtgcagaaaataaaacaaaacatgtatatatatgtggtttcaatctttgttcttactaatatttgcatataactggaaatatggttattaagtataaaataacacaaatatattctaaacaacaactcctttgtcctatatatctgatggaattctaatatacttatgcatattgcagcaaattggaggatattatatgcatggttttgtcattaaaattgctttgccctgatattaagaaatgtcctttatgctaaatttcttcttcgatcgatagtggcagagaaacccagagtctgaacaatgaagttaattaatcccaaggttttgaacaggagtgaatttttaaaattattgtcgtacatattgaagttaaattatattaatatgtgaattttctcttctttcctttatagtgacggattttgagttcatggaaggatcgaaacaagactcatttgcctatcacctcacaacccacaagaagcatatatagtttcaaattgtccattttggtttaatttcatcacttgtatggataattggatacttttcaagtactgttactcttacctgaataatacatgtacgccatgctgtcacatcatatccttgctgaaccaaatcttggaatcatttaactaaacgattatcttcacacgcaatcagttgtcatctcatgagagatccgtatgcagtcaacacgaccaagtcaacaactctctagctatagctagctaattaaccatatatatgacgactacttcaagacaaaattaattaagcttactaatctctcctaaattgaaaacaccaaacaaacaaatcaagccaaatcttacaaagcttagacagataagcaaaagcgagaaattaaaattaaagagctgcatgaaaccataagattagtcgacatagtactaagtacacatgcaaattaattaacaactagaagcgctgaaatgctgggcagagtagcagatcaagacctaatcaatcaatcaagctgcttataagctagctaattaagctgctactagctagaggagaaaccatgcaagcaagcaagctaagctagctgaagctaatattgcataccgtccaagaaatcgccgtcgtcgtcgtagtcgccgtcgtcgtctccttctcctccggtgttgttgctcatcatctcggcgagctcgtagtagtactcgccgagcaccggcgccggcacgaggcggccgagctcgcagccgagctccatgggcgccgatctaccacctctggggcccctcgccttgtccgcgtctcctttccctgatccggcggcgccgaccgcgaccatgtggtgatcgccgccgcgctcggccgacgacatgcgggtgtcgccggcggcgcggtgggaggaggaggaggggtcggcggcgaggcggtcgatggccggcttggactgggtgagcagccagtccaccgtcttgctggccttgtcgaagccgaggcggtcctgcagcgcgaagaagtcgcgcgcgacgtcgagcgacagccgcatccggcggtcgcgcaccccctgcgccgtccggatcttgctgtgccggtccgtcctgaacggccgcttcctcgccctgccatggccgccgccaccgtttcttgccgccgtcagaacagccgccgccgccgccgccgccggaacagcaggatccgcggcggcgccgcgcggcggcctgcagagcacggcctccagcgtctcggagttgaactggccgtggccggagaagaagtggtcgtactgatgctgctgctgctgctgctgctgatccagctgctgctgcatggtggtcgtagggtttggaggcggtggcggctgggcttcttgggagatgcagaaatggtgaaggttaggaaagtaaggcaacattttgtgtatcactactttgcactcactttgtgtactatagcttcctactgggagtgagatctatagttctagtactactgttgcaggcttgcagccacagccactatcttcttcttcttcttcttcttcttcttcttcttcttcttcttcttcttcttcctctcgatctcctcctctgttcttcctctcttcacatgagaactatagctactagcactactagctagtgatcaggtgatgatgagatcgatcaagatggtgatgtgtgcatcgaagcttaaggagaggggaaagaaaaggttggagaggaaaggggaaaggaaaggagctaagcagcacaggaagctgaaagatgagtactgagagagtgagctttaggtattactagtactagacatcaccatctctctctctctctctctgaccacaagggtttgtttgtttttggcagtgatttttttgcttcagagatcgatatatcagtgatcgatgaggagcaatggccggagtcgacgccggacaaaccaactgtttgcgtcactgcagcttaattgggggggttacaagctacgagagatcgatcgagctatggagtaaactagtggagtagctatatattagcaccagctgctgctggtagctggtgtgtgtacatgtgtgtgttggtgtgttcgtggtatggagagttaggaatggaatgatgaaggcattattgtggatcgaccgagggctacagcgatgcactgttgggacacgtggtcacgcaggcgtggacgtatgtttgctcttgcagttacatgtatatacgtatatgtgtataaacgtacgtggaagtgtacgtacgtatatacaccgtgatatatataagaaggcatatatatcacactttttcatatcatttccatgactggagagcttatgattatgagaaataactggttgatatcagtttttgagaatatgaaaaggttagattttcaagcttctggtttctaattaatttcctgaattatgtatatcgctatagattcttagaatctagttgggaatatggctatttggggagctaaagatcttgaagaaactgtaactgctagaaattaaactccccaaacatagtttagaagacatacgagagatggttagggtatgttcaaaggtagaccttgatatgagttcttagacaatacacgattatttagagaacgcgccattacaatagttaaaacaatagtgaccctaagcattaacccataaaacttctattactactcttttttttccacccgcatacatcaaagttttcattttatagaagctgagagtcgctgttaagccattgttaaccgtgataacaatgtctgtctcttctctttctgccatgtcagcaaacctaactagcatgactaagggcccactactattaatgactattgtatatgccggcctttagtatatactccctccttccctagatgtttgacgccgttgacttttttaaacatgtttgaccgttcgtcttattcaaaaacttttgtgaaatatgtaaaactatatgtatgcataaaagtatatttaacaataaatcaagcgatagaaaaagaattaataattacttaaattttttgaataagactaacggtcaaacatttttaaaaaagttaatggcgtcaaacattttgggatggagggagtacttgtataccctagagtttgtgttggaacataatttattactagcttgcaactaatagtctgatgcacaatatatctagtcaagtgtggtctgcaaatacttgaattgaggattaatttaaaattttcagatttgaaacaccgttctcaagaatcttattgacagaacaaaattaatttagttgtggtttacaagagctctcaagcgagacagcaaattaaatagattattgtgctttgaagtgttggtctcacattttaaaaagtttctttctaacaaaggtatattgttttccactttggcctcatcatgtcgttaggtgagacacagtatatatcttaagctagctacatatacttatatatatctagcttccagtgtgattgtgtatatataccaccgcaaatcccggtatatatatatatatatatgtatgcagttcatatatttgcatgcatgtccaagttgtagtacgtactaaaaggaccagactttgtacttctaaatatatagatatatgaccacaggcatgcatgtgacattttttaatttcttcctacgacgcactgcactgcccctgcaagcatgcctgctaaacaggaagctgtgcatgcatgtaatagttgaaatggcaggcgcgcagaaacctagttattcattttatacaagaaaataatatgctatataggcattttttagtttattattttttacgaaacaatgtagattatattaaataagaaaataaaatacaacatgttgttataagttataagaaagagatgataaaacctgccaatgcaactcgaataggctccacatctacgacataatgtgcgatgaaaaagtatatgaataagcatccgctatatattagtttctctaggaaatcattaagccggccggtatcactgaacaaagttgagagccatggaatctgcaatcggtgccgccaattagatcatcggtaactccatatatagataatctttatcgttgatctcaccaacacaagaatatcttctgatgaacatatggatttttttttaaaaaaaatcaagacactagaagaatctaactctataaactagcaaatatagttaatcctccaaagactttgttcgaaaaaagaaaccctaaaatcttaatagagcatatcagatgagtcatttcgcctcatcatcaccgagaactctaaagatggagaaggccggagaggggcccagagagctatatatgttcatgtatagtttgagttgcaaggtaacattttggcgagccctcttttcacgatgaacttttaccttatattttatcttatttcttcaatttattgttagatagtcaatctaatggtacaaatttgtctcagtaatatacttatacatcattgtcttctacctcttgaaaagacccaccaaactcctcatccacctccaatcatctaccgtctgtgcccatgccgcgacttctcctaacaatgttgcctcatcactagagggccccatgccctgctacatttgctacccctctcatcaacactattgcctataattcttcgctcctctggccctctgctatgttcctctcatctagtgctttaacttcattttttagttcttcatcaacaccgatcactatgcatgctcctaaagtgtttaaagcaggggctattatacaattatgttttacactagagggataatgcatagaattagaggactccaatgtaatttgtcaaaagctgggggcataatcctgtttggtctccaataagctccagatctaccctcataggtagggatgattatggactgacatacaggtaatcattacctataccttggttaaggattgttgtactcatgggttgtcaagcagggcttgttgaagttgcatggcgatagatcgagtcgaaggagaccatgcgcaaaaatattaaagaaactcaattgagtgttgaaatattaattttttgtagatttcatccaataattttctctcaagtagtaatacttaattcttcagccctccgccatcttcctctcatctagtgcttcaaccccacttttcaattcttcatcaacgacgatcactatacatgctcctccaatcccttttacccgatcactatacatcctcctcaaccttaaaacctaaccactggggactgccacctcatgatcaccttcctatagtggttgaggctcaaataatataatcctgagggagggctggaggctaatgtgtgtaagttctaagagactcgatctgatgtaatttctctaataccgggagacgaggaggggggataacccaatttggtcttgaataagctccaattctaccctcatatatagggatgagtgtggtagaccgacctacggtaatccttacctaccttggttaaggattgttgtacccatgggtcgacctcgcttgtagggtctgccgaagttgcgtgggtgttagagatggacaagatgaggtgaaaaaagtataaggcaacttacatcgaatactcaaatactaatttgtaaattttctctagcaatcgtttcgttgagtttgtgcggatgtgcttgccctaggcatgcagttgtcttgttgttcactccgttgaggttttttttttaccgatttccatttaaataactgtgtagttgtaaagtttttagcgcttggttttctcttattaaactggggcaatatatactcttatttttataataaaaaaaggatttccctacttttcggactttctcttccaaattttttcctctagtaagtatcaattttctatcaagtgaatgctacctccatcccataatataagaagttttagagttagatacgatttttaagaaagtagttagaattaagtggtggaagattgtgattggttgagaagtgaaggtgggtggaaaaattgaatagtggagggttgtgataggttgagaagaaaatgttggtgaaaaagttattatattttcggacaaattctaaaggctaaaagttgttatattttgggatggagggagtagttaattaagcactccgaaatatatacttattgagtacatgttattcaatgagattcgatcgaccctctgcgtaattttccggtgagattaatttccatccctgacatctcgatcaatcaacttaaccggcatcatcgtttggcatcagctaggctgcacacgtcgtcgtgcaataatcagctcgcccatatggtcaggggatcgatcgaaaggacgagtcggccgccggccggcgagaccgccgccgccgccggccccttctcccctgcagctctcacgcgcggtccatgtggggccccacgcgaccaatcccaccgggcaggtggtttcatggcgttggaccggtcgatctctgctgattgtgcagggtcacgcatgcatgcagttgcagatgcagatgcaggcggctgtgtgcatggcctgtggcccgagagatcgacgacgtacgacgacatggccgtacgctgcgcccatttgacggccgcggccggggcctccctctcccccggccggagacgagattctagacgtcagctgcgacccatgcatgtatggcctccgaccaaggcgcattagtttatgcatatctatgtttttgggtgtccctgtagattggatctgatcaatctgtggtctctctctcgtcgtcgtgatctcgctgtcatcttctgcatatgcacaagcgtctctagctctagcttcagtgcacatatatgcatttgtgtgcatcttattcgatccatatatagctcacgtacaccaggtagctggcttaattaattaatcaaccacttcaaattaatgtgcatcgtcgtccttcgtatatacgtacacgtacgtacgtacgcatatatactagtgtgcatataattaaatatatacgtagagaacactctacgtataaataccccacgtgcttcgatcgtgcactcgattatatgcgtgatgatgatactccttccatgcaaaagtttaaggtgtatttcttttagagatttgagaaacgcccggatcttccagctagctccacaaggtggtaggctatacgacctgggtttgaagcctcaccccttctaattatttaatatattatgtcattctctaatattcgcgtcttttagagatttgctccggtttagcaaaaaccaaaaagtatctcgaggtatcggttacctcacggtactaaatcgtacctcgagatatattttattggtccggagcaaatctctttcttttgtcatcaagaccaagaaaaaataattcattttgtatgtaacgaagcttatgactatatgcatgcatgtaatatatgagtattaagatggctgtttaggttccggtcaataatttaatctaaaattttaaatcaaaataacaacattttcatttaagtattggatgtatgaagattataaatatatctatcttgaaattaactaaacaaaagaaaaaaataatgattaagacttttggatgaaggaagtatatatgcaaacgagtagcaatgtatatgtagccaaaaaaaagtactctatccgttttatattatgagtcgtttaatcaaaattattttgatttaaccaagtttatagaaaaattgagcaacatttacaacatcaaactagtttcattaaatttaaattgaatatattttgataatatgtttattttgtattaaaaatattaatatttttctacaaaactaatcaaattttacaaagtttgacttaaaaaaacacaaacaacttataatatgaaacgaagggagtagcaaacagcaaaaagagatatatagaacatgcatgatgataacatcgacgatgtatagtactagctatatagtgagtgagtgacgacctttcggccgggtgatggtcgttgcttctcgaccttgtctttccgtttctgcatgccgccattgctgccttcttcttcaacctctcgccactacacacacctctctcaaacgtttagagctagagctagcagcagctggctacctagctacacctacaggcctactaagaccagagagaggctactagctactcctagctaagctatacatctctctctctctctcgtccacataatcttggcctgcatcaaacgtgcgtaaagcgagatgcatgcgtatgaacagtacacgcaccataccttgtgtgcgtgcttacacacatatatatagatatatagatatatccgcggctagctaggcttctgcaagtgtgtggagaagatcatcatcagcccaaaaagtggctaatatattatgatgcatgagttcatgcgtgccggccgccacgtgtgcgatcgatcgtacgtgcggccaccagtgtgtgcacacgtgccaccatcgacgatatcgatcattgataaattgttcatcttttctcatcggtcttaattttagatttagtactagttgttataaagagtatatttcagagttgctgggtagcatatgtgtatagaaacatgcatttctaaaaaaaataaaataaaactaggacttaattagttgctattcccttcgtctcataatataagggattttgggtggatgttacacattctagtacaatagatctgggcagacggtctcatcaaactcaatattataggacggatggagtaggatttaggaagtgcaaagtacagaaattacctaatggagttggatttggtcagtgaccacttcttaatgggtcgatcgcctcttgatttgtgacctgctcgatcgatctccaccgtcgatcggtcacacgcctgcctgaagctgcctacagtttgatctccaaattaaaatggcagctggttcatcgatctagctaacacagtagctggctagttaattaaagaaggatactgttgctagtttgggagagttcatgcatgatatctatagctagctgatcttcattttccctttaaaaaggatgcgaggatatatcaacttaactaccatcaactccacacaaactctgatatatatctgaagttttctccagacactacgcatgcgctcattcgatctccagacatcatttctatatggaattttttttcagctcagtgatcctctcctatttgatccactcacgggcaaacacgcggtgagggcgtagtaccgtcttgtagctttcgcattttttgcatgatatatgatgtgaaatcgtaactacatgcgatgcatcgtctctgcaacgacgacacacgcaatgtagcaaaatgcagtgcacgatctcgttctctgaatccgtcttcgacgcgtccgatccccataaaagggaagaatcgaaatctgtatacacctgtcgtctatgagcaaatctgatggctacctaattaagcttttcatccaccacgcctggacgatttgggcatttttctccgacacaaactgtcgaaatgttaggtgctgatcacagggatctgttcagcagatagctaggaaatgacgggctgaataattttccctttcatttggataagatatctatacaggatcaaatagttcagacaaaataaaatcgatggcctctaaaatatagcgtaatttgatactaatatactagatttctattatcgttgctaggaaacaggagttacttaagagaattacaatatcacatagaagtctatcttctagcgcacatatttacgtcgttactatctctgtttctaagtagtagatgacgtcacatatatgtgatacatgtagtcgaacattaaaatcttaaattattaatatatgtaaaaatatcaaggttttatttaaaaacgatggtaataaatttaccataaaaatattttcacattgttagaaaaagtatggagtggaacatagcacatgtatctatgtctaaaacgtccttaagtaaagaaaagtatggagcattttatgaccaattaatgtggatataattaacgaagagactgttgatgaaagtaaaattgtctattgcgctgtgcacatgttcttgagcgacatttgctgatgattggagagactttcgcataggagaaaataacaacacatctgtgtcaactgtcaaacgagatgagcaaacagtgaaggctgattagatcattcacctcctttccttgtcggtcgccaatgggttgctcacccccaaaatgtattaatcagatttgtctcagaaaagacaggagtttgacttttcagacaagagattgtcaagcttgacacagcgcagaagcagctgaatagatttaggatatcctctacatagccagatttatcaattgattaattcaagaataacatatattcactgggctggggcatcttgagaatattttcccaaaacaaatttctcttgcctaaacaaaaatggacatgtgtggctgaatgctcagcagaacagatcagtccacaggttgatcgatgctgccaaaattcttgccgtcacaattctgtatatgatccattacacaaaggatagccaaaaggcaaaagcaaaggtctacagcaacgaagaaaggaggcctacacatacatgaaagcaacatggataaggactaaaaaagaggggaaaaaaatgggggggtgacatcttgtgtcacccggagcaagcacgcatgcacctggcaacttcttggcaagcattttgcaccatgcatacaggtattggattggatgtccatgtgatgtgaggcagcatgccctccacaagaggtagatcattgcaggccacagggcatggcaaatcatagcaacgtgaccaaagaaacgaaaaggctgtagccacaaatgttgaccttgtaagctgaatcctcgtacggcaagggtgatctttccagtatatacagcataaaagtgcacatatggtgtatttgacatgcgcaaccggtagttgccctcatcatttgacaagaccaggagaaacctcatgcttcaacttaatcattggagatacgattgagcagataagagcatattgtcctttttctaagtatgcgcactgatgcagattcagaacatttggtctctgagctgcacaaatttatatacccatgaatcatgaaactggagcaatctgaagttcctgctgcacaagatttttcttaactgtgccctcagttggtaagattccttacatgggaaaccaaacatccgaactagcgaattgtgcctcagaattcaatgatttaagtggattttcatgttggcaccatatgcaagaaaagattccaagaactcgcacgcttcttttgcttcctttgtgtcatatcactcagggttatgtgtgggttagcgagcaagccttctgattttcttgtaccctactctgacacaaaagacttattctagcattcctttgaattccatagccaaaacaatttgtcttcctctctgtggtcatcttcgctggctcgagaagtaggtaacataaattcctagaactgtggtcgacatgtgaacatctagactgtatcacttattgaatcagctgaactcatagcatcacaaacaggtagcttgttctcaatactcactcgacaaattgggcatgaccggcacttatcagagcacgctctgcagggccaacaaaaagaactttagaattccacttgcagttaaacagaaacacacccaacatgtagcaacttgcaataatacataaatatatacaccttgcaagcttcagacgacataacatgtgaaacatacatgaatcagtgattgccaaagaagcttactcgcaaagaacataatggcggcatggaagcagaactatgcaaatgtctctctcaaagcatatccgacataggatctgttcctgtatttatatagaaaaaggttcttgttaaaagtaattgaaatcgaaaaagcacatcaactcttttatggatgagatttaacagcctaccactcatgataatgattcaatattaaaagaaaataaactccaaactgcaatactagaaataatattatataggtgcagcacagaaccaaatcaacctagagccttgtgtatcactctatttgaaattggacattgtagaatgctttgtctgagaagtgagaatggaaat

SEQ ID NO: 75951 - DNA, 2422 bp, Oryza sativa
gaataggcagaaaatgtaaaaattctcataatagcaaggtaaaagaatttaaaaggcagattgactaggaagattttggcctacaagaaagtctaacttcacttcacacgcaaaagcttgccttaaagagtgcacataagaagtttaaatgccaacctcatgcaaatctccttgcacacatatagtagagcattgaattgatttcagaatattatttcagtattcctaagcaaaagcaccatatagaagcagtaccagaagcttctatcaggcatattgaagctgactactattttgctcacacttcacaatcattatactacataatacatcttgtcaggtagtttctaatcaatatcaaacaatttagtgtcattatgacctctcataatttctgatttcaaagctatggtccaggttagcattggtttcctgaggatatctagtccctagttcccagattctgactagtggagttctatcctaaaaccgtaagtgcatcgcatcaattgctgttccttgtcttcctttttttctaatggcacagtagaacaatagcttcaaatgctgcattatccgattcaggcctaagttcaggggtgaattatttcagaaacaaatgtagataaatgctgactcgtcccaaatgctgtgaatttccccagatatgaaaactagtagctagttaatgaatccattggaaagcattagattatggccaaaacactataacaagcactaaatattatcatgaatattcgacctaaaagccagagtgtaccaacagctgtactaaaaaaaagggatatggctcacttgtatctttatctgataatagaagaaatgaaactaggcagcaacagcaacatgccagcagctgcaataggtaatgacaacctactggactaatagatggatttgaaccatcaaaacaggctcattttcacttctcaggagcaagaagtacatcacattcatcaatatcatacgtcatggtggaaccgctgcttataacatttcttttggaacaattaataaatgaaatattatgtgaacaggaagtaaacaagaataaaaatggaaacaatggtatgagccttacctgaaaaaggaaatattgacagtggtcattagaaagaggttgagatgatttaattatctggtgtagatctgtgtccatgagttcataaaccaagtatacatctttgaaactccttctgtgtactggcatcattatatctttcaaggcaataacattttcatggcgcaagtgtcgcagtagtttcagctcccttagggtcctcagtgcatccacacggttgtcaaagacattgttgatcttctttattgcaactttttcgttggttgcacggtttatagaggagcaaactattccataagcccctcttccgatgggcttgattggcacatacttggtgtcaatctcaaatagcgtttgccacattgtgtagtaatgcttcccttggtttcccatgccattaggagggtccaccatcatcgccatcttgtactaaggaaaataaacatttagataactcagtagaagataatttgtcaaaatcaggaaggggagaaaatgcagattatatatattcttatcgaaaccgcataaaagagatggttctatgcttgctgtttacagccacatacttctatccttgcttcctagagcaagacaagatctcatggcatctgaaacacctaagggcacccacaatggttatctataagctctctacaagagatccatgtcagcatattttcctacttggaagagattaaatgaagagagagagcaaagctatctactaacatggagatagtctatagagaaaaacgaggcaatggattagagagctatagatacccatgtagacataccattgaagtggtttactattaatctagtctattgttgaggtgtacatgttttatagatagcaccttactttaccattgcgggtgctctaagagcagagtttgtaaataggaacaattcatcatttacattggatatgatcaaatctactttggatattgcagacaataactgtaatattcaatgctttcagacagtgacacctatgattcgtttccatatcaaatcccatcccaactatacttatgttctcctgttctattcccaagaacagaggaagtaataaaacaaagttaatcctctagccacatcagctgatttagaagtattaaattgttagcggtatgctcgtaatcctgcataatccttcccaattaacacgacaattatgaagtgtgtacataaccaagcctcactaattggagtatttcaagcaagttgcatgctgctaccttgaattccaatccaaccgaggaaagaaattccagagcagcaggtgaggggggtggtgtcattggtggc

SEQ ID NO: 75952 - DNA, 10516 bp, Oryza sativa
gggatccctctccttctcccctctcttctactctctcttccatatcccatctcttcccctctctcttccatatcccatctcttcccctttcttcccaatccagggtgctgggatgggcggcgggggccaagatccgagtcctgctttgtttgtatcggcagcgcgaagctggactccaccgaggcaacggggctctcgctctccacctccatggcggcggcggattcttccttccccttaggtgcatcggcgctaggagggaatcaacgcttgtgaagctgcgccaagtcctcatcgccagaacagtggtttgcggtttttactgtagcaacagtaacaaacagtgaagtacactgtgcaagagtagtgttactgtggtatactgtagcgatcgatctcgttcgttcactgtaaatcggacggctaagaataccctaaagtcacaatactatgcttctctgacttgatctcgttccaatcgcgtcccgctcgtacatgcgctactggagtttgacgatttcttctgcgagtccttccctggcagaggggagagacagaaagagtagaaggggacagagaggaggaagaagtggtagtcactaacatgtgggatccgcgtgggtctcatgttgactcagcttgtcacgtcagctaaaaccggatgtaatactacctaggatctcacataatctggttttgtaaattaagggacctattatatatagtatttcggtttatggaggaattttagactcggcgacaaattgaggaacctaaaaagtgaacttatttcttttttttctagtgatgaatccagcattgatgttgttggataaatgaatttggattcaataaacctagtccttttgcgtggattagtaaaattacattagttagaggtaataaagggacaaacatagaatccaacaatattattttgaacaattttactcttttcagagttttaaaatttctgaaatctcctctaaattttagaaaaaggaactttataggtttgagagaatccaatacaattcaagaaggcgagatggcttagatcagcaatgctatgcttacctcgttcagtttcgttgttacattgctcgtgattaggtttcaagaacggagtattgttttttttttttgaacttcatcgatgcctttttattcacccagcaggttcagtgatatcacgaaccacaaaggcatttataaattctgggagggggtcgacctaaacgatggattgacccgggtcccaactagcgcccattttagtaagatcatgggcaccactattacagcaacggggaatggataaaattcagctgaataaggagcttcacttcaccgaagatggcagtacctggggcctgatcatactctcaggatttcaaggccgacaccaggataagagaatcagtctcgatccccacctcagtgatgccctgcaccgaagcggcaagcaaggcagcctggcaagccctagcttccgcagagtcagcatcatgaacgaacgccagccgtccagcacccgcaagcagcccttggccttcactgttgcgtaagataaatccccaaccgccagttttttgcgtctcctgaaaagcaccatcaatattgagcttaagctgaccagcccgggaggcgaccatttcttccgcaccacattccttgttatctgctgctccccttccgttacagccatctcattcatcatgctactcgccctgtaaaggagtattgttggttgagcagcttacgagctttttctttgcatgagcgtgttcgctccagcttatcgatataaaagaaatctttcccaccaatcctagtaactatattattttctgaagggggcttgcttaactcttactttgatgaacttgtggtagcccatttttttctcctaccttgagtgtcttgtaagtgtcatgatttgaagacatcatcttgtcctatctcatatattaatttagaaattgattgtagtttatgtaattaaattccaacaaaatttttaaggtaataaaaaagctcatacaattacatcaacacaatagaattgtaccgagaacactctcagtagctctgtttggatctatgggttactttttagccctctctcaaatagcccctaaacagcctaaaagtttcaaacatatgagctatttcagggctctttggaaataacacacccaaaaatctgtaaaggagtgctaattggggctatttcgggtggggcccaccgaaaaatgtcttctctctccatagaaaagtgcattaaaggccaaatagctcttaaaataacccttgcatccaaataacttagggctatttctttatgctaaaaatagcactcaaaataactcttagctacttcttcaaacaaggccaatatatatacatgtaaccaaaacacacgcctgtagacaaaattttataatcaaagtacatataatgctaagtcctatcattccatagattagatcgtcactcgtgtccaatagtttttatttttgctagcataaacatgtaaaagtactcgtgtcaagatatttaggtgatatttattactccatagtaatatcacatggaaaatatgtagcatatcaatttaataaaagcaaatatcataaatcccaatttaatatgatcaaagttgcacaaaaactatagggattttggaatgtcgcatataaccctagatattataataccaaagtttcacaaaatcacactattgatcattttatttttgatctaccatactttcaagttctacaatcacatcttaaatttatgaggattttactatcatatagatgttgcatctttttttattttttttatataggagtatgtcaaaatggtcaacaatatagttttataaaactttaggactataatggttacgtgccacgtgccaaaatccctatagtttttacaatttgaaccacaataggtgtggttttatgaagtttactcatctatatctatactaatataaaaaggagcagttccctccgccaatcctacaggccaaatcactcgaatcgatctctaccgtctatctgcgtgcttgatttcgccaccgcacgatccatccatccacgccacgccgaatacttcgctcctcctcctccacccgcgaagacatcgctccacacgcgaagacttcgcttctcctcctcctcgctagctcctcctcctccccggatgttctgccgctgcgccgccgcatcctcgctggatatcctccccgcatggactgccgccgccagagcctctgattcttccccgccaccggagccggtgcttcttccccgcgtggactgccgccgcatccccgccgctggagccgctgcttcttccccgccgccggagccgccgcggccggctccgacctcggccccatccgccggcaccggcgccgaggtccaccgccgcgaccggagtcgacctcggccccatcctccgcgcgatgactccgcgacgctcctccttcccttgatccgcaactcctcactctagcgtgctccgcgcctccccgctgctgacacactccaccacggcctgctcccaacggagctgacttcgccgcgcgctcctcgctccgctcctccccaccactgccacacaccaccatgccatgccctcgccggcgccgtggatctgtatgtcatgaagcctgtctccgctgccgcacatagtcgactcccccgtgaatatgcctttcggctggtatcaccatcccgtcacggccctgtggtcctgccttccaacgacactctgccgcgcctccagtggtgccgccgttgtaagggttatagtctgcccacaccatgcactcggttctcacggacgtgtgccatcctctcttttgcaggtgagagtgcagagtgcttcagctgaaagtgagtcttccgattcccctcttcagcccaatagtcctctatgtggattacctgaatctgaatgtacatcattttctttcactatggcttgatttacactatttgatctagctatcagttcaagtggatacaatcctgttgacgtaaaacacgaggcctaggcgatctgcttaactccagtgcaggtccaaaactagccttcggatatgctagcgtgccagttgatttgatcctgcaatcaacaagaaataaagacaaagaaaccgtggttaaatccataaatgatagccgatcggctaagtgccgatgacatatcatttatcctcgagccaatgtcatatgtaaatcgatcggtggtcgtaaatagataatgaaaaactaaatctactcgatcggctgtagatattaacaatatataattcttatatcgatatatacttaaatcaagtgattgggatagatcggtcgccatgcggagacagtataaatcacttagatcgaaatatatattaatgacaggactatatatgtttatagcatagctgatcagatagatctagcatgtatcggctaatactccgatactactctatatcaagatattaaaacaagtacaatatatcaaacaaaagcctaatatacttaagtgtaataggatcttgacataaatggcggacttaacatgtcaatgaagcatatagagcaaatatagttaaatcagataagatcggctgaaactccgatactaccctaatcggcaaccagaaggcaggctagagattgatattctaagcacaacttaatagatcaaactcaactgatgcagcattaagtatgaaaagaagaacaatatctagacaatcaagccgctgaaagtttcatagggtggtagatatctcatataatccaagtcaacgtcggtgtctaacctaatcggctaccctctactgatagatattagccgattgtaggttagataaagatattgccagagattatgcaagatatatgatgtcacaccctaaaaattctaaatttataaattgttgtttaaatggaattataagaaatgattttaaaagcctagaagaaaagatccaattttaaataataaattccaatataaaaatgggctatataaaattttattaaatacttctcttgattctatagttcctagatttttctgggatttatttgagccaaggaagtatttttaataaatggaattgcatttcatgaataatttaaaaagaaaaaggttttaaaagtcctctgttggctttgggccgaaagtcggcccaagtcactctctctccttcggcctgctcgcgttcggcccaagtcggcccaccaagccgagccgctcgctctccctcctctcacccgctgacaggtggagcccacctatcagggttgtcgtctacctcccaccgcagccacgccctagccgcgcgcaagccgccgccaccccttccaaattcggttgcatctttcccgatccgatcaaattggtaaaggggaaatgatccccttgatctcctctatcttttcccctatagaaacttcatctaattttgttttgaaatcatcggattcgagcttgattcggatttgatttctctcctctaaccctaaaccttccatcgccgccgccggacgttgaaggtgtggaggattaggcgtagccctggtcaagctgcttgtgggatgaagtcgtctgcgctgtttattttattttccgctgcttagatctttattgtttgagaggaactatctacctctgtaatgaatttatattcgcctattaattagattaataattgcactctattatcaatttgttattgtgtgcctcggctgattcctggatgagggttttacacacatgtaagtgtttggagttttggatagaaattccgggcatgacatatgataactcgacgaattacataaacaagattaaagtgtcataaagatggaagcactaatcccgaaaacgcaagccgtcataacaagttttacctcttgttgaagatcgaaactgatgcagctcaacccgaaagtaagaactcgtcgaaataaaactaaagcaaaagggtggcgatgcgccaaaattgtattgaatgtgtgtgttaatttattacatggggttcggggtctatttatacccgaaaattacaaactatgtccatgtcggacacgactcttatccctaagaaactctaagataccataagtctttgcggcagacttttgccctaaacatatctctaaggaaattacataaaacatcctaattaatagatacaattgccttctcaggactctatccatgtgcggcaatcatcttgaaacatatcaactcaacctgatgttgtacaccaagtcatattgtcggaatcggctgtatcacttaacccagtctgactcagacttagccgatccaatcgtagccgatccagactccagccgattcttgctctgttctcgaatcgatctccgtcttcgactccacttcaatctaatcctcctttccgatgctgatattaccaaatttggtcgttaacaaatcctattgttatcctttcaccacaatcagtagttttctgagaagttaatttctttgcatacactgatgaactctgtagtaaattctctgcaggctctttcttgctcaattaattatcgctcactctataacagatcaactctggatttagacttctttggccaagcactatggctaaaatggcatgccaagcttggaacagaaaggtcaagcaatttttccaaccacggtgcagcacgtggctatagcactaacactaatttctatcatatgtaggcagatccaattgatgctggcacaggctttggtgaatcactgatgggtgagagacctacagagttccttgtccaacagagcaatggctgagttctttcagttgtgggatgaaatttagatggtgcagcttcaaccaggaatagccccgactccattcggtgctagctaacaggtgatggccagtttactttctcatcggcttacaacctcttcttcatggcaaagaccaaatgtttatatagtgaactgcataatttcgattcttgctattcatgatgatctgttggttgatctggaaagacggaacacttgggtatttgagcagaggtcttgacctacagagcaattatttggagacatcaaggagatcacgatttggaagtcggctagcattttttatcctgcagtgattatttattagtgttagttgtttattgtggtctgatgctttgcctcatacctttgttcgacatcatagtactttgtactttgtttctccctaaatcttaataaatttggtaggcctaatcctttggccaacctggtaaatcatttcagtagtaaaaaaatgtgttttcctggtcagattgatatatatatatatatatatatatatatatatatatatatatatatatatatatatatatatatatatgatttcttctaggctgaaactcttggcttggagaaactttgttgcatactgtagcaggaactgcaacagattgaaaattgatggtatcaaaggttcttaataatacaagcaataagttgtcaaagaatcattgtttgattttgtagtgccaaaattccaatcacacttagtggctaatctttttattttgactaaactaatgccacatgttagcagcagtagcagaatttttttattttggtttcaggttttagaactgatgttatttgttgctccaaataatccaccgatattgtcaggtgggagctatttgacttgtgtggctagaagtattcgagtcaatcatctgcttgccgtgtttcaaaaaaaaatcatctgcttgcctcggcctacttcaataaacaacggaggatgctctacatcataatcgtatgcaaatacagataatacacaccatatttcccttcatttgcaaagtcgtaataaactaaataagaacaggtaccacattcatatttgtctgatagatctcaaatccatatattgctaatggtctacttctcaaattggtttttacacctcaatgcatgttttgtattccgtttgtcacatattttatcaatcaattacagttctttgaaattggatcatgacttccaacttgtagcaggtaattgcattgtatcacacgttcattacaagatactcaaagcaaaaacggtaatatgttggttagctgcttgcacttgcaatgagagcatagaggttctgtacttacaatctgaggtcaggatcacgttccatatatttttacatagaacactattgcatgaattgcactatttgtagatgttctatagttaatcaactatgttaccttaaatatacatggtgtgttctagattctgaaatgtttagcaaacttagtcaatatgtagattaactatcacaattcatgtcactttttcatatctagcgaacttatctaacttttctttttaggttaaaaaaatgcaggaaaaacgtttaggctgtcgaagcaaatccatcaggaggacaccatggcatctgatgttgtctactatgcatcaaagagattactggttgtttctattccttctttttggttgagataatttgcgttaatataatgttttcatagaagtgagtcaatcttgatttgtttggttaacacgggttatgtgttgaacgtgtgatccaatagtatggctttgtcatgttttcttatcagctaattgtaagtccttagcaactggaatgctggatcatgactaacaagtgaaaaggatcaatgatagttttatgctggtgcagacatgcaatgccaaataaaacatggataattccttcttgtttgtgcaggcttcttagcactcagtaatttatcttttcgaaatttctatagttgttgctcatatacaagggataattttgttgctcagtctcacaaggacagctcactacctatccatctaaaatctgattacacatttgcccattaaatgctactatgcacaacaagaagcaacgaattctactatacacaacaaagaagccacgattgtactcttaattcaaatctgaatttgttaggacatattattgacatataaccacataaataaatccaaagtatatataatatttttgtttccccatttcaaggtctatatgattttacttatttggttttggtccgcatactggtagtatgcctgagagtggttatgttgatgactgttaagagaatgacaagtcaatatcttgctttgataccttttttttttgcatttttgatttagctaaaaataaccatgtactgataatggttatttttattgttacaaattccaattacatgaggatatgttttataaattttgggtaaataggttgtgcttcagaaggtgtagtttctaaaatttttagtgtaattatgtactcgggtgatatattttgtcaaaaacgtgcattgcacgtgcacgattactagtttagtaacaaaagcaacagaaaaggatgctttaacatatagaagttgaatctataggatgaagattaagggtgcacgtaaaacgagacaagtcattagcatatggttaatgaagttttaattattaaaaaaaataaaaaaatagatttatttgatttttttagagcaacttctatatagaaagttttcgcacgaaatatacttgttagtagtttgaaacgtgctaacggaaaccgagaaaaaatctgtatgttattggaggttagaacgggaccataataaagtgaattaactacaccaaccattgttttagagttgaaaacttctcttcaccggtttgccaaaaatggataatctcccatgactttcgatgttataggaaaaccagctcaaatcgataggtttatacaaatcaaccaccgatggactgaaaaaactgatcaattttgttagacatgaacttcacataataaactaaataatacaaccgatatagatcactactacaaccgatattggggagcttataattctgagaagcagctggtgaaaagctagctagtgagaatctagataagctgacaaaccttgcttctagcttctaatttattttctagattctacaattacaacatttcaaaatctaggtgaatatatgtactgtttggaggagcttctgacaacaggagatcataggagaagctgcaacggtcaaaagctccccaaacatgcccattaattagctgaacaatttatgatgccacatttttattaaaagaatattcaaaacattttagctgcaaataaaatttttgttagacacactatataagagaatatgataaaatagttgattatctacttaaaagagaagatagaatagattttagaaagatgttcattaaacagattaatttgggctataaacaccgtaaaacagagtgcagagtgtagactacgacaggaagggaaaggtgcgaatattagatcagcatctctccggcttcaccgaactggcaagtgggcccatccctccaatctcggcggatcactctcataccccatcggtccatccggcc

SEQ ID NO: 75953 - DNA, 2425 bp, Oryza sativa
gcgtggtggtagcacacttcctcaatgaactaagggcgtaaggtaaaaccgtcgacagtaatatagcaaaattccgtttgtgaaatttagttttcccaatcccttctttctataaagtggccaaaagctcaaacctcgtgcttccacatcatcatcaaattgtgaatcgtttgatgaatacattagatcacttcttagacgttggatggaatgcagcatagagcccaacccattagtcaccgggtgagtctcttcgcctcatcagtgccaaatatagctcacatgaacacattggctcatttctatacacatctacatgtatccagcctgtcaatccgtataaaagagctttatggctgaacgccccttcagttgacatgtgctacttaaatatctacaaattttggatagggctgctaaaaagaatttctccaaaaaaaactatttgttttttcatgagatggtaactcctatctaataaattgatgttaactaagtccgcagcaatgcgcggagcatcctctagtatataagaatatactaagcgggccaggagtgtacaagaatactcctgggccaattcttgggccgacattctcaccaaagtggaccgtttggattatttggcccggccgctctccgacaattctttccccaattattccattctctctcctccatcttccggttgcctcgctatcctctccacctctcccaccaccacccaagcagccaaggcggaggaggggagccggccggcgacgcgcgcgccaccatcccagcgacgatgccgcagctgagcctgaccaccaacgtgcccgtcgacgccgtcgtcgccgccgacatcatcaaggactgctccaaggcgctcgccaggatcatcggcaagcccgaatccgtacgcgccccccacctgctcggcggaatgccgcggccgttctctgctctgctcctcctgccttccttctgctgatgccgcggcctccgtggctttttccttgtatggccccgcagtacgtcatggtgtcgatcagcgggtcggtgcccatgtcgttcgccgccagcgaggagccggcggcctacggcgagctcatgtccattggcggcatcggccccggcgtcaacggaaagctgagcgccgctctcgccgagatcctcgagaccaagctctccgtcagcaggtctaggttctacgtcaaatttgacgatgtcaaggttgcaatctttcttcagctcacttcttgtttccccatttttcctcttctaacttctccttccactcgagcttaagttctaatactgacacagtgatgactgatgacactgcttctagtcaatttttccttaatcccgttgcgactgcttgctgctgtggtctgaacaacattttgctccactgcattttaacttcatttttgttcttacagggattcaatttggggttcaatgggtcgacattctgaggccaagtccgtcaaaagttggattgctgcgtcgaatcaataaaattctaaggctaaatgttacatgtcatgtgtatcattccgttgcactttcgacatcatccatgaatgtgtttcgtttatgtgagagaccgaactttgcctgctttatttcaatcaaaaatagcatcgaagtctgtttgctgaaaactcagtccttaattgccgtactaaacaaaatgcagagttccaggtagttgagatagtctttaaaacaaacaaaggtagctgaggtgtcttagcagtttccagaatacatcagttgcaaactgcagggagctttataccagagtatcagtatagagtatactagacagtttggacaggaataccatgcaaactgcagatctactgctctttgaaaggaacacatgttaagctgcaaaccgccctaaaaccaagcatgtctcagcaagtcagcatagcaaatatatgtgtaaacgtggccacttgaaagttgacacttcatagtgtaatataagagcatctaacattacaagccttgataataccgaattctgcttcacgtactcatacaacacattagtccatatactacaagtagaggtccacaggaagaacaactccagaatgctgtcttattcgcacatatttacataagaggtcacctgggcgacatcgccatagcttaagcttgataggcgcgacaatcgcgaataagatttatacaaaaaaccaacatgtgaagatcttagtgtagcacgttgccttcacatgttcgttcttgcctgtcacatattcactcctgcaacaacctctgggtgatagtggagcatctcctgccacatcatctcccggatcatatccacgccaagattttcatcgatgtcgagatcgatgggcacttgagcaggagggtttgcgcttggatcatacagtggagacatgtaagggtgctccag

SEQ ID NO: 75954 - DNA, 1522 bp, Oryza sativa
ggatcatgagaatatcttttattttacaaagatatataaatgagagattctttcataagccgcaaattttggtcaatgtcgcccaattatcttcttcttttttttttgtgtgtgcggagagaggaggtgcacttgctggagtacgtagaaaagcgagtgtgacatgaaaagaatcgttgcgagagatatcaccctgcagagtgcagtagataataatctagctgctgcctgcacttggtggtggggtggccagtagatacaagcgatgcacactcattgccattttgcgtccaagtaccgtacctcaatatatagcttgtcccagcaaattagtacacggccacaactagcgtactctttgtacgagtacatatactggcagcggcagaagcgtacaggtagatgaactggctgtctggccaatggcaacttcagacttgggagcaaatcatcttcacttcatacatgcgtgtgtacctgtgatcgattgccaactttttctccgtcaacgagtacataattctgtctctgctgtttcttctagtagtataggagtacaagtatggccgtgtttacttcgttggccaaaatttattttaaagtatacggatatatattcaaagtattaaatatagtctaatcataaaataaattaaagatttcgcatgtaaattgcgagataaatttattaagcctaatcaatccgttattagcaaatatttactgtagcatcacattgtcaaatcatggcgtaattaagatcaaaagattcgtcacataatttacatgtaaaccgtgtaattggttttttttcgtccacatttaatgctcctgctttatgtatgtgtccaaatatttgatgtgatgtttttttgccaaaatttttttaatctaaacacggcctatatatgagtcgttttgaccttttgagtaattgttccagttgtttacagtacattgtcatctccttttcttttttttttcttttggcctttgtaagcagaaatttgtggtaatgaccgggaccatgtactgtaaggagtagtacaatatctcatgagagcaagtttaatagtatagctaactactagctttaaatcatctatagccaatttaatagccaatttatataatagttgattactatactattaatatctgatcccacatatcatacacatattacgtcttagagtccgtactgcagctggctacggatccgtagcccgctacactgctctctcttattttatctaaaatatatttatagctgctactgtacctgctctcaagatacgagggcaggcatagtgagtgctatagtggtatagatggtgcagtgagaggggagtgtggtgccgtagagcaaggggacactggaaatccatggtgtttcctcgcgatgcagccgccgtgcaccgcagggccccagcctcatctctccctctctctctctcatatgcctagtgctactgcttcccattgcacttgctgctgctactatacggaggggctgcaggaa

SEQ ID NO: 75955 - DNA, 3565 bp, Oryza sativa
aatgttgcagcaaactgatagttttctgaaatttactctatcttaaatgataaatatttatgactagagtgattatcaataatatcttgcccttttttaaacaaatactccctctatctcataatataagacgtgcacatattacaggattcaactttaaaaacatttgacgaataattattataatataaattaaattttatttattaaaattaatattattggattgacatttaaatttactttaagatgattataattttgttgcaataaaccttataatatatgagaaattttaagttaaatattagttttgaagactgtgtcaagttcgacaatgctttatcttataggatgcggggagtacaatttattaaagatgaatttcaaatatgtatatatggaatagaatcctggtactatcgcctaaagcaaacatcgtgcataggatatagatataggctttcttgatttcgacaggaaaggccgaaagggagactgaactacagaaaataactttgatgagcttgacagggggcagcggtgttgtcgtaagccgtagcgaccgtccataagtctctactacaagcgtgtgcagtgtgcacaccgcttaacaaccggcatctcttgggctgcctccatggaaaccgcacatttcgaggttttttgcttgctagctagctcatcatgatgtgtactaacgtactccctccatctacttttgatagttatatttccaaatctgaaaattttatttttgataggcatatttcaatccaacaacttatcatcttaatgactttcttagatttaatgcatgactcttcattcttctacacatgattggctacatgggcatttagaaatgtaaatattaatgaatcacttgtttacgaggaatgactagtagcatatttaaatggatgataagtaaaattacttatccttggtctatgtgccaagattaaatatgactatcaaaagtagatggagggagtagtagcaaatgaaacattaacgcttgtggttattaatcatacgttgcaccgacgttccaatcgaattaattgcctcctaactaacgggtttttaccatcaatgcaaaatccgcatctcttataatcggttgatcaaatgagaacttgtgaattgtctgtcatggccgatcaccaaactctctccgctgtcttcttcctcctgctcgtcccgcacgccgcgtgcatggccatggccaagccgtcctcctccacgctgctgcaggacaagtgcgagctctacgccgccggcgaccggcccagctacgactactgcatcaggacgctgcgggcggacagggcgagcgccaccgatgacgagcgcgggctcgccgccatcgcggccaggatcgcccgcgcgaccgccgtggccacgggcgccaagatcgccaggctgcagcgcggcgagacggcgcccgcgcggcgggacggcctggccgcctgcgccgcggagtacgccgccgccgtgcgccggctcgggcgcgccgcgagggacgtcgtgtcgcgctcgcgcggcggggccggggcgagggagatgcgcgaggcgcagacgctgctggcggaggtgactggcgcgccggagcgctgcgacgtcgcgttcgaggccgccggcggacaggggtcgccgctggacgccgtggaccgagatcgagctcgacgtcgtggtcgggttggcctccgacatcctgccgccgacgaggccgacgtgatgtgatctggcacgcttagctcgcgagtgattaaccacactatatatatggatttcgtgagattattgaaggtaaaatttcacgttgaagagttcgaatctcagcttaaaagtttcaatgtaaaaaatttgtagttttaaaaatttctggttgtgtttcttacaagaaataaagttcgtcgcagtataaggcgcacactagatgatcctaaatctaataactcgtgacgtctgcccaagatatgaatgaagtacgaaaggtcatgtagcctggcgggtacagtgaagtcttaacttcgctaagagatcagagatgtgtcgctagccttcatctacagagcgtatgttaaggactcactaggggtgcatgtacgtagtgttgtatgtgcgtgtgcttctgctttgcaatataagaaaacaagttgtacattaattagtgtttccatagcgaacactcaatgtagttaacctcgcaatgctacaaacaaacataacttatcttccacaaaagaatttctaggggtgcatgtacgtagtgttatgtgtgcgtgtgcttctgctatgcaatataagaaaacaagttgtatattaattagtgtttccatagcgaacactcaatgtagttaacctcgcaatgctacaaacaaacatagcttatcttccacaaaagaatttcagaattgtaaactagttaaaaaatataacaagcagataagcctttcctgtcaataaaccttggagatcagcatctatatgactataaatcctagagatcagcatcgaacagacggagtgcaacctaaatccgtagcatggcgatggcgaccgccccaagtgcaaataacagcgcggtgttcgacgtgccctccagccgcgtcgctcctgcacgcacgaataccattcggattaattaaattaagttcaaaacgtaaattaaatcaccgttattttctccaaaccttttttaaatttcatcacaaaccaatctactccaacaaaaataacatgaaaatccagttcaatctacattttaacgatcaaaagctcgcaagaaattaaattgctcaccggatgtctgcggaggcgccggcggcactccggtggtaaacggatattccggcgtaagtggcggcagcggcttgcctgaaaaaaaaaataaatatattaattaatcaatggagatcttcataaacgtccagggatcttccggctaactttataaggtagtgagctagatgatccgagtttgaagcctcaccctttctaattatttaatattagtttcttccttccaaataggttctttcctaatattcgcgcttttttatcagtggagattaagcacgataaatcttctaattatttaatattaggttttcctaatattcgcgccttttaatcagatcagtggagatcaagacaggattaagcacgattaattgattattagttaattaccggcgcaagagcgggcgatggacatgaggacggaggcgtcgccgaggcaggcggcggtgacgttgaccatggcgcgcgcggtgtcgaaccccgggccgacgagccgcgccacgtcgccgtgcaggacgtgcatcaggcagcacggctgcttggcgacggtggcgttcagctgcgcgcagcacggccgcggcaccgcgtcggtgcggtgctcgatgaagtccaggcacgacagcatccgctgcattgtacgcacacacgtcttcggcgccgacgccgtcgacgccgacgccggggggggcgacatgacggcgaggagggcgaggaggaagaagactgctagccttggcacccgcatggcgtacgt

SEQ ID NO: 75956 - DNA, 2212 bp, Oryza sativa
caaggattatgagaagctgtaattgtataataattcagaaaatgacatagaagttaaaagttaggttaccagcttctctagattctcaccagttaatttctcaccggctacttctcaaaatcttaaagtggtgtttgaatgagaggggactaattttagtccctgtcatatgcgctcattaggagtattaacatagactaataataaaactaattacataataagagctaattcacgagatacattttttaagcctaattaatctataattagcacatattttctatagcatcacataggctaatcatagattaattaggttcaatagatccgtctcatgaaatagtctaggattataaatatattttatcattaatctacgtttaatacttccaattaatgtcctaaccttaaatataatagggactaattagtcacatgcatccgaatactacaacattaacgccgtgtttatttccaaagtttttctttaaacttctaacttttcaatcgcatcaaaactttcctacacacataaattttcaacttttccgtcacatcatttcaatttcaaccaaacttttaattttggtgtgaaactaaacacagcctaagatctctccctatcaatcgttatttttttctgaaagcctttccgtttttttttccccaaaagttactactcctcggccaacgatttctcagctccatcctacacgcgcgcagttaaaatatggagtagtaaaaaaaaccgaaaggagagaaaagaagagaagcgaggcccaggtgtcgatgcaagtgtcccctgacgccccaaccggagagcgtgaaaaagcctgcactgcactctcgcttctcgtccaatcaaatcaaatcacatcattttccgaccatatcctgtgagttgtcctccctccgtataaaaaaacaaacactggattttcgtatttaattttgattttccgtcttatatgaaatttttttataatttatatttttattattgtttgatgataaaacgtgattaatattttatgcgtgacttgtctttttaatttttttcatatttttttcaaataagacggacggtcaaacgttggacacggaaaccaggctttgtcttttttttttatgacggtgggagtacattcactcttcactgaatcatcagacggtcgatgcacctttgcccgcggcgagatcaacggatcttggccgtccgatatgtcctttgtgtttcgtgtacatgcatgtaccggcgaggctcacagtcacatgtcactggtagggacggaaacggtcaaaggttctatttggagagctttagattctgagaagcagatattcggtagccagtttctgagaacctggaaaagctttaaaacctaacttctccagtttctaacttcttacttcatttttcagcatctatagactattttggagcagtttctagcagaagcagtttttgggaaaagctgcagctaggagaagctcttccaaacagagccaaaatggtgggaaaattgttttggctcaaaccaaaccagatcttcatcttctgaaaatggaatggtaaacagtgaggatccatttggttcgtaggattagcaaaagattgtcataggatttaaatttatataggagtagaatttttcatatatgccccttttattcatttgaaaagaaagagaactttcaataggtaaacttttattggaaaaatatcaagaggcatgggctctttcctatgacactatttaaagggctcatgtcttatttccttttatttattcatacgggattgagaagtataccactctaattcctatgtttttcccattaagatttattttaattcatgcgaatcaaagagagccgagctaaagccaaaaatagaatcatacggaaaggaacgtatcaatatcaatcgaaaactggtaataaaaattgaactgtaaaatcacatactcaagttagtatttaacttagcataactatataatatcaccagataaatttaatcttgcactatgtaaattagaatgtgttcctcctttagctatcacttaggtcacagatttgattagggagttgacggcttctaactatggttcaaacagaaatatggagcatagatactatggtatttagaaatacggtaactattatatcataaaaatggcaatttcttcaataatatggtaaaata

SEQ ID NO: 75957 - DNA, 644 bp, Oryza sativa
tacatccgataaattttgtcaaaaaaaatatataacaaaactgttaacgaacaccttttgtggatcgatccgaacaactctgaactctgaagtgaaatccttttcgttttcgaatcggactcacactaaatctcctcatctttttatatcacgagctatcgtgcaatttatcgttgatcgatcgaatcgtggtgaagaaatctgcaacgaaaaccgatggacgccaacatgctgagcgcgatgatggccgccgtcggcggcgacaagccgcagccggacacgtcggagcagatcaacgtgtcccccctcgccctcctcaagatgctcaagcacgggcgagccggcgtgccgatggaggtgatggggctgatgctgggcgagttcgtcgacgagtacacggtgacggtcgccgacgtgttcgccatgccgcagagcggcaccggcgtgagcgtggaggcggtggaccacgcgttccagagcgagatgctggagatgctccggcagacggggcggccggagatggtggtggggtggtaccactcccaccccggcttcggctgctggctctccggcccgacatggccacgcagcagagcttacgagcagctgcacccgcgcgccgtcgccgtggtgatcggcccggt

SEQ ID NO: 75958 - DNA, 1996 bp, Oryza sativa
ttatccgcaaatgtgacaaattcagttaccccctctctatactcggtagacgaatgatgcgcatagtacatccatctacgatccatctgaaatcaacaacatacgaagaaaaatatatgatgatcgatatactgagaaggaatggagaataatgtgttttttaccttgaattttagaaaaaaaaatcaccccccttgccctcccaaccgatttgtgaacagtgaaccgatcgggatggaaagcagttggcggtttggggggtatttatagacccaacacacctcaaacgggttagattaaaaaagcccgtcaaaggtgttggtcatacctttgatgggcttcaattgagttgcccgtcaaaggtattgacctacctgtgacggttatctgtgaccaattcataggcccgtcactggtatgccgtcacagatgtagggttctggcatagtgggcggtgaggaggactggattgtggcgttcgacctcgagccccgacctcgtcggtggcccgccggtgacgacgacgaccagagacgcgcgcctctacgtcaccctggccgcacttaggggctccttggtggtggcacaggacgacggggagagcgcggaagcggtggtggtgctcgacgacgggagggtcgtcttctgggtgtgggacaccacgttttcacacgccgatgccggcggcgtcatgctggtgtacgacccggccaccggcggccaaacggaggtggcggctatggcgggtgccgtccatgtcggcgtgtacacgggaagcctgatgcgtctgcgcaactagtgacttccccgtcttaagggtgtttttatttatggcagtagctacatttaaatcatgccattaatcttagtttgtatgcgtagtattttatagacctttagttaaagttaatcactgagagcaggtacaatagcagactattagccagctacaaacatattttaatgagataaaagatgagagagaagagcagcggactacagatctgtagccagctgcagcacgaactccaagacgtaatgtgtgtatgacagatgagaccatatactaatagtataataagcaattattgtatgaattggctattagattggctatagataaattggagctaacagtgggctatactattaaacttgctctctattttcctactgtggccccttttacttttcagttatatatatatgtcgttaatttcattgctcaccgtgtccaatggaaagcgtcgcctagaacaaacatgctgaacctggataggtttctagtagtagacatgcatgcagccgatttgtttcaagattacagccttgctattggcctaatttcgatttcatattagaaaagatccttaattcaattgtaagacacaaccttttttttttggttttacacaaggaaaaaaaagacatacgtgaacaaagaaagaacatacaccgtcccatccacagggcaaaaaagttgatctgataaacagacacgcctacgaatgtcagcatgtgcatacaatcgactgcagttatcatatatcatatactccctccgtttcccttcgtttcaaaatatttgacaccgttcactttttagtacgtgtttgaccattcgtcttattcaaaaaatttaagtaattatttatttttttcatatcatttgattcattgttaaatatactttcatgtacacatatagttttacatatttcataaatttttttaataacgcaaacggtcaaatatgtgctaaaaaatgaacagtgtcaaacattttgaaacggagggagtatcatagtaccgttctatttgtcatgctcactatctggtgcaggcatgcatcaatttgcgagtttccagaatttcatggtcactataggagattaagtaatgaaaaaaaaaaccatggttttatgaaccgaaaacatttttttggaaccgatatcattatgatccgtctttgaaagaaagccaacacggggacagg

SEQ ID NO: 75959 - DNA, 1331 bp, Oryza sativa
aggagaacacgcggcacttagatgtcaccgcgcgagaggagggagcgaccaccgcacggactcccccacttgccactctcgccgtcgccgcggcctatgtactctcctactactagcaatagtggagtaggagtaggattatatatatccacatccacatcatcgcttgatttaattgtccactttcccgtgcgccgaattcggaaaagtcgtctagatcgtctccgcctccagctagcgactccgtcttcttctgccgcagccgccgcccgcgcctcttggcttcttcctccggcgagctaccggcctcctgttccgttcccgttaattttttcctaagccgcgaggattagagcaaattaaatttaatagtatagcccactactaactccaattcatttatagccaatctaacagccaattcttacgataattgtttactatacttttagtatatggccccacatgtcatacatacattgtgtcttaaagtctgtatttttctctcatcttttatcttattataaaatatgtttgtacctggctaatagtctgttattgtacctgctcttatatatatgcgtgaaaaacacggtttctccaacaactttatagaacaaattagtataaacctaatttgttgttaggtttataatgtatgtatactaagggagtgtttgaggagaaggggattgaggagattgggaagatacgcaaaacgaggtgagccattagctcatgattaattaagtattaactattttaaattccaaaaatgaattaatatgattttttaaagcaactttcctattgaaattttttgtaaaaaacgcaccgtttagtagtttgaaaagcgtgcgcgcggaaaacgagagccaatctcccctatcacccctaaacgaacgatgcctaattcctaattcgtaccgtaaatgttaatcgtttcgttcacggctcacctgattcaatttgcgttgcgtcattgttagggagctagtcagatatcgaaacgtacgacgatcgagcgaagagtatatatgtggtgatggcggcggcgtcgaccggcgatgatgacggcgagacgagagagtatgcatgccatgcatgtatgcaatgcatccaagggacgttttgctcgatttggcaggcggttacgccgctttttcgatgatctagttaatgtccaacaagtatattaaggaaacacaccacttagtgctgcatggtgcatgcattgcatcagccgtaccgtaccgtatgggtgatgtgacgaagctaagtacggagtactgttaatggcaaattggcactggatcacatcggagtgaacg

SEQ ID NO: 75960 - DNA, 18658 bp, Oryza sativa
caataattaaaagcagcatactgtggattccagttttaggtagaaaataccatggaacaacccacaggtccaaaaactattcactagctgcataactgaaccatctgcagaaccaagaaaaataacaccccagtagcttgcacgacagtagcctgtccaagagtgttatagttttcaggagcggcctcaaattctccagtatgcaatcacaccagtcctgacatcggttttgctcctcttcttttggcacttcttccatttctgcaggaagaaaattattttgtacaacgcattcaggagagatttggcaattaacttcattgaacacaaaaacataaccacaataaccagcaaacagtttgctaaaatagtaggccgaaaattactatggttcttattccatttcaaatgcaaaatttactatgaaaaaaacttgatagaactattatgcacctttatattcaaatgcaaatccacacaaaaggccctcccattattttttttatcaacatgtcgagaagatatgtgctcattcaaattaaaaagaccctccttaaacaccaagtttagcaagaattgccaattgccagcaatgcaaaattaccaatttacaatacatctaaattaatagagtatatgattttaagtgtttgagtaacgattgaagtccttatattcctgaaacaaataatcaaactatataggcccatttcctaatttcagttggatatcatcttatttcgatgagcatatggaagcttttagcataaaagatacaagtagaagatgaatttgcaatgaaatttgtagaactgcatttgtgacagataagtaaatgacaaaatgatgctgtttatcaaatcacggcatgaataccaattatgtgatgatacgaaaccaaactttaccttgtcacatactctgtggacataattgatttccagtatatacacctactccagtaaagatactagcctttgtctgaactatctctgaggaagtgttggttactggattataaatccagaccatcccttttgatcctatctgcacccaaagtaccacatttccctcatccgtcacaagcaaaggttgcacaccatctccaaaaccatcaaaagcaaattcaacatttatcctatattctttggaccacataccattctcaaaatcaactagaaaccataagtccaccgcagaaatttgatcattgaaatgtgctgtacacaaagttccttcaagttgggctaacataagacgatcggtaaggtcagcatagttgagtgtgccattcgcttcctcaagaattctgtttactggcccttggagagccgtgctccactgctccgtcgcaaggtcgaaggaaggtatgcagcccgtagcaaaatagtaggagggatccatttgccagtgatccaagaagaagtaagcagccccttcgaagacaactccattggtgcagctcggatcaagataccccggtggactctccatcttcctccaccgtccattcatgtcgccgattgcgaaaacctcacacactggatcagcctcatatccatcctccaagtcctctagaatccggagtagtttgtactctcctgtggaattcgtctgaccaaatgcaaaccaggctggcctcatcccgttgcgacgcaccatatcctctgcaatgccgaagggcaaggcggagacggatcctgtggcggggtcgagcacgctgacgcggtggtgctccccggcgacgaggacacggtcgtagctcgccgtcagcaccctgcactcgccgcccacgccgaggatctcctcgacgacgttgccggacaggtccacgagatcaacgcagcatcgactggggaagctgtcaaccaagacggcgaggagcgggtgagggtggacggcggcgtaggcggcgaggaagagccggtccgtggtgaaggacagccacgagcggcagacggcgcggaggcggcagatcggcttggcggggaggcgcagcaggacctcgagcagcagctccgggggcaggacgccgtccacggctccgaacccgcttcccggtgcggcggcggcggcgcacggctctggggacgccatcgcggacgcctggattgggggtcaaaaccggatgaaaacttgaaccaatcagtgcgagaagaaggacgagttctctgccatcaaggagaagggtttacctcgagcggagcgcggtggccagccggagtccagcacggcggcggcggcggcggcggtggcgccgtctctcgtctctcgccgggatgtgtctgagaagagaaatcggacattctgacacttccaagagtgggtttcggcgtaatgccattccacgaaatggagtcgttaaaatgccactttaaaccaataccaaaccgctgctttgccatattcaccatttcacaggattttcatcatttttcacacttcgccttcccaaaatacccctccgagtgactgtcgccgtccgggtgctcgccgccgcctgcctccttttgcgtcgacgcaagggtcggtaacctcactgcccccgctctagaaaaatccgatggcgaagaccccgcaggagctcctagcccaacggccgccgacgaggaggaggagagcgacggcagccgacaaggaggaggagagcggcgcgacgggagatagccacgcagcgtgacagccttgccactgccgtgcccctgtcgacgctactcgcggccaccggcaaggagaggagagcggcggcgctggagctcctagatacgccgcgtctgggatgatgaattctggctgcggcctgtctacggatggaaggatcacgagggagtccggcgctggaagcttcggtatggtcacaagcggcgtggaggcggcggcggtggcaggtttgtctatgctggtaacgaccgatccgttccgtgagacaggtgtgtcgtcgtcgccgcagctgagaagcgctccgttcttgctggaggcggcgtcctgtgtcggcgccggcgccggtgcggtcgccctgcgcactctcgccgcgtcaccaccggagccgtaacggccgacgggcaggatggtgcccctccgcttcaagacctgcaaacacagcgcacgcacgcgcaagcacacacatcggtttcaaacgaactcagcaaagcaaatcaaagcggaaaaacacttgagcatgacgatctcgatgctccaacctaccttgccgacgccgtcaccacgacgcgagcgggaaggctgccacgcgcccgaagaaccttgtcgtcgtcacccacccgctccacgcccgcatcgttctccccattatctgcgcagcgcaccacggccgcatcccgacgccgacgtcggaatgactcaaccaactcagtttggtataaccgacttaagggcattttggtcagaccgggtgcaaaattaggtggaaatggtaataattggcccaaatggcaaaacaaatatttggcatctcttgtgggtggcattttaaccactccattccgtgaaatggcattgtggcgaaacccactcttggcagtggcagaatgtccgatttctcgtctgagaacgaagcctggaaggagatatcctgggccggaggccactactgacaagccgagcccatttaagcccacataatgaaaatcccagcccatatatcttgtgcgtttgggcccagcccataaaagcccatataaacgtagcacgaagccacgaacacgaagcaatccatccccactccccgatccccatcccctccgggctccggcggcgccgtctccgatcgccctcgactgagccggcggagaggctcgaggggagggaccccaccgggggaatccagctcggttcgacctgtcggcggcgggagcggccgccgtccacccatcgcagccggctcgacctggtgagctctaaccctatgtttcttggtcgcaggaaattttgtctggtaatgatgttctactgcgtattatacatcgatgtaatcatctagcgaatgcatgaccgtgttgtgactttagattctactgtgctttagtgtctttgtactattagagtagcagtataaattgcaaaattgatagttttccgatcatgaacttttagataaatagcttcttgttattaatggcaaacgatcaaagttacatcggctgtgtggcattggcataagatcgatctttcaacggtctcaaacaaaaccaacagaaaaaatgattttacttactacttactgtagtatattacagttcgagttggccgtacaaacatgatctcctctcctgatgctaaatagtactgaatgcttgtaggcttcagaagttcagatatggacacagggcgttcttcccagttgaccgagcgagtacggcgtatgcctgcttcctccaactctggcattctccccctggaggtgctgttcgacgtcctggtgcggctcccggccaaggagctctgccgcctccgcatcgtctgccggccctggcggtcgctgacatctgatccccttttcatgaagacacacgtggctcaccaccgagagacgttcttcttggccagctttaaggatgacgagacgcacatccatatcatggattttgcaggcaatgtgattaagcagataggcataccagctggccacaaggtgttatgcacacgcctcgatctggtttgtgtagccacaaataagaacagctgccatgttcttaatcctgtcactggagatgtctacaacttgccaaagagtccagcagaggagcacacgtaccatgtcaatctgcgcaagcctttcacctcatttgcatttgggcatgttgcctcaacaggagagtacaaggtgctccggatgttcaaccgtcctggatttacggaccttgggataccacagctttgtgaggtcatcaccgtcaagggtggcacaggccaggcacgttggaggggaaaacagagccgtgagttctttgttgaatgtcaaaaggcaaacagcggtgtcgtggttaatggggtggtgtatttcttgatagacagtgtatatgattcaatgataattggtggtgatggtgccggcattcatccagacttcatctgttcttttgaccttgaggtggaggaatggagggaagatatccagggaccaattagcaggaactttgtatatgacatggacttcccagatgagtatatagcaatttgggatcagcttagtttggctgagctgaaaggctacttagttctagtataccaccagagttaccgatcctcgaccatagacctgtggtatttaatagactatgagacccgcacctggattaaacaatatagcattcaaattgaatcattcgttcctgttagggagtgcaaggtaaagccactgctggtattggatgatgggaggatagtcgtatggctaggatcgaccggactgctactcatatatgatccaagaaccagcacttttgcagaagtggagatgagacgtctttctgaagttggtctgtacacaggaagcgtactgagtttataaaatggtgatgtggtgtagtattgtactccataatgttttgctactctcttcaaatgccagttaatcagcttttagaaatgatctttgggcacaatcattaatatacttggtcggatccttgtgtcttgttgtattggggcctgtaagatcattgtaaattcttgaagatgctatatctctctctcattttgtactgtcttgtgtaaatatagtgttaggtgtgtacttgtcagcatatgtcatctgacattatttagagttgctgcaactttgtatcatagctgctagccagttggttggatacttgggttatgtgtaaaaggatgtggcctgaaaatatttctatattctctgagctcttttcatatgccccattcaggtcaaaatgctcttcctttgttgcatgaaatcactccagtcattaattcagtaaggatggggcatgctcataagcattgcatggtgaatcagaaatgctcttttgaaatcgaattgtcgtgtggaaccctcagaaaaaaaatgtcgtgtggaagtctcgagtctgtagggcctgcttatgtactttatgttgcaccatcttgattgcagctgttaaacttgtaatcctaccattgggtttgtcgttgcagctgcctcgtctgccatgtttaccccaagataaaatccaagtatttcacacgatcatctctatacaatcttaaagaaaaaacaataataatagatgtgagtccgccatcaccattagtctgacaagtgggaccacagataattcacctgtcctctcccaaccctcttcctatggccccaactttgttaaccaatctgtctatacatatgagcaaggaggtggttaaaagcaaagcaatggaacaataagggatcatgagcaaaatccactccatcgtctcctccgtggacccgagtactatgtcgacaaggactggctcgagctttatctggccgggcgacggtgggcaagggacgacgtcagcgtccgtggtgacttggggattgtgatagcgtattgtgaatagggatttggggactatcagtgctctgcatttggggaactgtgattagggatttaggggactgtgattagggatttggatccagattttctctttttttttggctcccaaaaatatgttcactggcgggtcttcttagcatccgcggagaaaatcgttttttcactggcggcccgccagtgaaaatctatttttgctggcggtgcaaaaaccagttttagccgacaggaaagacttgttttgtagtagccccttccttctcgccgctgccctcttcccaatccctcgtccaccacactacatctctgttgaacccggcgtggagaccacatcgacgatggcggcttccatggcatcacccttttctacccccactgtcgcgtccactgctgctataccaacactcaccagcgacccatgcaacaaaggaagcccagcaccaagtatccggctcgtgaccgcgttgtgttaggggagtacttaagtaagtaggtgtgtgatggataggggtatcaaggttgtataacctgaatacagctctatcttcttccccaaacaagttcatctgcctacccccagctttttcttcttcctcaaatcttttctctcttcccaatccccttgtctagatcgggaacgtaacatctggtatcaaagcacacgatcgacctagagacctacgacaagccgtagtaccattcgcgagctcaactcaaggctaccaagatggatcaacatattgctgatctgagcaagacactggccgagatccatgcctagaacaatgcgatctagacaaagatggagtcgctagacgagatcaagaagccggtggtcaacaaggcgatgaatgaactacacgacgaggatggggatcttcatagtactaagataagatgtggtatattcagtattagattgacttttattatatggcagaggaagtattatacttcatccattttttaagtatgacgtcgttgattttttttagatactttgattattcgtcttattaaaaatatatttattttattatgatttgatttatcatcaaatatttttggaaaaagtatgaattaccccctgaactattatggttgaccgaattacccccatgaacctgaaaaccagacattgctcatcctgaacttttaatattagacgaattacccctccccccgacactattctaagcgattttggcttgtgcttgcacacgtggcgctaacgtggcaatccaatcagcaaaaatactccttgagcccacttgtcatatctcttccctctctctcctaagcgtcctctctctctcgaacaggcggctgcggacgggctcgggcacgcggctgtggacgggcggtggcggcgtcacgtggggacgcgcggtggatggtggcgcgggggaggcgtcagcggcgagcggcgccctctcgagctcggcgtcaacgtcgacaaggcttgtgtaggggacggcagcagagcgcgggaggacgcggcggcaacaccctctcgagctccgcgtcaacggcgccgtgtccacccccaatgactgcggctgcgtttgcaccacggcgtgagcatcaacgactccaagtcgtcgaactccatcccctcgaacgggtcgacaccgtcgtagatgccggcccgcgctactgccgccgccgatcccgccgagccgttcctggtgaggtcagcctcctccccctcctcctcgctcacccagccgcgcccgcagccggcgtcgcttgcccagccgctgctgccgccgcagccgcctccgctcgccgagccacccccacagccgccgccgctcacccaatcgcccccgcagctgccgccgctcgcccagccacgctcgccgctggcgccgctcgcccagtcgcctccgctcgccgccgagccatgccctcagcggccgccgcagccgcctccgctcgccaagccatgctctcagccgccgccgcgccctgccttgctcgccgagaaggcgagaacaccctagagggagggagagagaggggaagaggagaaagaagatgggagagagtatagatgactggtggggcccaccgttaaaaaaaagaaaatgctgactggagtgccacgcgtacgccacgttgaacaaaaccgccctggattgggtcgaggggggtaattcgtccggcattgaaagtttagggtgaacgatgtctggttttcgggtttaggggttaattcagtcgactgcgatagtttagggggtaattcgtatattttccaatgttttttaagcatgatttaaatattttatatttacacaaaaatttgagtaaggtgaatggttaaatgttaataataaagtcaatggcgttatacattagaaagcggtgaaaatatttgttttaaggttttcacatttttaggttggttacaaaacagtacacgaacatggtcgctgccaatttgttgatttgaggctgatagcctcaggccctaagttctccaaaacttttcccaaaaatatcacatcaaatctttgaacatatatatggagcattaaatatagatgaaaaaactaattgcacagtttacacgtaaatcacgagacgaatcttttgaacctaattaggccatgattagccataagtgctacagtaacccacatgtactaacgacggctaaattaggctcaaaagattcgtgtcgtggtttctaggcgagttatgaaattaatttttttcattcgtgtccgaaaatctcttccgatatccgatcaaacgtccgatgtgacacccaaaaattttcatttcaccagctaaggccttgtttagttaccgaatttttttcccaaaaacgtcacatcaaatctttggacacatgcatggagtattaaatatagataaaataaaaaaaactaattgcacaatttgcatggaaatcacgagacgaatcttttgagcttaattagtccataattagccataagtgctacagtaacccacatgtgctaatgacgaattaattaggcttaataaattcgtctcgctgtttccaggcgagtcatgaaattagtattttaattcgtgtccgaaaacctcttccgacatccggtcaaacatccgatgtaacacccaatttttttttcgcaaactgaaaaaaaggcctaaacaggccctcaaatgaatcaacgagaaggcgagaaggcaacgtgcattcaagaatagtagtgtgaaggcaacgcgagtgttttacccctatgctgttaagaaattaagaaagttgctgcttacctgtgtgccataaaaaaatttggagttacttgtatgccatgagcccaactttcgttgacccgtgtgccattttggatggatggagacataatagatgtgttaggggctgtgtaaagacagctttggccttgtatacaataatgggtttaaaaaaatcaaaaaagtgaaaaataatttagaaaaggcgttaaaaatcaaaaaatggaaaataatttttttaaaaggtaaaaatcagaaaaagtgagaataaattttaaaattttttaaaaatccaggaaaaattaggaaaatgtgggaaaaattaggaaaatgtgggaaaaaaatagaaaatggtggaaaaaaaggaaaaatcagaaataaaatttaaaaaaaggaaaaaacaggtgcatgaacattacatactgacaaataacgacatatcacatagacaaaacaaatgcataaccattgcaccatagcaacaagtgcatatcaaaccatacaagtgcatatcaaaccatacatgaccgttcatccatagtaacaagttcatatcaaactaacaagtttatagcaacaagttcactagttttcatcacactaagtccacacataaaaagtactagttcactagttttcatcacaccaaaccatatatgtcttaaattacatcaaaagtagtagttcctccacataatttattcaagctgaagtttcttcttgcttctagtattagaagctaggctggatgggttggccactttaattggagccctccttggtgtacacttcttgacggcttacttcttccttagtgtgtccactgtctgtggagagacttcataggatgcaatgtcaatatacaagcattcatcatcaacacccacatgctcattggatgggtttgggttagcaagggattcactatctgcagatttagtatgctttagttcaactgattgcccactcccactcccaatttcccactatgaaatgtcaggaggctcactgtccaatccggcgtccatcctacagatgaacaatcccccactgtgaaatgtcagtgatgaatggacatgaaagaatagaggttttacttcgctgcttccacgggctgcttggaggcgaggtgggcacgggaggcgacctggaggcagggtgcgccggcctaaaggcgaggtcacaggagctcgctggccagggcgcgcggcgacctggagccgcactggagccggcttggaggcaggggggcgacgggccgacggggcgagggcgcagggccgcgccagcctgggcgcggcgcggcgacggggcgcgctggcctggacgcgccgcgacggggcgtgccggcctggggcgacggggcgacgggccgacggggcgccgacgaggctaggcggcggcggggtcggcggcgacggctccggcgaggccaggcggcggcgtctagggttagggtgcggctggcgtgcggcaaaaatagggagagagcaggagaggagagagtgagagtatagagctgaaaatagagcagaggcaaattagtcattttgatacatgggttccacatgtcagagatatggaaccgttaagttctaacaaaagttggacggaatagcacatgggtcaacgaaagttaggctcatagtatataggtgactccaaactttgctgtggcacacgggtaagcagtgactttcttaatgccacagggtaaaagacttaggcaacgcgtccgtccggctcccctccccgaggaatctccatttccattctccactccccgccatgggcatcaccaccagagctcgagggaagaggaggaaactgcagggacaccagaccccgccgccgccgccgccgtgcggcgccgcccagatcagcctcctccccgacgacgccctccgcgagatcgtcacccgcctcccatccaacgacgccgctcgcacgcagctgctctcctcccggtggcgccacctctggcgctccgctccgctcaacctcgacctgcgcgacgccggcgacatctcccgcgtcctcgccacccaccctggccccgcccgccgcttcgccgtcccggacctcggctcgtctttccccaacagacgcgccaccttggacgcctggttcgccgcccccgccctcgacaacctccaggagctcgagctcatgggatcctatcgccctctcccgccgtccgccgcccgtctcttccccacccttcgcgtcgccgtcttctcccggtgctccttccccgacgatcccgccgccgccgcattttgtttcccccgcctcgagcagctaaccctcgagtacgtcgccgtctcggaggccaccctgcacggcgtgctcgccgggtgcgccgctctggattgcttgctgttgcgcggcgtgcgcggctgcaggcgtctgtcgatcagctcgcccacgattcgagtcgtcggtgtttgtgtcactcgcgcgttgaaggaactgatcgttgaagacgcgcctcgtcttgaaagattgttgatgcctgaagtctggcaactcctgcgggtctcggtaatttcagcacccaaactggaggcattgggatggctttccaatcactgcacacttgagattggcaccattgcaattaaggtatatgtctgcaaccttatttcttcacacattcagtagacttacaagtacctttggggagtttcagtagacttaccatgctcctgtgttcagtgctccattggggaatttcactttgatagcttgacaacggtggcacgcggtgtgaaggtgttagctctcgatattgataatcttagtctggatatggctattgacttcatgagatgctttccctccttggagaagttgtatatcagggtaattagtcttcatcttgtggactctctagttcacttattttacgttcctttttaatgatatccaaggatgagcctcgttttcgtcttgcagaaatttagtcacaagtgcaacaatgtatggcgccaaaagatgcgccataagatgctagatcctattgagtgccttgacctcaatctgaagaaagtagaagtgtcaggatattgcggcaataagtcccatattgactttgccatgttctttgtattgaatgggagagtgttggagctaatgaggcttgagtgtggaaccaggcgaaacgacagaaagtggattgaaaatcaaaaaatgtgtctcaagctggataatatggtttctaaagatgctgagttccatttcactcgtcgtactagttggaactattttacaaatgtcaggcgtgcccatgagctgttgatagctgatccattttgcacttaaatgatgaacccgggcttattgtctttataggatttgtctagttttgggcactcatcagtttcaagaaattgctcgttcttgttgttttgctacagtatgaatggcttatcaacatggggacgtaatagctagggaggatagctccatgcctccatgtaatcagctgcagcctttaacagagaatgagagaccatgtctgacgcatcatatatatgtaataacattgctcttcaatataaacatctgtcagccttcttgtaacagataaaatctgtgcccaatttcatcatcttatgtaaaatgttgtttgatacatcttcattggtctacacaacactaacatatcagtgtgatgcttaggtgctatacatattaagattagtatgttttgagaatagccaactgcaaaatgtcttggaagttccttgattttacatttggtgatcatgtagaataaacagcaaaatttcttgatcaggccttttaagtgcttttagcattgtgtatgcttctgtttcactaaagaaaatgttttatagttacaacaactgattctagagaacaatcgcatcaagagtgaacaacctagctaaatgtccaatatggtattttgcctatagttgcattcatgacctcatcaagataattgttttgacataatttagataatgttttgtaatcagaaattgcatcgcttcatagcagaagaaaagtcaggtctgaactattggacttgtttgagatgtttataggactcgagacttctagtgtgaaatagaagccatgggtatgctcttgtgacttgtctacctagctcttgattaattaagaacaacaagtactcgtagtaagcattttggaaggtattctttttttgaaacgagtccagccttggttggctttatattaaagtaggagggaaaattggacatgtatggccccaggagaccggtaaggaaaaaagagaactaaaaaggggctgtggaatcccttataggcgtaaactgtacttcacagcaactagcagaagaagtttcataatcctagtctcctggcatgatcctccaggcagagctagcctctccttcccttgaactcagcttaccatgggagcaactcatcttgctagattgggcactagttcctgctcattgatatcaccctttgcccagttggatttgctaaagtctcgtgcatgattccttttctgtcagttggatttggtaatgtttagataacctgaacattaaggagcctgctgatgctaaattgctaatagtactaacagtgttcgataacacagctgtaatgcctcaattttatctttcaattgaactagtgagtctggcctcttttgtctgagattgctcagcttcttcagataatgtaagcttgtttctgcctactatcttaccttcaatttgcttctataattgtttaattgttgattataattcagtttggaaaggatgaggaaattaaatttggtgaaattcacttgacacaagtgttactggcaatgtacagatgatgggacaacagtcatcatctggctaggattgacagaactgctatgcatatatgatacaagatggagcacttctgctggatataacacatcttacaggagttggcttgtacacaggaaaccaattacgtatacaaaatggtgacatgatctaatgttgtaatattttttactccagtttgtggtcagtcagttttgcgaataatgctcacttcacttgggaggttttacatttgacagtgatggtaagtggtcgttgctcctggagcagaggacgtggaggttgaagcagggattggtgggagtgtggcggcttgaacaagagcagcagaggttctccctaacattgattctgttgtttttgttgctcgatgcaactgttgaattttctcctttgtgcacagagttgatcgatgagaaattgtacttcattgaattgaaatgtgggggaactcagcgtcaaaaaaaatgtgggggaactcaaagtctagcgaggacgagtttgggctatcattgcttttaagctgatatatcctctagtactatgatgtatgacttgttgatggcattgtgcgatcaggtatctgttaacttgaatgcatggcctaatgggcttgattgagggtttggtgctatcctgttgtggttctgacccaggaaccctaaccaaattggggatggcatgttctgtggcgatagaggttaggccaactcattgtcatgggactttttgttgccttcatgagaatacagaaaaggagtaatcatgaatgcgtatataatgggcactgccactgtagttctgtgtggctgtgaggtggattttaaaaggtagtttcacattatttttaatatgtagttaactagttatccaactgtgccttaggattttacacaaatgttttgtgacatagcaaaggtttccaaggtctcagcttatcatgggagactggccttaatggttctggactagttccttctgacatatattacccttaaggccttatgttgcattgaaagcatagccttgatcgcgtactgagttttggaaaactatgactgtaattggtgtggcatgttcttcctgagatattcagtaaataactttgcttccatctactttcttacctcaggttgcttttatgtttgtttaattgtaggtagtacttcagtttgggaaacatgatgagattaaatttggtggaagtcccttggcacaagtactgctggcaagagacatgagactaactagggactgctgagtactcctgaacaatgtaaagccatggctgccatacatgatccaagagccaacacttccgcgaaagtgaatatcaggagatgagacatcttactggcgttggcctgtccacaggaagcctactgagtgcacaaaatgatggcatggtgtggcatcgcaaaatttttctaccgagttcagtttgaagtttaaactgttttgcaggaatagctgtctcttgttgcatcggagcctgtcaagctgttgtaaattctcgaggtcgcacattttgtacagtctcctgtaaatgtacatataatgttagatgtaatgagtcctggtaaagtggtacctgacttaaattaaaggaactgcagctctgttagcatgatggttgtgtaatttgatgcaagagaagtaccagggtgccagtggcattgtatgttcgtttaattgtaaatcgtccatgcttttaagttaaaagcattgactgcttcatggtgaatctgaaaattttgtttttggagactgttgtcagttctttaaggattatatccatgctgtgtaaacctgaagaattaccagtaaacctgaagaattactgcatgctggtttgtgtagttcacaatctgctggctctaacagacctgttacttaaaaagtaatcgaacagagaagtactctgtttctgtatgaacaactgcactccgtttctgttagttttgggatatttgtgtctttccaactcaataagagttagcacatcattgaacttgaaaggaagaacttcactggatgtatatcactcaacaagtttgacagagcaatgaattgaatagggaatattttcattgaacagaaatattacttatagcgatgttacttacactgaaatcaaccaatcaacagcaatctcaactaataagagacatatttcgcataggcttattacattcaactcatcaattaatcaattactcataaatacatgccattgcacaactatttgcctctgcactacagtctacaaaccactgaaaatctcttcctacaaggtcatccatataacagctatcttcactcttcagaacgctacttaagtgctgatttcttgctatcattctcctagtccaccggcagatcgaacagctcgtccatggtgaagtcgcggcagctcgtgtcgctcgtgctgaagtcgatgtagctaagcacctcatcaatactctccggaaactcaaaatctgacaatgccatgtcctcgccgtcattgaactcgcagttctggttgtccgccgatggcgccgatgctgcaccaccaccagcaatggcttcctctgcttgcgggacgaacaggtgtggcatgtcgcactcgcgcacaaactgctggtgctcattgtcatcaatcatcccaggaagatcagggagcagcagagaagagtcatcgcccatcacacagaaggagctctgatcggcgacttcagaccaatcctgttggttctgatcgggcagagcagctccagcatcagcgatcaggtcgggaagatcacggaacaccatgtcggtcacaccggaggagctctgatcggtgccatgatccgccgccgccgccgcgggaggaggaacgagcagtggcggtggcggtggcccgacctccagatcgaacagagcagtctccgcctcagcccgccggggcgcgccatgtgctcgaccgtcgtcttccggctctctcttccgcttcttgccgtagccgctgaatcggatgcggtagagccggagcggcgacgaggcgaggtcagccggcgccgtcacggagtactcgtgcatcacccaccccgagctccccctctccccctcggcaaagaagctcaggacatacttgcgccacgcgatctccagtacttcgccgccgccgccgccgtcgtcgccgccggggacgagcagcttcttgccgtcgacgcacatcctctgcccctgccagaaccctccaccctcgacggtgcgcttctggcgcttgcccttggcgttcttggcgtgcgcctccgcgaggaagaaggcttcgtcgccgccccggccgtgatccgcgagaagcctccatggctgcgcgctcaggggatcggcatcgaggacgacgccgtcgagcgggaggggctggccctggaggcgccggagcaggtaccggccgacgagctcgtcgtcgctggggtcgaatctgagccccggagggagcccatccgcgccagccgccgccattggagtctcgatcgcgagcgctcgagaatttctagggtttagggtatcgagagagagagagagagagagagagagagagaggagaggaagcgggcgggtgaatcttcccccacaaggacgggatttgaatttatcgaagaggaggaggggggatgcgtggggtgacgtcagcatgagacagccctgctgcgcgcgcgttgcctcgctcagccgcacgggtagatttttattttgtttttggaaagcttaacgaaataacttgtgttagcaacctgattttggaacctagttttgatttgttttgaaattttagcagaaatttgaactgtcgatcaggggcctcaggctgtgcattcttattgctgctcatggtgattctgaagatgcttcctgcattctttggactttctgacggattctatctttaggataattctaggtgggaagcagagtatacttctgaagacaatcaaactataggggaaaaaccttaatattgttggtgat

SEQ ID NO: 75961 - DNA, 1877 bp, Oryza sativa
tctcattagccgtggcgtgcgttgaagctgtgaaattgacaggacgagtttgtgcgatttgctcgcgctttgctttgctagtttgctttccaggtcatctcgatgggaggcaaggacaatgggcatcactgttcggcatgatcttcctccgatctgcggctttgcatacaacccagagtccccccacgatgacactgtgcgacttcggttggattgtcagggaaagctggagaactcattgtcacctgtgtttgtcctgaaaagaaacaggaatcgcccctaaactgatagtagatgagtagatcgagtcatcccatgctccctttccatcctatttttccagtttagcttcttaccttacttgcctagctagcaatagcatagctctcattatcgatctcacattgtatctttaaaaaattatctgatattccctatgttatatattataagatattttaagtttaactaaatttatagaaaaatataatagtattttcaactcaaaacaaatctataaaaaacatattcgccggtggattaaatggaactaatttgataacataaattcctatatttttttaagcttaatcagactcgaaaagtttaactttgaaacaaacgtaccaaataatcttactaccttttgttgcactctggatcaccccaactctcttctcaaacatacgaacgatcttgagtgcgttggtttctacttgtcaataaactcccatggtcatatgatatgtttgtagatggacaaacaagttgaggatggtccagactgtcacaaaggtaaaattatccaattcaaagtgaaaatatcaattaaataaatggtccaaaacgaaacgccagtaataaaaggtggcccaaagtgaatttcacttgaagttttgattcccttttattctcggctgtatcaccatgaaagatagaacgagaatgaatttcggccaaaaatgaaaatgaactactctaaaaaataatttatcttgcctctctcaactcttgctcctagttgaatcgcatcccttaatagcaaaaccgggtataacgtctcctccatctatcaaaaccggtgcaaatagcctcctttggtggttcaggaggcggttttgtctcacgtggcatatttgatcccattaactgactcagtcaatttgtgggtcccacctgtcaaccggctagtggtgatgtggtcgggagctagaggtctagctggagaaggttttggtgccattgtcagggatagaggtagaggcagaggtagggaggagagatggaagggatgcggaggagaggtgagggaatggcttcggcgggaggaccacagtcgtcgtcgaggaggcggcggtggagagtgaggaggaactgcgctacctggtccacgaggaaccctgcccacaacggcgccgggactgctcccccacacgtggccgatcgacgagctcctcctcccccccccacgtgcaaccggccgatgattccaatcccagcgcatggcccaccgggagttcctcccaagagcacggccacccagtgagctcctcccccgtgcgcggccggctgacggctcctctccctgtgcgcagctggccgcatgagctccttccccacgcccgccgccgccgcccgggatctattgcttattggaggtgagagaggaggaagatatgagatgaggtgaggaagaagatgggatgaggtgctggctgctgacaagttggtcacaccaaatgattaagctagtcaatagccacgtcggatgaaatcagctcccaaaccactaaaggaggcgatttgcaccgattttaatagatgggggagacgttacactcggttttgcagttgatggatgcggttcaaccatgagt

SEQ ID NO: 75962 - DNA, 33267 bp, Oryza sativa
ttgatagtcaaagtttaaacaccttaatagttcgcgaaacgatactttttaagaggaagtatatatgggatccggctaacaaagaactactccctcattcctattcaaattcgtggtactaaaaatgttacacccgatcaaaattattataatatgcaaaaaaaaaatattaaaaaaatatttgatctaaccatgcaactaataggtgtgacataacatagtaaatgcatatttgatcaaaccttataatctgatagtatgtttttacaaactaatgattaagtttttatttcgacgatacagtacttgaaaaaacaaaacaagtagatggcttgccacagaagcaaacaaccgaaattttcatttgtagtaatattcttttccaaaattaattaaatagtaattctaaatagggattttgagaaataggaaggacgccagttagaagagcgtccacatgcggacgcttgggaggatagcgtccagttcgggacgtagtttgtaacagcgtccagctgtttgggccaaacacagcatgggcctgcgtccatgtgcatgggagcacacagtaaacacttatataaaccaaatctttgaacatccacgtggtgtttactgtttagcttatagtccatataatttgtttagaacaatcttatactaacagatattgaacaaatttagtacttcctctgtttcacaatttaagtcattctagcattttccacatttatattgatgctaataaatctagatagatttatatgtctagattcattagcatcaatatgaatgtagaaaatactagaatgacttacattgtgaaacggagggagtagttaatttcagtagtatgcatattggcttcggtcctttaataacgcagtagtctaataaatccatggatagtttgtagccgttttcaaccaatagataatgtcaacgagctagctatcaagaaattccaccagcaacaccacatgacaacaatagtataaataaaaaacccagggtttttcctcaattgcattagcatgcatttcattgaattgtggtggattatctttttttttcgaacggtcaggccgttgccgacgttttatataaagaagaaggtgtctcattttaaggagaaaatgagaccaaaccttacaatgcatggttaattagggaaactgggtgaaaacctcaacactcaaacctaagctaccaacaccgcgaaaaaagaaaaaatggcggagcccaaaacagccatcgataaagagcttgttgaaagcgacacaaaggcttcgacttcgcgaggcaagtgttatcgttgccgagcttgtcgcctagcgacacaacagcttcgactccagagctatcacatcatcgttgccaaaggcatcgaagaaaacgagcaagacaccgaatgtccactttgaacatcagcccaagccacttgagcactactacttgtagatagctaacaccaacctccctcgaaaactgcaacgtgttatcgttgccaagcttcatcgcatcccaataaagcagcttcgacttcaccttgaagaaaacgaagaaagttggatgcttgccacatccaagagcagcacccaggagacgaaggcctcgccgaatagctaggcttatagagctttgacatgggggtccattgtaaaatcaaaggtgtttttgattattattctgtgatgaacaattggcatcggaggttattggttttgttatttggaatttattcacgaagtggttttggagatgattggattttacaggtgaatggctcctggctctcctcaagctaaatacctgccaaactctttttttttaccaaactcttaattacagtacaaagtagcacacaagagttaaggatgtgtttggttgggcggacgcgcgcggcggtggatgcgagcggtggcggcggcggacgcactgcggcgtgcggcggcagatgcgggcggtggggtgaggaggagcggcggcggatgcgcgcggcggcggcggcaaacgcaggcggcggggtgaggaggagcggcggcgacgacgaagtggggaggagaaggagcgacgcccgtgggagaaaaaagaagcgcgaaccgttttttgtgtaatggcagaggtgggtaatttttcccccaaaagcagggggtagaggtgattttgatttgtactaccttaaaagctggctttgggcaaaagcagctgtagcttttgggcgctttggttggcttttggctttttcaaaaccaaaagcaggttgaaaagcccaaccaaacacaccctaagggtgcattacgaattgattctcggattggctactccctcacctatcataagcacattatccgaactgctaaaggatatattttttcaaaatagcattttatataaaattacttaaaaattaaataaatctattttgtttgtactagttaagtttcgggtgtcattgaaaatatgatccgaaaactccaggatttttgactctgcgctctcttttatctcaatgattctggagttcattctcttagagggtcatctgtggtctttagctagggttgccacttttgggaatttcttgggagcgtagcgtggctctgcccctttctattgttatgagttgcgtttagccgcctgttaacgccaaaatttggtaagcccgaagtcatcatcggtttagagtcagtatcgactttagagtactgaaatcagccgatgggagtcgtcaagtcgccagcagtcgtgttcttgatggagtcggatcaattaaaggaagcttatttaagaagagtccgagttcaaggaggatgcggcatggcaagttatctattaattaggaatagtttattagttttcttttatctttaagaaagtgtgtttagtgtccgataaggactttatgttttccttttatctttaggaaagttttttttattgtcctgcaaggactagtatctacccatgggtataaatatgtacacccggggttattgtaataaatctctcgatcaatactactctcagcgcatcgccaccctctttaccgaggtttttacttatcttccagcggaatatggcacctgacgcggggctgcatcggttcagttcgatctccggtgaaggggtaagtcctacgttccactggccctggtgaatctatcggctacattagtgttgttcaaggctgcattgcttcgatctcttagatcgctctggtttggttgatatatttgtctacctaatatctcaattctatttctagttgcattgtgtttagagacgcatcgacttagttgtgactgtctcggttaggtccgatcttctgtcttagccgatatatctctacaatcacaatgttgttgtaaatagatttgttatatccatcacattagacaaatctattggctcatcgagtattagattattatatacaatttcgtgctgcatcggttaggttcgacctactagattgttgttgataatataaatcttgttaagccgataggttcatactagtgttttatcggagtgctagccgataagttatccggacgttgcatcggtttataaggatcgcatgtacatataatatataagttggatttagccgatgacaacaaaggtttcattgatctatctaatcttgtggatttaataacatcggacctccagccgatgtatgctttaaccttcggatcgatgctcatctatagtatatcacattgttagccgattggtttctaccggattatattattgttatattgcatcatcatcagccgactgtctttatattattggacatattgctgatagctcaaaaccctatctctatcggctgacatcggcatcggctggaattactccatcggcttgtcagccgatcggttgtttgatctgttgtttacatatcttgtcagttgcaggatcaaactgactggcacgcccgcatctcatcaaggtcttggacctgcactggagctaagcagatctcccaggccagtgtctgattttcgcatcaacaccgccatagtagttttttcctaagcttcagtttctgttttgttttttctcccttcccttggcataagctggtatggctgattgtgttgtgtaacaaaaactccttttcttttaatatattgacgtgcaatctttttgtgcgttcgcgaaaaaaatatgatccgacatgcatatttaaacgagaaatttgcatatataccacggttaaaaaccggcttcactataataccatcgctcaaatgggattcacccaaacgccattctcaagatgtgggcgttctctacaatgccattttcaccatttgttgcatttccaaaccattttccaccaaaataatattttggctgaccgttttgaccctggaactggttgaaccgaaccacacacacgagggacgccgctgccgctgcccagatgtgccgctcgcctctcaacacgatgatgcggcctcctcccccgccatccgcgccgccgccttccccgcctcgcgccgtcttcccctcagctcgctgctgccttccctcacctcaccgcttccttccctcaactcgccggaagcggctagtgacggtggccaagctggcgttcccggccgagttgaaggcgcacacattgcatctcgtcgacaacggcggcgagctcatgctcgtgcaccactgcttcgggacgacgcgccgaggtgcgggcggcggcggcttcaacctattcaacgatcgtcttacgagtttctactacacgcaccgagtagatctggacgcgaagaggaggagagcgctacgcgtcggacgtacagcacgagacgaaaaatcggacacatccacgagcagtccgatccgcgcgcacgccatccgccatccaacatcatcaagcatgcatgcatgcaaaactattttaacctaccttttctcttaaattatttattcaaattatgatccgattgtaccattaaattcgatgcaattaaatctttaaaacaagaccacatatgaatatattccggtgaaaaaatattagcttattattgaattatttttaaatgttgcacgctgttcaccaagtatatcagaattgtttcactagtagatcgaatcatcgaaaatgtttcaatcgtttaaatcggacgttgtttcaccttatataaaaacattgtttcagcaaatagcgaaagaatgtttcaagtcattgcaacatttgatctatataaagtgaaatattttttgtggaacaaaaaataaaacgaattctcttaatagatttccataatatgtgggtgatttattgcaaaagaattttttaattcacggcaacattagatctatacataaacattgtgagtacattaggtgaaacatttttagtggaacattgtgagcacactagtggatacttgttgaaacacttaaccaacatatatatgtaacatttacgaataaaccagtgaaacacaataaactacttactaaaacatacaaatagtaccatgagatacattaaggaaagatatatacatcgcgacactaaataaatatgtgcagcataataaaatttcagctaaaacatctaattttcatatgtgaaacattaagtttaattggttgaaacatatgtgtgtttttttattataatatagtcatgtgagatcttgttgtaaagatttaattgtaacgaatacaatggtataatcggatcgtaaattggatgagtaatttagaagaaaatcatttttcaagtttgctaaaagggtgttatgtacatgcaagtaaccttgtatcatctctctcacgcatattaatacctagaaagaaagcacatgtaagagagagaggacctgacaaaagctgcatgcagcaaagtcaaagaaagatgtgtccgatttttttttctcaaaatcagatgacgaagcattttccccgaagaggacggtgtcttgccgtgggctgggcgtccgccgccgcgccgcgttcctcggcaggaaccgcacgctgtccgtgtccgccgaggtgttccccgccattcgcgctgacaccatctatctgcaggggatgcctgagcaagaagaggctcacctgaggtcgtatgcctgagcgctccattgattgggccaacccggctggcattgttgactatctgtgcaggtacgtctcatgcttcagctgtggatgaattcattcgtttgttcgcagcgattctctgtcatcgccatgaagaagcagctgcaagacgagatacagcaacatgaagaagcacacgcaggtgctgggctggaagcctggaagtggaagggaaggccgaggggagctcgggctgttaattccaagtatcatgggctggaatgggccatgtaatagctaaacaataggtccagtaatgtgagagaaagagtggttatcacatccccgatccggcaccaccgtacaacaacagcaggatgcaccacaggataagggtgtgaaccgtcacttgcgaaacagcaataccaatccctgtttcagggtatcagcccaaacgtcctgcttagccttttgtagctaaaacttccataatgcgtcagttgaacaccaaagtgaaagcaagaaaattattgcatgtccaattatatactcctaggttggagacttgagcatataaccactctgaacctgaagtgtgacttgaaacttgtaccaatactaatgccatctgtgcagtgtacatgttattttaagttctacaagtgccatatgccacaagctagtcttctgatgtgttcctactgctgtcagtaaatggccagcatactactagtcttggtcaaattttagtcacgtggttgaggttcacatttgttttagtacaaccaaaacaaaaatgatacttcaggtttattcaagaaattctgccattggctgatgctgataactagtgcctagtggctcggcagtattatattttcctgatgttaactaagagttcagcataaagagcatatggtataccttttgcaagcaacacacaatcgaaataatatccaaccaaacgtattctagtttttcttgtactgattgtgatacatgcaagtataatcatgatatgactgaacagatcagtttgctgttcgtgcagatttggcgaatccaaggcaggaatttcttacacctacacaatgccctttccttaataaattctaattgtagagattttgttcagatcatgataagatttgcaagtgccactctgtccgttgatcttttctatatagtttatgatcaagaccatttcagatgtggtatttggcatctagattgacagaatttatgggattgactgtgtttctgactggtctaacagtggagtggataaatgtttatgcttggatctattgcatgacagtgatatctaggcagcaatgcttccaagttccaactgtctcagaaaagaagacaagtcaaagtctgaaacccagtctaaagaagcaaaggagccacaagaaaagatgctccagcaataatgccccatcccagcagtcaatactcaatagagtggaaaacttgaggaattcttgacaagaactaatacaggtatcgaggaacaactccaaaaatgatatttttcagctgtagtatatagattgtctgaaataactagacaaaaggtgaaaactgttaagtcttttgtccattctgaaaagcacagacttttctcttagcacgttttctagaagtatgaaaaggatgaagggctgcatccacatagtactccttttctcttccttgaggtgcatgaacttctatattgggcatggctcagacttaagatgctgtagaaacttttatacgtgtgttttagcaatacaattgccaatgctgaaaaataaaatagaaaatgtaggatcgaatcacaagaactaagccaaccagagggggggtgaatgattggtatacccaaaaaccgaaaacttttagcggaaataaaagttacccttgaaatcgacggatcgcggtctgaccgaagttgtcctgccggtctgaccgcctggttgccgtcggtctgaccgcggttatatctccggtccgaccgccgagatcagctgatgctcgctgtcgccgccgccggtctgaccgccgtgctcccgctggtctgaccgccgaaacccagtaaacacaaatcgaagaactcttaaagtagatgatgactttattgattctctctgtgtttacaaagtgcaccaacagcactccttacaaaaatttcgactaaactcgaaaccctaactcaaaactcaactcaattgctctcaaaagcgataccgggaagcctcacgctccccctctatttatacatgaggtaggcagcctaaagccacgaaccaaactcatactaagagtcctaaacaccttaggaaaccctctagtacaagaaagaaactttacataatcaatcgtaccaaatttggactccttccaaattcgactccgcatcccatacgcacacaataactccatcgtatgccatatggaatctccatcaaccacgtgcatcaactctagcctaagtatctcgcatgatctctgaccaccacggacgtcgtcttatccccaagccgactcccggtccatcaccgcaaatactctcccgagacatcgagtcacctacacatggaacaaacaaagaaaccatattccgagaccaagctatctccaacttgactcattagcagcaaacaatagtattacatacgtatagtatccatctagaagtcataatcatgaaataaactcggatatccaaataaacaacccgaaaccgaaaccgacacagtgtcggccggtcagaccgcgggctgcgccagtctgaccgcgcattacatgccggtctgaccggctaccagagctcggtctgaccagtcacatgaaataatgaatcctgcgatcacctgtgaattcaatcatctccaaaaccacttcgtgaataaatttcaaatgacaaaaccaataatctccaatgcccaattgttcatcacagaataataatcaaaaacacctttgattttacagaaaacatcaaaatcaactttaaaattaacttttaaaatttaaattttggatacggctgatagaaaagatggaactgacgatgcaattgccgttcttgcctctatccctatataagtgcatttttaacactctagttttttgtcaaaataagtcacttctaatgtactacatatcctatcaatcacttcttatttaaatttctcttcatttacccccaaccaaccaacactaacatcccttatttaattaaggggcatataagtcatttattttatctattccctccgtctcagaatatagcaatttagaaccggatgcaggggcggaggtagagtatggaagggggggcacccaggaacccggttaagaaaattttttagttataactcaccgattttcaccatgtgtgcaccccctcaatataaacttagatacacgcatcaacttaaacttgatctaaagtagagtaaattaaataagaggcactatcctctatttcgttctagctccgcgccctttggatgtgaccaaacaacgttgaagattcagacttgcatgctgacatttgcctcatgacatcacattacccggttcaatccatcacgtggtgatcctcactgtcaccaatgatatgcaagcatctagtaatcattttcttctcaatcgagtagaaatggtaccaatcaacctcctaaatcctgccctgtgcatgcatacccccaaccaccagtaagtactaattgtgaataaaaatacttctgaataaaaccattttcaatatggcaagactaactcaaagaaaacagcataaacattacattattgcctgaagattacatacatgattgtgaaatccagccatatccaacagcaatatcattcatttctgtcctcctaaccaaactagcattactaagtctttggagtggtcaagttcatgaatgtgaggtacgggctgcattattaattgagaggcccttaattgagacgatatagtaacagtagagatttttctgatagaccagacaaatgaacaatcaaaagctactagggaagagaaaaggtaggaaaaggggaatcaaagcagaacaaaagcttgaaaagatagtcgagtcatggtgcacgaggagcaacaattattttccatccttcgttaatcctcacgcagaataatcgtgtaagaaaagaccaaggcgtagaacaccagaatggctcttcacctcgttgttgaaactctaaaacattttttgatagtgttcaaaccatttgagaggaacaggtcgatcaaacctatatgacagcactaaaaaaacacttattttctcgccggaccacaaaattttacttttattactaccttttcagccatgtttcagtatcatgtagggaaatcaaagattatgagatgaaacaaaaacagtttcgtctgacaggtagataggcacagcgttgttgaccatggactgctgatttgtcacaactcacaacccagcggagagccttgctctatgcaatgaactggacacagagcgatcaacaattaacaaaagaatctaaggcaaaaaaaaagacgaagcatcaaaacttgaggaatcccaaagccaaaatggacacaaacaagagcagaatccagagcgcagaaaattatcgtgttcacaaccctgttgcatttattttttggaataagaacaaccctgttgtattatccatgtactaaatgttttatctaacatcgtagtctcggttaactgacaggcattgacctgcagtttaagggttcagagtgaatgcatgagctttggccggtcaaagcctgtcagtgtcagatcattgcataccaggttgtcatggctggacgctactttgccatccggtgtgaatacgcatcatccatccatcatcacatcagtagaaatggccgccccttcctcctctccatcctctatataaaggcatgtatgtgactgcagattgcagaagcacagaagaagatactactactacatagtagtacatagcactagtatcttcagagagcaggaagaacatagtagatagagacatagagtgcgccatgtatatctgcagtctgcagagatgagggaggatgtgcgttcttgtggggggtttgggccctgtgatcaggagagatgacaccgacatcgccggaattcgttcttggtcttgtgccatgatgaattgatggtccgtttgatgcaggtgtcatctcccctgaacataggactgactgaccctgaatggatgtgtacctcgatgattcttcggtttcttctgttctgttctgttcttgatttgcttttacaaggtaatgcctgatgctagtatgcaaatgtcagcttgtctcctcgattggtttctctttccatgattatctgcaggtgataagagttgattatccaagctctgacatagacgtgtgagaaggacataggttgcggagtcaaccacaaggtttgccatccactcttgccagggcagacagtaatttaggcgtcacttagctgtaaaaacgggaataccattaactactgcccagaaaaactcggtgtcttcattgacaacacatggtgcattctttgtttgctgcgtggtcaaattttttgtgttacctcatacggtttatcccatcttaggtaacttcatatccctcaagaacatggcgctctatctatttcgtgtaggttgtctgttaaattctgatttggttttgcacttctggttgcagggaagaacagaatcggagaatccgcaggcgagaccgcaccaacccgagcgctgcttcggtttgggccgaaacgattgagcggccaccgttcagctgcggcctgcgggccttcgggccacacggcgaggccgaggcccagcacacgcgttctgaagacttctcacgggctgtggcctgtggaggaagcaaactgaatgccgcaccgcactttgtactgttagcgctgattaatggtgtgtcatggataagtgaatattttgtaaaaagagatttttctgcgaattcaaaaatcgtactgtaccacgttatgtttgttaagtgcagagtgcacctaaaatctttaaaacatatggtagaacaacatgaatgaaactactgaattcagtggaaaaccataaacgtcaaatccgccgtgcccgatggcctgattaacgggttcttatttgtttcagaatagtgaatcagtttgaatgtaagaaaaacattttttttaaccccgcaaaaaaaacatttttttttaaaaaaaagagtggtgaacagaagttagctgccaacatttagaattcccattgataattcattaattcatctcccacaagtatattattcttcatctctcacgacagatcaacccatcaacatttcatcagttagttccacatgaacaccacagggctcctgacctgatgcttccgattctcccacgagatgtgcccgaaatcccagctctggttgacgtgtcctcccgccacgctcgtgaactccaccgtgtagctcttctcctcgttcttctccttgaactccagcgtcgccggcctcacggtcaccttcacgccggccggcgccgacacggccacgctgtacgtctccggcttctcgtacaccttggtcaccgtccgcgttagcgtgcggacgcgtgtgctgccgttgaacgcgacgacgaacgacgggtagttgaggttggccgggccgccgccggggagcgccggcgcgcacccggccgtgtccgggacgaacacccgcagctgctcgacggtgtagttgaggctgcagaggaagtcgacgtagtcctccacgccggcgtcgtagacgagccccgggtccacggcgagctgcgggcggacgtgccccgcgccggccgccagcggcgtcgcgctcgtgaaggtggcgttggcggcctcctggacgccctcgtcggtgatgtcgcggccggtgttgtcgagcgtcgccgcggtcgtcatcatcgcggagcgtatcatggccggcgtccagtcgccgtgcctcttcttgatcagcgccgcgacgccggcggcgtgcgggcacgccatggatgtccccgagaggatgttgaattcggatctcctcgtgtccatgttcaacatcgacaccgggatgtcgcgcggccaggccgcgaggatgttcagccccggcgcgagaacgtcgggcttgaggagctcggggacgacgcggttggggcccctcgacgagaagcccaccgccgtcggcgcacggttctcgccggtgaccgtctcgcaggcgaagctgaacgacgccaccgggctcgccgccgactcgaagtagtccatgagcttctcggccttggagtagctgagagtgagagccgggagggtgaaggcgtcggctaccactccgtcgccgtgccattcctcaccttgcatggagactagcccggcgccaccggcgttctgcagcagcatgccctcgtagacgccggcgaggcacacgacgatcttgcccatgacgacgtcgggcgagagactccactcgtcacaggagtccagcaacaccagcggcgccatggtggtgcccgtggccatcttggtgtacagggactggccgacgagcacctcaccgttgccgagcgtgaggttagccgggaacagccggtccacggcgccggcgccgacggtggtcatccacggcgccacgttggtcacggtgtacggccgagggccgctgttgccgccggcgagggcgacgaacacgccctcccgctgggcgccgaacgtggcgatcgcgaggctgtcctcgtagaacgggatcgggaaaccgccgagggagatggagatgatgtccacgccgtccttcaccgcggcgtcgatcccggcgatgatggcggcgtcgctgcagccccagttgccgccgcacttgtacatggcgatcctcgccttgggcgccacccccctcgccgtcccccgcgcgaacatgaagaggccggcgccgtggacctcggagccggcggccgtcgacgccacgtgcgtgccgtgccctacgtcgtccctcggggaggaggcgccgccgtactcggcggcggagaagtccttggcgccgaccagcttgttgttgcacagcctggcgccgagacccacgcacccgcccttccagctgcggcggacggcggcgagcccgctgtcgttgaagctcgggttctccggccagatgccggagtcgatgacgccgatgatgacgccgtcgccgaactccgtgtcgcgccacaggccgtactccgggtcgaggccgatgaaccccggcgacctcgtggtctgcgggtagtacatcctggcctggtgcaccgcggtcacgccgggggcgccgcgggacaagctccgggcctcgtcggcggcgaggcgcacggcgaagccgtgcatgacggtgtcgtaggtgtacaggatgcggccggccaccgcggcggcggcggcggtggcgttggtggcggcgcgaggggagtgcgtggccaccatggagatgtaccagtgctcgagggtggcgaagcgggacggcttgaggaggtggttggcatggacgatgtaggtgttcgacagctgatcaggcttgtgctcggtgcggttcttgggcttggggatgaaggctgagtgggcgagctgcgcgaggaggaggaacaatgccaagcactgcaagggtttggaggtcgtggacgccattgttgatgggtgtgtgagcgagcttgtggtgaaggaatgcatgcgtagtaatggcttttatagaggcgggatgaaaatcatttagggcttcttgccaagtgccaaactgtcactaatcactgtcacacatccctcagaaaaagggaaaagaggacacttgaaaattgaaaaatagtgtgtttgtttcactgaaactgcatgtcagtatgtcaccaatacttctccatgcatatgcatgtgaaacaactgagatatactattatcaaggggttaaatgatttttaattagagcatttaatcatctaagtgagagctgagacaaattaaaaggcacctagcgttgaagtatctacttcatgagagaaactaatcagatctatattgtttgaaggtttttcagacaaaattaagggacctaatgttcaactgtcattcttctgaaacaacctaaaataaacttttgaagttaaacacccagaaaatttgaagttaagcattcataaattgagattgtggaagttaaacttctaagtatttattgcatgtttgttgtcttgtcaactgcaggcaaaatttgaattttataacttgatttttaaattaatttaggttttttcatcatagactattttcgaacatggcttttaagccactaatgacatagatataaaagctatccataaattattttatttgctctgtgctgttaatatacttgctggatgaattggaggaggaagcaacggtgaacgctctgggctgtgaaacaaattcagttggaactaactaccacactttggcagggaacagggcaacagaaaaccaggccatgcttggcagatcataaacatttagatagctctaaaaaactccaacaatttcgattatatcatggtgactaggccacatgaagcaaaacttctgtcattttccgtttcctcctgggatagatagaaataagcttgtgaatagcaacttctgctccattattcaggacgaaacgggctctccattgttcagaatgaaacggctttctccatccttttgtcttttcttaaattttgacatgcttcagttgtattgcgttcaaccagttgcataaagtatgtacattcccagtattcctgtgcaaactgactttctgttgagatacaggtaatcttcaaacagccagcaatagcacctcaaagctgtttcaggtgctatttaccacaagaaaaaaattaattggattctattcgtatctacattctacagagtctaagaccatagttatgtaagtctcatagtgatgttgcagtcttccaaaatcaaaaccccaagtgaaatgcgaagcaataaaaagaccaattcattattttagtaaaaatagctaaatggtaattcaattacatccaaagcgaataaatataaaattagcatacaagctatgtattcttgtgaacaatgcggctaggctacatttgtaaggggattttggattaacttacacaggattgtactcccatgctacttttggtacatactcaactcgttgctgagtacctttcactgtgtcatctataacttaattcagaatttcagaccaagtcaaaatgaattgacaatgtccgagtttctttcctttcgagtcgtataactgtactgttgttaatagctccagcctccagcagtggagtcattggccgttggacatatatacagttgcaatggaagtgctaccagcagagttatgcgagaagaggttcaactaaaggtcttcgccgagtgtcaggtaggtccatcgtataagctattatggctgagagcagtgaacaggcagctgggactaaccccaaaccaagtcttgtaactgaataaccaaatgccaactctaggttctgtctggtattggtacttcctgccatgcaaagtttcaaactctcagcatactgtaaaagtaccatcccaaatttttttgatgtatcagtgccatgataatagtaacagtcattaccttgataggactcaagaatatacagagctagtccgcatgacactttgtcaacaaaacttaatgagccatacacaaaagcacaaccatttagatcttcacctactaaaattccttccatgctgatacttgttacctagtatcaagagaaacagtgaaaagatgtgaacgatgagaagagaactcccaggcataacatgattatgtatggcatatggaaatttggacaaatttaatcacaaatttacatgataacacgctacttaaaatcaagcagctgaaatgcttcccaataagctaaccaaatgcagatgatagacatacagctttgcaaggttaaaaactacacgatggaaaatacttctaagctatattataggctaaaaatttgccatagaaatgttttagtatattaactctttaaaatataagcagaaactgaagtttaacaacttactgtcataagagcattggcaactcctattgtgattgatagtgcatacatgaagttgtgcattccacttggtagaacaacaattccaacaccagacaatatccaaagcatggccccagcagaaaagtaattttttaaacgccaacttgaccatctagtttcctagaaacaataaaaattatgttaagttgagtagcaaaatagataattaaatactaaggacatgctctgacctgtaatatgacagatactatcaagctgcagacatagataatagcaggtacctgaaatatgaagagcagcgcaaattaattcgtgaaaatccatattatgacattgaacacaaaatcatctaaaatggttaaagtaataaatgaacaatggtctaatgttgatataattcagattattttttctagtctcaaccattgaagtcccaggattgaccagctagtgaactggagtttatacatagctagcttagttatagcatatgcagtgagcttcagccagattagactattcatagttcaaaaatttggcacattaattagttatattagactgattttacttatttgggctgacggtggcggctggacggtggtggctggacgggggtgtccgtggcggtggtggtggcggtggcggtggtggctgacggtggcggctggcgacggtggtggctgtggctgtggcagtggcggtggcagctgtcgacgatggtacctatggcggcgatggttgaaggccatcatccggctgacggtgcgtcggcggcggcggcggtatgtggaggcggggaaggggtctggcggcggggaaggaggagtccgggtgcgggagcgccgtcgacggcgggaacaactgtgggcggtggccttggccgaatcgctgaagggacaatgttgttgaccgacgacgatccttcttgtgcggattggtggtgtgggtttggacagggaatcgcgggcgaaagccttgccgagccatttggctggctgacaaccgcaacgccgtttggcgtcattcccctccttggaggcgttgttttagcatacccctttcctttccctaccatattctccaggtgaaaaccttgcttcggttccgaacgagcggtggcggcgatccacgtcgcatcctccttgggggcaccgctttggagaaacctcttcgtgcaaggatattgtcattggtctatgcattggcttcgaacttcagtcctaggccttgacgaggccttctagctccacattttgttttgcttttctcagtttgggtcctctctctcttgtttggtgtgttcaacttgtcttgaactacactctcttctggagtggatctttgtaataattggttgtagttctttttgagcaaaggccgggatattatattccattatctaaaaaaaaacttgttgtacaattgcatgcgaacaaccatcccaatgacatattcaacaccagcgctagtgtaatacatgagataaattaaataaaacaacatttacaaagcaaatatatgaaaaagaaccttaccaatgctttggatgattgtggcatttccaaatcatttatgacgtagaaagcaagaagtgcctgaccaaatacagaaacgttatagttgatgtgtcctctagctattagttcaaagcataaacaagagcattgtagtttaaacctagtgaaaaaggtaatacgtcaatatacacaaatactgcacaaataatcaaacaaaattcccattatccagtaaacatattagaaacagaaaaatgctaatgcatcgtgagaatgtgcttctatagtatgtctcaaaattagtatgttagtagagaatttcacagaaaaaagaatctaggaaaaaaagaaatatataaagttcatatataatatccaccaccatatttaagcatgaactagtcaatatttcatcccaaaacatacaaagtttttgctgcataataacctatgcgtgaatttggaattacatgcaaaagaatttactatgttccaccatgccatggtccatggaacacagttaacaaggtaaactattttggagtacaatacattaatctctacgagatatcctttgtcatacagaataaccatatgcagggacgaagccaggatttgagattaggggggtgtggggtgaagataaaccatgagaccgaataactagtcctttaagaatagtcaccgtcaataacaagcaatgcgtaaactagtcctttaagaaaaacttaaattttagctctttaataatatcattggaaatttaaaactagtctttattgctaaattcttttaatataaactattaaataatctcacaaataagtatcatctattttactttgaaaaatatgagaaatcacaaactaattttgtagatcatgtctcttgctaacatttttagacttgctaactaattaaattgataatactttcaagctacacaaaataaattagataaatacttatcttagctaacttaatatagagtaaaatacatgagggtgtagtggtggtagtgtttggataggggggtgttggcaccctttggcaccccccttaccttcgccactgaccatatgcttgaaaataaacaagtgatacaaggccattatatacatggaactaaaaatgcattatatttttatcaaaggaaagaagatttcagtcccataagaaaaataggaaaagattatagatacctgtgaaacattggtaaccaatctagtaaacatgtatactagagcaacttggtagtacaatactttcttgaaccagtgggtccatgaaatcctggaaagtctcttattctggcaatgctgatttaacctaaaaaattaaaagtcattcaaatactgcaaaaatgaggaaaacctagtggaagaaaaaccatcaaaattatatggcctttaaactatgaactccacaagtgttttttatcttaccctggctcttccgttccaatcaagaacacaacgacgaaacaagatccaagggcaatggacacatatgctatccatcgatactgaaataggattccaaaatttaagataaatccaaaagatcaggcaaatagtaaaatattatcttaaaacaagagagtacctgaactatcacgctcactgactgacgtagactaaatatcaacaaagcaatgccatacaggctaagatttgcgatctagcacgagcacagaaaaggatcatcagattcagctcttttgtaatacctgagttaagaataattagattaaattaatgttctaaccattgtgaaggcattacggcagcttactaatgcaacccgacttgttgggtttgatgtcatgcagttcaccattgaccttagaaaatacgcagatgatgtacacaagtcaaatgcaggaatcacaagaaaagaaaatggagataaacaatgaaaggaagaggcattacatatgagagacctgagtaactgcccagccaacattgaaaatagcagcgaatgtgctatatccaacagtctccattgtagatgaaatagttcccgtaagtttgcaaggcaaacagctaccaaaaacagatgagaaggaaattgctactaaaatggatcctcctgcatgccacagtttaaaatgtccaaagcgatcaatctggataaaaaaaaaagaagatagaatttacatatctagtttggaactatacacaataaacacaggaaaactagtagcgaacgtctaagagaagataagccatgagaatatgatgtcacagctttataacaatgctttagtaaacaatcatgttctttcttaggtcgtaccagttctccaacgaagattgttgcgaagccatctgccaattgaccagaaagcatgacaacagcagcatcactgaaaaggtgaataaaaggtaaaatgtctaaaagaatcctgaagcagcacgtaatcctttcaaacttccaatgtttctcgtagaaaatttctttcagcatctctgatagaacatttctcgagatacgaatacaagtataatgttctgatgatctggtccaacaattccatactgtatgcagtctctacggcatgtctttgatcataaatgagccaataatttccaaaaaaaaaaaagtcaaagttgctaactttgctatagccgcaacagttgcttggacatcatgaagttgtggctagtcttaactcttaagtggcacaataccaataatgatgcaaaaaattcatccgaaaaaagatgaccaatcgttacattcatttgcaggatatcccggtgaaatatctattgcaccacatttaggacatcctgactttaaatatgaacctatgtttttgtacaattcctcatcaagcagagtggattaagtgtttgaaaacaactaaaaaaagtgcactaatggcttcattcaatatgatttagaaatatgtgtaaataacatgatacaaaaattaacagaacaaatggacaacaaaatctatccctcaaaggcacataccttggactaagcccaatatctgtcaagaaaaccagcaaataagtaaaccaacatgaagaagtgatgtcatttagcatatgcccagaaccatatgaaagtattggaactctccctaatggttcatccagttcttcaatcgatgactgattatccattatcttaaccatattttatgtttgccagactaaaggtatcacctacacaaaaaaggaatacatgttgatttcagtatgtaactagcaatctcaatcccaactttgaataaacaaaacaataataaaatgccattttgccaaaagttaaaagttttgaaaaataaaaaatgcctacggtcctgcacactattttagaggcttgaaaatgaagttgcttagcttacaacgagtgtaataagtcaaaccgacagactttttattcagaaacatcaactgaagttatataagaagatagttggtacgtcatgactggcagcataacagttgcttttgtagtgcttataacaaggcttcaagctatgtcagatggatttgagttttattccttaactagaaaaaatgtctgtgcgttgcaacgggtgaaaactattttaatcatgagctgcaattaggagtctgatcgtatcaagttagcatgcgagttttttaaagagatatctatacggctccttctgtatttacaaaagcgaacgaacttaaaaaccgactcatacacggatgatgtaccaaagtaccggcaaaaacatcttcaatttttataatagtagagatgtatgactggtttttactgactgctgtaaaacacattacatggaccatcttaaagcagcaattgatatgactactgtacttgctaacttccaggaaaaaagttcaagttgtattagttcttacatatatgagaatcatgaaatgaatcaaatgccaatctaaagtggtgggcacaagaagataaggagataaactgaaggttccttttgttgttgtaaagttttttaaaaaaaaaaaacagcaagcaaatttcaatcacaatggtaatagatcagcaccttcagaaggttgggatgatatggatatgatcaagaatccccaaaggcattattgtagcatatataccagttgactaaaaagttcagatttgaggtaaaagcaactactctgcacacaacatcaacagccacccaaatcaacgtgttatcgctgggtcccaactcgaatcatcaacgaggagtatcgcaagtgcccgaaagctaaagataaaaatgcaatggcctacaaaagaaatattcgcatttccactaactttacgagacatcaacctgatccccctttcctctctgcctttccttccaaaaattgatcctaatcgaacacaacgcaggagcccacacatactctctgcctgctccccccacccaacgtagcaactgacattcgaaccgtaaccaaacaaagttaaaatttaccaaatgaagaaaacccaattttcgcggagccccatgcccgtcggaactccctccaaactctgctacacccaccccaaaacaacacagagcagcacttccatggctggccccaactccatggcgagcaacctctgtgccttaagcccgcaacagactctacccatccaataaccccggaacaatccagtcaaacagatgccgcacatgctcacctcgctgctgctgctacggcgaggaaccggagcgaaacacctccctccgcaagagcaggacgtacgggaagggcaaggcggaggaagaacgaaggcgacgctcggtggtgtcgcgtggacggcagcaggaggaggagaggagaggaggaggagtgggcagggagcgagccgtgcgggaggaggagacgcaacgcaaacacggaggaggaggaggagagaggaggaaccgagggaaatggaaggagactgggcgagcgaaaggcgtggctgacgcgggcccccaccaccgatcccatggaatggagtctggactttggagagacgagagcgacggagatttgatttattctaatccttctgtttagtttattagtggcgtcgcgcgcgcgtcaattcctccgttttcgtggccgccgccaacacgcgggacggcgggacggggacgttttgctctcggctcgtgttctcctctgctccctccatcccacgaaaaaatccatttctaacattccaaaatagaattagtagagaataagactaactaaaatatttttaattattaaaaaacataataagactaatatgtagataaatggtattgaagtaaaaaccttctcgttttacgttgatgatagataagatagtagaagttggtttttctaaaataaaatttaaactctataagttgagtttttttacgatggaggaagtaaagctgaagaggtggccgtgaccgtgagttgccttgattaaaaaaaagtctatctatacggctattagtatgcgtctcgagtaattagtactccataaactaagtcatggctgcgtctcgatggtgttttcttccgaataattttgtgtggtgatcatgttttcttctgtctgcaagaacatggggtgggatgggagaaacgtaacgtacgtagtgacctgtagggcttgctttgtcaacaagtgagttgttagtcttgtcctattcttaaacaatgaattttcacaagtgcaaagcacatgaattttcttaggacatgtacaatggaagacacccatagagtaccctcactaactgaaggcactcacgtgtaggggtgggcagatttagaccgaaccgaagaatcgaaccgaaaaaaccgagaccgagaaattcggttagttgttcggtcccagccatcaaaagactaaatttatttcggtcattttggttattaggctcggttaaccgaattgaccgaaattttggctcaatagatctaggaagcacgataaatataaatatatatatatatatatatatatatatatatatatatatatatatatatatttgtgtgtgtgtgtgtgaaaaaatgtctcaaaagaggggaagtgctgttaaaattttcattccaaacttactcctgaaaaatttcagtcggaccaagaccgagaccgaaaagactgaaattgaatttgccagccctgtgtttttttaggatgaaattcagtcctaagttttcaaatactgaaatgaccgaaagaccataaaccaagactgaatttttcagtctaaccgaacgtccaccccctgctcacgtggacactcgtctcccaattaaggccacaactaagtgggttcttcaaaacccgaaacaactggatcaaggtactctatcccacagtagatatcccaatcaaaaagccacggatattaatttcctctcctacccctgccggcaacacgtctctctgctccctctcgttcttttcgctgctctctccatccctcaacttgctctctgctctctccctctctctcaacaaagcagacggcaagccgtgcggatcgccgtagcggatggccccgccccaccctgccgtcggcattgaagcggcggcatcgacggcgcgttggtctcggatagtattgtagcgtattgccataggttaagagtaatattttactaaatccttttagaaagcggcttttacacgaaacctacatgtgacagtagatttctggacagtgtgagacactgacgcaaatcattgattcaaatatttgctgcacaaatttgatagataacgggtgtaatatttcgttatttcactatcattgcaaaagaatgaaagtgctcacataatacttgattgattctagggataaaatggttttctgaaagacttaactaaggtccatggataagaacattgatatcttgtagaacttgcgtttaaacttattttcatctatgagacaaatatttgcattaccacatgcacaccttcgcacacgccggacgccctgcctgctctaacatctctaaccttctcaaaattgagcacatcagcacacacacccatatccccccaaaaaagaaaattacaaagacccatattcactggaactccctccaaaggtcaaactctacagcctctgctcaagtcacccttaataccgacccatgcactatccatgctaagcaatccaacagccattagacatttaattgattattaattatcacaaacttgaaaaatgactttatttgtctatttagaaaactctgtataaaacattacatcgtttgataattcaaaaagcgtgttaatgagaaatgcccaggggtcttctggctagctccacaaggtggtgggctagacgacctgggttcaaagcctcacccctcctaattatttgatattaggtccttccctaatattctagtttttcaaaaagcgtgttaatagaaaatgaaaaaaatgccacccctaaactcactatcgaaggggtggattctcccaaaatctccatgccccctaaacaatccatattcttagattttgtagttatagaatatagaaaataaattcttacacagtcataattcttaaaattttaagcttccctaatatagccttagtaatatgtatagaatcacggatttctaattgaaacaaaacacatccgtagagccgtaaagtagggcagggaagagcaaggtcgaaggtggaaggcacggcaggaggagaggaggtagaagacacgcatagtagtaggacatggattttcattcctccacgacatgatatttcctcgttgtttacctatcatttaaatagtcataaaattttttaaaaaacttaacaatatagattaatacgaaatatagcaccccacaaacacaagaccaaattcgacttctacatgttgtaacaaacagaacaaattaaactgaaaatagctatatatcgtacattcgcatatatatttattattattttacaactagtagaagttaaattttaacttatatgtttgtggagtgatatactttatattaatctatcttaccaaattgtttcaatttttttttgataattatttaagtgaaattactttcccatagtagcaaagcaaagcggaggaggaaacggaggaaacagggggctagcgcgcgcgaaaggcgtggctgatgcgggtcctcccgtcttgggtcaggtgtggatggagattttgtttattggtggagtagtggcgtcgcgcgtcagctcgatcggcaggctcgtccggtcgtcccttcgtggccaccaacacacgctgccgggacggcaggcaggacggggacgttccttccaattccttcgcttgtcttttagccgggagaggtagcggggaagtgttcgctacgagtatgcgtgctcggtgtgtacggcgttcaaatggtctatccaacgtatggttgtaccgtgtttagttctaaataattctttaaacttctaactttttcatcacatcaaaattttcctatacacataaacttttaactttttcatcacatcattttaattttaaccaaacttttaattttaatgtgaactaaacgcacgcttgatcgtccgcaagaattgaggaatacgggtggagtatgtgagaaaaggtagcagtgtgtagagcttgcttcgtcaacgagtgcttgtctacttggccactgtttgttgtcactatccatcgaggatgtcttttaacaaatacacagatactttcttacgcctagttaggagagtttagccatggtagtagtttcatattagaatctttagctcccaaacagcgtgtattctcactcactcaaattataagaatatatagttacatagtctaaaaagtaaactgaaatcagctactcacagaattttaaacaccccccccacccccaaaaaaaaacacccaacaggaccttacttattagtagctgaagatactagactattagtacattgatgcaaggttattatattcctacaacaaaatgaaagtgttgtgtttactcggatgggagaaaagagaagaaatataaaggaggatgagaattgttgttgaggagttgggcgcagtgacggatctatcaagattcttagcatggacaaacacatatggacaatttataatgttatttaacactaaaaatattagtaaagcctattaagtgggatacaattgttaatagaggatttgttggtaaaatatattatttccatttttaaataattatacctgcattatttaactttgaccgctaataatgttagactactatgaacaaatgttatatacttcaataaatatttacaaaatattaaaaaagataaatagtcaaagtttaaatatagatagtaaccgtggtaatctatttgggaatggagggagaaagttacaggagagaaaaggtcacgttcggtggggactcctactcagttttctaaaatttcaacttaggctgtgttctttccacaagtttcccaacccctttccctcgtttttcgcgtgcacgcttttcaaactgctaaatagtgtgtttttttgcaaaaagtttctatacgaaagttgctttaaaaaaacaaattaatccatttttgaaaaaaaattaactaatacttaattaatcacacgctaatggaccgctccgttttccgtgcggtggagttgggttcccaaccccaagtatcaaacacagtagacctgtctagatcctaccctaaaatttttcaccatgtcacatcgaatatttgaacacctacatgaagtattaaatataggctaaaaaataactaattgcacatattgcgactaatttgcgagacgaatcttttaagcctaattgctccataatttgacaatgttgtgctacattaaacatttgctaatgacggattaattaggcttaataaatttgtctcgcggtttactgacggattctgtaattagttgtttgttagtgtctgaacacgccatacgacatcctatataatatccgatgtgacgcgccaaaactttacactcctagatctaaacacccctgagatgatgtttgtttggagcagtaaagcgaaaaatgttttcccattacgtgttgaatgcgatgggccgaggaaaaaccacacattgtttgggttcacatgagaagcgatatgcaaattgctcttcatatttgctccttataaaaacaagagggatgacattttgtactgggttggttatgacttcgcattgggctggccagttcatagtgctcaaagcccacaaacaataacgcaattgcgttgtactgcaatctaattacggaggaaaggagttgaaccaaagttttattatactcatggtgattttcttaataaaaaagtaagtgacattctttttaaaaaatatttctcatggtataacacaaggtgtcactttctttttaaagaagctaatgagtcatcgaaaaccctctccgtctgcctttctattgaaactagtcttcagagcaagctagacctttgcagtgcaagaatttttttcaaaattttttctataaaaattcattaattattgtttaaatattataaaatttatataaaattcttgtgttttaataggtggctaaatatataattaaatcagtactaaaatatctcaaacaagcactctgccatgacatgtatgcccttaatcaagaaaataccaaattactggtgttaagttaaaaagttccaaaaaaacaaataagaatagtagtatggcacttcaagaatagtttgagcacctcgcgaaaaaaagaacagttttattgaagcataaactattactcactccggttccgtttaatcttttatagctttaagtaccaattcttcatgttttctccaacaataatataaatcctagttattctcttatttttgttgtcctttttgtggacagcaaatgaccctcataaaagctcaggctggagtgaacaagagcatcatccaacagggctcgaatcatgttgtgcatgtggtcctttttgctctgttttgcttcttcgttgtctatctcttgtcaaagttctctagaagatagtaaatatttagaagataatagtcaggttttgtcacctaacgataccattggttttatgttatacttgtactgcatatggcaatgtagtatctgaagtatgtgttagcttctctgacagactgatatggatataatttatcctaatataggtacaattatattctatgttgtttgtggacacacgttttttttgttttaaatgatccatggaagatgcgagttttttttgggcatttaccaaatttgaattaataatatttttttttcatcattatataacactgccacatcattcaaaaccactttaaattgatcagaggatgaaaggcaaacaatatgcaaagtttagggacaaatttgggctttaatgaaaagtggggattaaggacttttctccttagtcattgaaaaaacaacacgttcaagacaacaaatatgtgatcatatttactgttcaacatgtagcaatataagataggataagaccaatcttagaactacggatttggatggagtatgatccattcccaccaagataatttattataattagactatcccaccaaattattttaggtacacgatgctaccattgaggagcaaacttcaataagaacagggaaaccgcaaatcacaagtcagttgcaggaagttgggtcaaacggaatcgatgacaacaacactaactccagagaggcaaaaataaataaatatattacattgcaatagttaattctcctttattaatactacccccattctagaaaaaacacagttttgcggtttttctatctaacatttgactgttcgtcttatttgaaaaaaaattattggtatgtttattgttattactccatccgtcccataatatatgagattttgactttttcatgcactgtttgaccactcgtcttatttaaaaaaattgtgcaaatatagaaaatgaaaatttgagcttaaaatactttggataataaagtaagtcacaaataaaataaataaatattacaaatttttttgaataagacaaatggtcaaacagtgcaaataaaaagtcaaaatcccttatattatgggacggagggagtagatgataaaacattaatagtactttaagcgtgacaaatttttgttaattttttcaaataagagggtaacccacgactacacgtaaaatgagacggagggagtatcttccaccaaaagggaagctactcgcggctcatcttgatgattgtgctggaggattcttctgtttctctttaagtgcaagtattgcaaggaaacgttggaggaataattagactctccactctacacatttatattttcgtacaaatcctatataataaaacttaacatgcaaaaatatcatattatcctacactaacaattattacatcttaaacctcaaacatgttgtattatatctatataatttattaatattagagctttgaaatgcaagcatttaaatcatcaacataacatttcaatatagaccaatttatttgacttccatatgtattttcatcattttttacgatatccaaagtacctaaccgttatcatcacttagttaatattatttttttcttctctcattaagtcatattatctcagttgcttctaacccttagatgattaatctatggttcgaattatcttctttattttcttttctcatagctacatcatcttacttttatatttgaataattatctaaaaaagctgccgcaagttctttaagggaaaaacttttaaatctaactataatataattgtaatataattcaactataatatataagtattaaaataatatatgcaactttatatctaccttatatagaaattacaatatagttatagtatagttacactatagcgtaattacattgtacttacactacaactatgctatactatagttacatttaaaagttgtttttttagcaattacgatatactatttaaaatatcaaaaaccacatcaacttatataatattatgtcgtttagctatcttacacactattttcacttgttatcatatttctcttgcagtaatgtgtgaggttttacctcttaataaataagaggacgaaaataaacagcacattgcaggggacagtcttgagatgatggatacaactgctgcatcgtagcctattatttacacccacgaggatagataatcagcgatacttacagggtgttcccattccttgccggggtcttcatagcatgagtgttcaatggttccatctgccaggtgataggcttcgatgtgctccaggccagttctatccccacagtcgaagcccgggtagacggcgtcaccaacgatcgaggggaatgtagcaggggacacggatagcgagcagtcatggccgatgaacacggcccgaccaccgagaccacggacaggcaccgtcttcctcccatccaaatccacccggtacgcctggtacaacctcttgttaccacttagggtacggtgcaccagcaacagctcgccaatattgttgtccaccaggtgcgcgctgccgagcatcctgctgaacctgtgttgcaacgtcaggtcggcggcctccaccagctgcggcgtctggctctcccggctgacctccaccaccatgatggcatcgctggtaacgccgtagaagcgacccgctaatgacatgctcggccggagacaatcgctgaggttgaccgccgtccagcacttgtcgccgggcttggcgacggcgaggaacactgtgttatggatcaccaccgtgcggtcgtcggcgaggccaaagccgtccacgctgagatcacacagcggcagaaggaggtccaacaaagtggtgaccggtgggaggtcggtgagctggtgggtgagtgggtttagaaggcgggcgacatgggtgctctcatggagcaggaggacgaggccctccgtggaggggctgaatactctgtggccacggaactccgggaggtgcgccaggatgcactcgccggtggagaggttgaggaggcggcagtggtagcgaatgcggggtttctcggggaggatgagccactgccgcgggtggaagcggcggtccaaggcgtcatccgccggcggcgccgcgcagcaccgccgccacggctggcacacggaccggaagcggatgtagtcagccacatcgttggcgaggacgcgctcggcgatgagccccgccggcccttcaccgagattcgccaatccgtcccatcaaccgattcggattcaaataaaggaatccgatccgaagatagtttagggcgaggaggaggaggaccgagcgcggtgccggtgcgcgcgcgctttgcgccccaactacaccaagacgacggcgcggcggagcaagggcgcaggcggctaacgctccttcgcttcgctcccctcgtcaaggggatctgcgtggaggagaaggagcagcaccagcaggcgtcgtgggtccttgaccgctttgcccccccccccccc

SEQ ID NO: 75963 - DNA, 45909 bp, Oryza sativa
aaagagattgatggagttttttaatagttttttcttttgaaaaagttttatcaaaaacaatttttgggcgatttttttagaggagggaaagacttaacagtctcattattttgcttatgcttatacttataagctaaaatttaggtgagagaggaagagatcatggatggagttttagcagtttatgaaaaaaaaaagaaaaagttttatcaaaaacaaaattttgggtgggtttttctgttgggaggggaggtgagagaagggttattttttttttcaccttagaaaagaacctttttactttcttttatgttgattttattcacatatgccacttttgttttgtagtgggaagtcatattcttatttgtggtagataggagaaaattggagaaatggtttatattttttgcggtttgtttcgtgtctgaatattatatgacgcatagaaaagttctccaaaccaattgatctttttttacgtgggctggacacccaacgtgtaattgttacttatcgattttttttctcccattttattgttcgagcacttgtgctattgaaataacgtacgacaagagggatttctccacgtaattttgtacatgctagttaaactggatgggttatacaactcatagcttctatttcttatatatatgcaattatgcatacaagtgttgatatcaatcaataatgttataatttggtccaaccacaccctaatggtatggaaatggttttttattaatatggtaatttctatgtcatcggacagaacgtgatgtcatgtttttaagctatctttatctttacaatataatacagagtaataaaatagattgtacatctattccctgtttctatttttcatggatcaatgttatttctaagctatttgtgatgaagttcttaatatcatacaaaagaatagtagcacgattttttaaaggataagttggtgttacatttaatcttaaaagggcattgtagatatacacatatctgtatgctttggtcccaatagagatgattcgatgtttaacacaagttaaagtaacgctttgcatcatgtcgatgtctatgtgtatgtttcagtgctaatcaaataaaaactttgttatcctaaaaggaagctgaagaaaaatatctcaataaaaccaccatatcaagttgaattccactcctaccttctaaactcattgtcaacatttcatcgtgtcaaaacctaaaaccacataaaccactgtacgcaagccaacacactaccacaaatctccgaccaatttttctaccgattttcatttgatcacgacactactctctagaacaaaaaatgagccgttttttcttgcctcaaaagaaagaaaaactaattttccaatcatgaacaaaaaattggacgtggaagtgtggaaccataaggaaaattttcttgtggcctaggctcaacgggaggaagacgacgacgccaattgccatcgtcagttcgtcaccaaccaagccgttgctggaccgagcgtgtggccctccacggaatcgtgcgagctcacgcggccacacacgtgtcacgcggggataaagcacgcagctttgccatccattgctacaggctacagcccttgctccctgaaatgttcagaaaaccatgagcttacccgcacaaagagagagaaagagccagtggtggagtcaggaatttaaacctgcgagaaagagccagtggttaagaaatactgttcccagtaataaacctgaaaaaaggaaggagatattaagttttgatttgtggtgtggcaatgaaaagttgaaaacaccagggcaaaagcacaaacattttcattgcctgagaacatgcataaacaggattgaggacaaatcagagagactatatgggctcaaaaggaaaaaaaatgatgcaaaaggaccgagttgtaaggaggtatgggtatatctgcaaggaaaaactggacgcagggaccagaacgtgaattctaaaatgatgatcatttgtgggtatatccgcaaaggtagagactgagggtgcaattgacaaggaaatgtataaaaaggaccgagttgtaagagttggaataggcggaggggcgtatctgcaaggaaaactatgggctccagggacctggttggaaatctcaaaaaatttggaccatttctcgatttgtgcgtgtcatccttgcgcaggggccatgctaatcttctctgtatcgttccaattttatcggatgtctccgaagagacaacacaagcggcagcgcgcggggttataaggtgggttcttcattgttcggtaggcgaggtggtactaaacctgtctcccctcaacgctcccgcgacccaccgatccccatccaacggcccccgcagcgcccagcggcatcccgcgcggtagtacacgctcgtgggccgtatcctccgttacggcccaaacaagcagagagcacactaggcttctctcgcctgcggcctcgtagctcaagtctgagccccatcatccatcgtgaccattcatgaataaaaccggtttgtatatgtgctccttttttttttgtccggcttagttcgttcttgcataacaactgaggttctaagtggcacgaaaaagggataaaacaattaacacatgatgaattaattattaactattataaacttgaaaaatatgttcatttgaatttttaaagaaaattataccgtttaacaagtgtcctaatgaaaaacaagcaagttaagtttaggattgaagtaaactgtaaactatatgtctgaccgcttgcagaactactgattgaccagcttgattgcgtccaaaatcaaatggtagagcgagagccgaaggcaagcccagctggtttaattagcaatcgcctatataatcagctagcgcaacaactgttagttagttggttgttgatgttgtgcttcaagaaatcaattaattaattagtctgttcttattgcttagtgtactacacactcttagctggagccctagccatgggaagaaattaattaaatccccagataaacacatgaccacgaaactgcattgctgtactaaagctctgaactagctagcaacgcgtcttagatatattccaccaagcaaaagccacatcatgctgtgctgtgccgtgccaaattaaaaccacatcgtggccttcaagtttctgctagcttcgtccttcgttgctaatcccagccagttaatcaattaattcgtcagatagatagatatatatacgcgttcatcagcgtacgttcttatagctagaactcatcctgctgtgcaaaacctgcatcactagctagctagctagctctgaatcctctagttgtctgatctcgatcgatcgatcgacaactatctcgtccacatcaagaaagcaaagttttcttgagctacgaatcaatcgatcgatcgatcgccatgggcaacagaaacgaggtgagtgagaaaatctgaattgatcatgcaatttcagagccaaattgaggtagtagcttagctacatgtgtgtgtggttgcattgcagcagcaggaggaggagcagcggcgggcgagggtgccggcgttcggcgagtgggacgagatgaaggccgccggcgtgctgccggactactccctcgacttctccaagatccgcgccgtccgcatgcagctcaaggagggtgggcccctcaccacctggtcctccaccgccgccggcggcgtagaggtcggcggcgagacggagcggcgctcatcgtcggccgccggcgtcgtcgtcgacggccgtgatcgccgccgccgccgccaccgccaccgccgacacagcagcgacggcggcgccgacctccgccggccgctccggcacgaccgtgctgcagctcccaaggtcagctaattaattaaactgctaattttcatgcgttttggtgttcttctgatggtttactaaaaagtgaagattccaaggtctgtgttactactaccatgttaatcattttaagctgcacggttataaccatatgaacttatccgcgattaagtgaaattaataagcatgattcgttcaacacactggtcaatttgttttctcaacacaaacgtacactgtaaatgtcaacatgctgcccgttagttaaaaattcagaatgttcttggggcaaactgacgtatgttaatcccgcgtttaagatatttttatgtatatttgttttttgaggaaatgtttatgtatatattttactctgctgaaactgctgcaaattgattaaatgcgacatgctgcgcacttcatcgctccttttaatatttctgtctgaatgttctttgggacatctgattgaacaatgtactatacttaaaaaattcagaacacacaagtcgtcgcgccagattgtcatgcttaatttgttgaactattatttgtttaattttgattctgaccattgtttagttttgatcctagcaggagaggagcaagctgggctacctgttctgttgcattgctggatgaagggcattggcagaaaaaaaaaattcaaatgcaagaaggcaattcaagaaaaaacttagtgctcatacatgtttaatttctccctcgtatttctgccatctctcaccgatcgatctgttggtgatttggtggatgttggtgttccatatataacagctcgttgcatctgtaatgttaggctgtctaggaattctttgctgtaaaaaaagaaaataaattcttggttaattttgattttgcctgggatgaaagccattgatttgtagcctgtacattgcacatgttgtaaatagtgaagtcgagagttattttcacaatttttaaaattaaaatggtttcttccgatctctttgataccacaggcgggctaaaaattagtagtcgtttggattctgaagaattcatcggtgcagtgaacaacaagcatactgatcttataggattcgtaaaggaaaaggtgaaatgatttcagaagagacgaacaaaatgaaacggaaagttaaaaaaatgtcaaattaggggtaataccagggacgatattgaataatgtaggtagccaaaagctatctgtaatggaggaaaaacgagagactgcaaagtggcaaaaggacccacctgtagaaaaggggaataggcaagggcgtgatgagaagatcccgggggcatatatgtaaggaaaaccatggtcgtcagggactaactcgtgaattcacaaaattgaccatttgtgggtctgtctgcaaagggagagattgagggtgcaactgaaaagaaaacgtagaaaaaggaccgaattgtaagattcgtaataggcggaggggcatatctgcaacgaaaatacttgtaactcagggacctggatggaaatctcaaaaaaatttggaccatttctcgatttgtgcgtgtcatccttgcgcaggggccatgctaatcttctctgtatcgttccaattttatcggatgtctccgaagagacaacacaagcgacagcgcgcgggtttataagttggtcgcgttcgagttagctgggcaatgtggtactaaactgttcctcccgcctctcgcgctcacactcgccctgtgggccgctcaccgtgcacgtacttgggcctcccgctcccccgcatgcatccagcccatcacagcgaagagaatcgggcttttcttctccccatctccctacacaaccaccaaatacagccaggccgttggttcatgatccggcggcagatcgacatctacctcttcacggtctcacgatgcaagcgcatcatcgaaacgtgtaaagcacccataataatactgataaattattcgcagtttcacacccagattactccataaaaatgatcaataacacatgaattatgatttatgatttatgcttgcttataattacatagtagatgacaaggcttactctgagtaactctctttttttttttttggtttcatttgctgaattaatctgtgctactacagatgaagaagctagagaacattttaggccgactgcatatatattgatgcattacatgagtaggctacggatgaggtcgggcacatctgcgccgttgatggcgagatcggacggctggaggaggaggagctcggcgagcctctcgctgagggcgtccgcctcccggtgaagcctccggatgtagcggcacgcctcctgcagcacctcggcacttgacgcctgctttgattaatcaatcaaattttagcgaggaatatatattaatccctacattataatgggatatataaattgtacttgcagatggggaaagggaaaaaccaataaaatgatgtgattataaacatgcgcatattacacgtcatgcgtgtgtgtttacaataacaatttagtgggatcagtgagacatggaattgtggtctccagctctttcagcggaatggtaacacggggatatgctagtggggctggcgataagcattgtgtgcgtgtgcattttccgtacaactgacgaagggaaaaaaaaataaacacatatatctacatgtggattatcacgtcctaaaaattcaatatccactagccacgtaatgattaacctagtagctcaagcgagtgagttagtgacaggcacaattaatgacggatataaacccaaaagggaggatattatatattaattgccaatgcaatgcatgcatgtatatgcatgcttggtttgtaactgatcctttcgcaattccgaccttatggatcatcgattgcatcgtctagctatggagtaattaaactagggatggagatcgaactcatgttaatattttcccttttctaacgtaaaatactcccgcaatcctaaatagataaaccagttcatataatatgataatatattctaatactacgaatcaaaaccggtttaatttgatcgagatcgatcaaagatcaccatcttaccttggcattggcctcgccgccgcgggtggggaggacggcctgcagcttcgagatgagctccgccatctgctcatccgtcggcggcggcgccgccgccaatctcgacgatgtacggctccgccggctcgacgacattgctaatcgagagagagagagagcttgagcttgtgagcctagctaggcaaagctacagtcaaaggagaggatcgatcgatgagcagtactagtacatgggcagtccagtccatatataagaagagcacgtacgttgtgcatgcgtacacgttgcgttggggacaagctcacatacggtgatagagacatgcatggggacatgcatgcatgttggtagctagcaacaataaataataatattagccatgtcagtctcacacggttaaagtgttagtcaggacatgtttagtatatctccagcttctaaatttagcttcaggagctggatctagagtagaattgtggagcggcctaaatcagctccacctctctagttcattttgtaagagcgctccacccagctccggggctgaaactgtttggctgaactccggctccagaagaggtggagctggagctatgccaaacagtctcttatagtatagtttaaggataaagatatcttgtggttgtagcccgttgtaattaaaatgatcgatatccgttatcatgtctttttttttcttttctaatatttgtatgatgtgtaaattcagctatatttgcagacgtccaaaatagccttggattaattgtaccattttagttcaacggtatgagatcaataaagtttcttttatcaaaaaaggtgttagtctctaagagattgagctagccatgttacatgcctaactgggagctgctacaataagtacacgtagctagccagtgcatatatgcatatacatgtgtgtcgttatgtacataaagttgtgagaagtgaagaaagcaatgccagcttcagcttcagttggcactgtactgatccagtggaccagtggacggacaactggtgcacttatgatgttggatcgatcaatcggcaattgtgtggggccaaaggcagaatgtgtcataagttctttaatttatttttaattatttccccaagtttaacaaaataattaattctcagttgaatgatatatgaagatactccatttttttcccatatggaaaatggcatgtttaaacgatgtcatttgatttgcatgtatatataggtatatatgatgctcatgcaaagaacaaaaggccagtttggttagtttgttcttgcatggatgatcatatatatatcttatttgctctcgacgatcctttcacgtgctgccatgcataaataaatagtttatcagatattagggcactcaacaccaacaagatgtcgatcgggtaagagtggaagatcatatgaaaataatcaaaagtatgaactgcattgtaacaccctccaatatgcagttaagatcgagctgacacgctgcattatgcatgtgctgatcagatcatccggagatttgatctgtgattgcgtatcatggtcacagaattaagcatttttgctttgtcaggtggactcacacgctcacacacaaactttaaccaacagattaaattaaatttcagcttgttggtcaagacagcccggagatgggccctcccaaaaaaatagtaactgagaaaatcacatggtatcagtacgaagttttagaggattttattgccgattaaaaatttaaaataacctcgtctatatattcttattcatgtaagttgagtattgccctctctcgtaaattaggattgacatacattatttttctattacaggaagaacgcatattcgtaaccgcactaacgcctccacgaatgcaccccttaacaatatatgctcaaagagaagagatagaaacctctctagccttactagaaatcccattgtgaaacgggatggacctgtggcaactcattctcgctaaaaatattatggtttgtgagactgcatcccataacatagtactttaggcatcacgatttaaaactctggcggtggagctatacatacaccacaactctactcgaatctggtgcttccactaatatgtgaatcttttttttattgctcaaaaaccgcatcatgtatgcactcaccaaatttacacctctatgaatcatgaaagtgtctcttaacacatgcttaaagaaataaaaactagtgacaattccctagcctcttactgattaaaatcctattgaaagtgtacatctaggctagtcataacccaaccttactaaaattatattaaaaccgcacctgcatgtatgtagtatttctaataaccggtggtggagctatgtaccacgacgatgcttccactgacacgtgaaatttcaagattagttagacgcggaattatctcttccttatattctgcaggtgcttccactgacatgtgaaatttcaagatgaatgagacgcgaagttatcccttcctcataatttgcatgactctatcctatgactcctgtcacatcctcaaacatggctaacttcaaagggattaaccattcacatgcatagcataacttgttggctacatgcatgcatgaaagcatgaagcaccataattggacagcgcatatgaacaaatcaagaaaagaaaaccatcaatccattgtattgcgaccattcaacagggatggaggaagtgaattaattcccaaagttgattgattgattgggccgtctttccaaacctgtgggtaggttgcaaccatattcttgatttactttttctgaagattatgttagataaataaacatgcatgtgccagacgtccaaggttatccatttttaatttccttttaacttctatatgtagtttctttatggagaaggttatgctccaattgtatatgttgacttcattccttacatcaaattggatgcttgatcgtgaaggttatttggttgggagaggagggtgcatctgcatttttaatatatgtccttgaattagcatatgtgttttgtgccatttaattaacataaacatatatgtttttcctccgcaaacacactacattacacatggcttttcctcggtgtcagagacaatattgctacagtatttaattcccaaaagggttttgattaagtggttgttaatttggtcgacagaccaaggatgcacaaaatgcataatcttgtcaaactttctgtggggtacgtatgtgcatgctcgttacccacgtaaaaactcatttttatagtttatcttttacttgctagtacaaaatttgaaacaagaaattaagtagaattaggataggcaaaaagaaaaaactcgtttgtctgtccacttgcatccctacttttctaccactcttatcttaagatatgattagcgaaatgatggcacatattgtattagctaggaaaaaatgtcactttttttagtgaatgactttagggtaaagatgaaagagaaaatacttttataggtgtggttgtgaagtacaaatgagttgtctggttaaacttgtttaacatgaagtgtggcaaggagaggcaatgttttggcattaccaattatactctgatagacctaagcgccacttaggataaacacatctaaaggcccctttgaatcgcaggattgagaaaacgtaggaataggaaaaacgtaggattttgataggaatgtaagtgtaaaacagaggataacaaaacgcaggaaaaacacaggaatgaccgtttgattgaaccacaggaaaaacacaagaattggatgagagagatagactcaaaggaaagttagcaagaggttgaagctcttgctaaatttcctccaaaatctctataggattgtccattccataggaatttcaaaggattggataggattcaatcctttgtttcaaagggcttcataggaaattttcctataggattgaaatcctctaaaattcctatgtttttcccccaaataaaaggggccctaagtgtatacgacatcgctagctagttaatcactaggcacttgaaaataacttgttagagcatcattaagagtatcccaataatcaattcccaaaacaatgttttttggatctcataaactgaatataggaagtgagaaaacctatctctccaacagaaagcttcattgatttcctataatgaaaagtaggccatccctttaactaccaatagagaaaattagtttttctaagccgaactcctcccatacgcgcacatcgcgctatgcctgcgcgctcgagagagctattgggaacaaaaatttgctcccttgaagtgaggaacgagatatgcggagttggaaacctgaattattgagaaacaggttagggattctgttggatgcaatttttaaccaaattttcctaaatatgaggatagggaatagaataagtaagctgttgcccatgctttagcttaaaaagaaatccctggatgacttaaaactattaatgtcagaattttgataaccctatgaattgcctcacaaacggcttaccagtcatccctcatttgaaacatactaattcttaaaacagaaacataagaaactatagaattatagtgacttagtaaattgacaaaacgctctcctcacgagagagggatatactacacaaaagaatttttttaagccaatcgaaaggaatatcataggacttttcgagtagctattcctttgatccaaaaaaccacacgaaaaaagtcttttagaagattgaattcctccaaaatttctccgagaaccgaagggagatgggggtttgttccgtcacctctttaatttgctttatccttacgtacacgatactcgttaactatgtgcatcgatgatacagaggccagacctaacgaacaatgggcggaactaagattccatggtttcgttggatatatatatttaatggtggagaaataaatcagaatcatgtctggtcctccatgataattgctgcctgacatgggacgacatgcctcaacttgggggcttggttttcagctgctagctgctagcaaacgatgtactctctctgtccaaaaaaaactaacttacgtgagaatataatttcacctaagataataaattggataaaaggttgtccagattcgtcacctagattgttttttaagacggggaaagtaatattagtagtactccctccataaatgcttatattttaggacgaagtattatcccgcaaatgcatcagtagtataaactctcacaaagtcacatggatgggatggtgattgtgacaagtacagttatcagtgcaggcaagtgaagatatatatacaggaagaaatgggattaagacaagaatcaatgtatgtagatgctgttatattagtagttaatttcatgtcaggaatggtttctgcaatgtgcccacatgttgtgaaaatacttggaggatatctctgatgaatcaactgtgtcaatcagcaattgtatcatatatatgctctccaagtttccttcgttttgaaatttgaaggatttgtctagttggcgatttgtgatatgtaagaatcacaaattcagagtgtattcaggccaacagacaatctaaaaggcacatgatcaaattttgagatgttaggtgcagaaatggagatggtaatatacaatattttcgtaaaataagatactagtacaatgtattttttgtaaaagcaatgacaaattcagtatgatgtgtagttgtgtacagatccaagtgtgctggaaagattaacagaaaaaaagaagagagaattatccacacttctattgaactgttacagcattttgctaggataaatgcacacaacatacaaattccattccaggggttccctcgccatgctttcaatattcaggcctcagcaatcaagtcagggagaagcttgaacctgttctgctgcataacagagaaaactgaatacacatggacaggcaagtatgtgcaaagaatgaagaaattcaactacaaatttaactatgcattctttctctttctgtaaggactgaaattttatgattttatccttgtagccaattgatcagcagatcaagtcaattttatgattttatccttgtagcccttactacttgccaatgaagtactgtgctaaaaggtccgcgatagagtttttttgggaatacgcaagcggcgcatctttgtattaagaggaataaagtttataaacaacggatccgaaaactgaaaaaaagaaggggacaggttacaggacacagaatggagctaaaggcctaatctccgactagattttgcgaccgtggaaccaagctaggaagaggcaattctggcaccgctgcatttactaagtgccatagttccgcctcggcagccataaccttcgccacttcgacccaaggcttctgttgttggttgaagaccctgttattcctctccttccatattgatggagaatgaagacttattgatggaagaaataagagatcaagaaataactactttcatttgcattatctgctaacaacgtcgaatctaacagttgagagaagccattatcattcagtaaagactgagttatattacttatatagttctagcgagattaatctctacagggttgatgagaatagagaaccaacagcctgctatccgatggtgactcccggattatcattagaacaagacagtactgtactaacacctattagtctataacaagcattagcatggcactaactttgttgaaggtagcagaagtaattaatcaatgaggatactagctcacaagctcagtggtgagatcaatcattaaggaaatactacagagatacaagatgaaactacatgttcacttatatgttatatttttggcggacagccgaaagattggccgacaaaatttcattaagatttagggaagattattacatggttttgtcatgacattaaatgtcgagttgatggtggttaaatgaaatttagacaagctaattgtttaagcgctaccgaagcttttacatgaacaagatcacttttgattaaccaaaattaaagaaagatatgctctcctgtctaaaaattggcaaactgataatcttctgacaaacaggacaaaactgaaggcaagaaagaatcaatattatttggatatcattttcattctaagtttctaactaacaagttgccattttgtaaatcatattctaataaaaatcataaacaagaaaatcacctaacataactccagcatcatgcaaagcactttcttctctgcaaaaacaaacataagttaacttagttgatcacatgagctatttctttggaatctgcattgaagtcatagcgtaagaagttttccccttaacatttctagcataagattctcacccatctctcaacttctgatgctgattcagaaagtctcctcctaagaatggacttttctgcttcacagctctctaaatcaacatctgcataagataacaaaatgtccagaaatgtgaacacttcaaatccgaattacaaacatctacatataaaactctgtttatgccggctctacacatatgcactataaaatatatggataaaatatactgcatatggatgtgttgatataaaaatatagagaaacattggaaaatgtaacatagaacaggtcaaaaaatatatatatcagaggccttaatcaggacatgcgtaataaacatggcatgataaaagcgctagacaacttgcaagtacggtatcagaaatccgaatatggtaagacattttggtgattgggcagagatcagaataattgaactaagaatatggcatgaattaatactacttcattattacgtaaaggtcagaactttagatgctaacattatagtttcttatcacatgacagggttgctttatcagcgtggtacacacctatctaatctctatacatacccaatgccaacaatattcaaatttccacctgcctgttccactactagagcaaattcaacatttgaatggtacaaactaaaagcttgaaatctaaaaacatatacattttattaaaaataaattctaaaacgttgtaaagatgatctcatctcaaggacatgcattctaaggaaacacataacactgtatgtcaaacattatgtgttacataatgctaaattgcatttggtttgcattataagattttagaagcaccaaaagagataaataggagataaaacaagaaacgtttaattcttttcaattccttaccataatagtatgttgacagaatgctgatacgctcaataggctgaaaataaccaaaaaaaaaatgttaatgtttcatttcatcatttgtcatgtatgtaatacactttgacacgaagttcaagaatataatagaagtgataagattgcgtaagggttcaagtatttctaaagccatgcgtgttcagtgagcctgcttggacaaaacacacactaatgaggcaaaaaaaaaaaggaatatctatctgaccaaaaacttgaatacattattttaactacaaaccttttacagaggatttgcagcagagaaatcattatgtgatttaaggaaaaactaaaggatgttttatgcctacataaaagaaaatgctgtacattgcaggtggacgtatacataccattacaaatatgccttctctacgagttggaagttgctcaagttttcttaatgtatcatcaccttttgtgagccttccaaatacagcatactgaaattattatgaatcaatgtttaatcatttaagcacctggtatttaatcatgaaccactgaagaaattgttgaacacctgtccatcaaggtgtggtgcatctccaagaaggatggaaaaggaagaaccaccactgtttggatcagagtgccttggagaagggggggaaaaggtgataggtgatgttatatcattgcaggcatatgaaaataagtgatttcataaaaaaatcaagataaacgccaaggaaattagttcatgatattttctaggactactttgcccaataactatcgcattcattttgatttagacaaatagacaaattaactatggaatatataaaggatcttcttcaatacctatccttttatcaacctggtaatcattgataaacttttgagggattacagaaggtactacatgctcatgttgttttggctataaccagaaggtagcaaaagtgatctgttaaaacatcaacaatgtattcacaaattgacaaaggaaataccttcccatggacagaatccccctgacatgcttgacagtactaaattcaccaacaaccgatttctctgcttcctcttgctgctcatcattcatgggggcagttctaccacccacaacagaagcaacttgtgcaacaaaacccttgtcaacctgaacccagtcatcgaccctttacataatgaaactgacaaagtcgtttagcaaaaatgaaaggttagcactaagaggtaattacccggaaaaagtgatttgtgttgtagcacccaagcctcacaagtttgtaaatgtgttcaactgtcttaggagcaacatgaggaaagaagccaaactcaatgtcaccatgagttgtctgcagatcaaattgcctaatcagaaataagaacagatactaccaactttggatgctatagaaccaattttgcctagtgtgtattagctgcaccaggacattagccaaggcatttcataacaaattgaaaaataaaatgatgtgatattataacaccaatacgagatatagaatctgaaatggaagaacatatccaaaatattaagatatcctgttattttaaatcctgattaacgagataattagcttcagccctgtcaccggcttaaataataaagatgcatacttcctcttcctcgtaagtgttcttgttcatttttaggaaatcagaagtttgtagcaacgaatgccacatgagactggttgcctgatcggcgtcctggcattctcccaattgcacactaggtggcatacatctaaattttaacctaatcctagtaaaatctcgcaataagcataggaacggacagttcaacactgcctgcgcatgaggattgacaccttgtaccccttgttttgcaacatctaattgcaacacaactcttaaatttccaacacagcactaaaccgattctccaacagtcggacgaatctggcgaacagcaagagcaacggcgtcggaattcagcgtagatcttcactcacaactcacaattccgaaatctttgatgagcctacgaatctgaccgtgccaaaatccgacttttggccccgttttctccatgaaccccggtaaaaaccgctcctttcctccctgatttagaacagcaactcgggaaaatgagggagatcgtggcgaacctggaagacgacgcgggcggatccgaggtttgggtccgaggcgtagaagctggtggcgccgtcggtggaggcggccgccgcgatgaggaggaccacggccgccgccgccgccgcggcgtggcggagcaaagccgccatttttttcttcccagttcccacctcctctctctctctcctctggtttagctgcaattgtgtatactgcagaactgaggagagacacaaagacaagtgattttttttaaaaaaaaatggttatccacaatttcacaatttttggcaatctttttacatctcagttccctttcttcccatcacaacccaaacctccaggacagccgccaataggtagggagaatagtgttggctgacggggaaaagctcgacggcggaggccgctggccgacgtggctcccaacaatctggagcgcgtgcgcggtgcggcctggtcctacctgtaatggcaatgtcatctttacctacgcgcatgagggctggggcttccgccttgtcaccttgggcaagctcctatcccggcccccaagctcaaagccacccccgccgagctgctcaaaaaccgatgtgttcagatatccctgagctctgcctctccttcatggaggagcactggtggctctaccgcatcgtctttaaggtcaattccatcttcgcgccgccttccactatcaagcttctcgacagctgcaagccttctccccgcccatcgctagttgtcgtcgtcagggttctacctaccgccgctgcccaacggccgctgcccttctccctatcggtcgccagccaccgcacacctcttccgtgactcaacatccaatgtcctcttcatgcgcacggacgctcatggagccagtggtgctcgggatcgtgctcaggcatcacaatgtactccatctcctgtctcttggagatcttctcgccaatcccaatggtgtggctgacacgcgaccctgaccgagagagggaagagcgcgtgcgctacgtggatccggtctgcggcggcgtgcggaggaagagatgcgacatgagccattggatctcatgatcgtacgatttagtattgcgtgtatatgtcagggttggagtcaccgtcaccactatgcttttttttaattatattagtaaatatatattattccttccgtcccattttaagtacagttgtggttttttttccaacgtttgaccgtctgtattatttaatttttttatgattagtatttttattattttagatgataaaacatgaatacttattttcttaagtttttcataaaattttcaaataaaacagatggtcaaacgttgaacacttcaacgtaaactcacaaaataggatggaggaagtatgtgctaatttaccgttctgatttacttgtcgagggaaaaggttcccaacacccttagcttcaaactcacccgagttcttctccctccatccaagctcaagctaattagccaaacattgaattcaacatgaactcgggttccaataacaagttggaaaactgtcctaaaattccaactgatgtttttgcaaggcattcttccatgggcccttggagcccaacgggccgagccggcccaaatccttctctcttaaagccgaacctgatctcgtcactcattgaaactagcagctcttcaccgtcagcaacaacagcatatcattcattatttttgtcttatttttctcctctttttttgcagtgaaattaaagcttctcgatttcgtcttctttttggccatctctcctttggccttttggcaacctaggtagcctctcgatcgatcgtcatggcgtagaaatcatttccatgtgttgtacacggtgcatcatttgtctgcactcgcggtagagtacacacgtacatacgtatacatgtattttatgtttgtatgtatgtattgtgtatacctccttttggtttttggtcaaaattaaatgatttgtttgtacgtccttgcacaaaaaataaagccattcacgtacctgacatgcatattcttcctagtatgatgatgtgtgtacgtgtatatatgctttaactttggagaagaaatatttgtaacgaattttagttttaaaaaaactatgggtttgtttagtttggaggtaatttttaccctactaaaatttggttacttagtaagtcttgacactatcaaatttgattgtagcatataatttgaactagtatgaacaaacattggtagcaaaccaaatatttgtttgattttagataatggaatagaatatccccgtctttgctcaacgacagcaagcatatcattttgcttaatattcgtttgatactactgaagttgccgaaattttattcatgcagaaattggctccaaaaccaaacatgccttacatatcttgcggattttcaagcgtaacttggcgtgcagataatttttataattaagttcaattagatttgatatacactcttgcttgtgtgttctctacaagtacattttattttgtaatataataactatatacataattaatcatcatcgttcagcgtcaaataagttgattctttgtgtgcctttctgtatgtttttatcagcctcatctttttattatgcttatacttattagctaaaatttaaatttttaatctaaaatttaaagttgattttagggtttttcatcgtagtttattttttagcatttgtttttagatcgttaagaaaatgaatataaaaattttattcacaaattatttttcatttttcatttacagatatgttgttttgctttttttttctccaatatgccaaacaatgggactatatacagatatgtaagcgggccgacccacaaatctacttatttgtcaataagtggtaatccgcgggttttcacgtcatagtctggcttgccgcacctagagatataagtgggtcgatccataaactcatttatagatcaaattagtaggtaacccacgggctatccactaattttgcctataagcagcttagcctgcttacagcctgtatatttttattgattgattttgcatgtatatatgaatgcatggtatatgatgcatgagcacaaatgtatatggttgcaatgcatggtcagataatctatgtcatgtagcatgatgatgtacacgtatgtacttttggggctaccctctgtggtccacggtatgacgaatgcagaagtccagaaaacgaaaaatggacgcttaaattagtacgttacacaagtatataccaaaaaatgcatgtttgcattgtgtgaaggaatttcagacttttttcagggtgaaatgatatatcaatatatgtgttcagtcatatgcctggtcccaaaattggaaaactaaatattttaccatgcctagctaggcttcttcacttgttaatttgtttgtttgtgcaagtgcactccaatcatcagcagtgcatgccttcataattaatttacagtctagattgcatgcattgctagctactttctggtttcagattgatatgtaaagctgcattatataatcctgttatgtgaatacatcatctgtggtgtgcatgtttacatttggggccacttcatataaagtccatgatgatgtgaccaaatggaacactccaaataggggaaaagggtggttataggctatacggccagcaattttggaaggaaataaatgtaaaccataattgtttaacaaaggcctcttagaggaaaacacttttgctacatcctcacacatgtcgacgttgaaagaacatcctaaattttcattaaatgtccaagaacttcgatgtgacaacgcgcataagaaaaggaaaaggggaaaggtaatctagttcctccgcgtcgtcgatcaaatttttcgtgagtacatgatgcagtgtaaacctatagccctttataaatggacaaattattccttctctcaccctctctcaccatatgaattgagcatccataataatgcaacaaaaaagctactgaccaactgtttttggaatttcttggacactggagggataggatcaatttggccactttttccccagaggcatttgtgcccttgcttgtgtgggcccccagctgcttgcacaccttgcatcatgcatcctttcaccatttgaaacccatgagcattttggcatgctttgaggtgttcttggtctctaagcaatctccctttttttttcctctttacttgccttgccaaactacaaggcctactcttcttctctcttagttacatggaaaagacaggccagggggtgcctaggctattaggtgtgtgccttgtgcactctatggtccttagttgtcatgaccccaagaatgggctcaaaagactttagggagaaaaaaggtgccatggagtgtagtactagctacttgtacgttgtttttagtgggatcaagcctctttaattttatttttttccgaaatggagtggcagcatgctgcgtgtatcaacaaatttgaaagcaaaaataatgtccttatttgtgaaacttaattttcacttaagagtagtacatacgtaagacatgttcaagatatatataggaataataaaattaaaaatcttgtaaatataatggcacacaacgttatcttaaaaaaaaatgctccaacacttgaataagaaagagaaaaaaaatatgtttaaaacttatctagaaaagcaaagaaagggtgagtcagatcaaatgcgggtataactcacgaaattgtaaaaatctgtgtgtgtgtgtgtgtgtaagaaagagaaaggcagatacaaagagagagatatagatttggaactatccatgaaaattttcatgatctcacctcattttcgatttccaccaaaccatatataggggaaaataccaaaagagaatgaggaaacatttctccattttcttttactgaaagtattataggggaggctctcatcgtcaaatttattaaaagatgttatatgtgtgtgcatgtattctagtgacggttagttaaaaaaaattatgtacaaagattacaacaatattcctccatttcgaatattaaagaaaatattttgtttggattaatacatgcaattctcccttttcttttctcatttttcctttgatccaaactggttctaatgaagtattacttaataatatttttaggagagtactagctacttaatattagccattttttaggaattgtttttttaaaaaaataccttatgaatcacttgaagtttgacatttcaccctataaatcattttgttgcaaatatttaccccatacttgttgttgttattgtttttgttgttgtcagtccacacatgtttaactcaatcaacatgttttttttaccaaaactaaacatttataggagtacacttttcttggagattccactaatagaattgttgctgagagcttaaacattatcgtaccgagttttgctatatgtataaaaagtttaatgaaacatgaagaataagtctaatgcaagcacttggataaaattgattcggctaacttaacctgtggttactctacatgagcgataaaatgtctgattcggttaaataggtgcgcaattgggtggtttttataataaaaccgaggaggtgggggtggatatttgtaacaaaaataacttaattatggaatgaaatattaaattttaaatgatttatgggtggttttccttttattttaggaaatattagcgtggttaatatgcgtagacatatttggtcaataaccagcagtgaatttgtgttcatgaattgaaaggcaagctgggtaagacactcagctcgtgtcatcatcattaccagtcaaagtgacttaagactgcacttacgtgcgtactctttaactgcggcacacctaattaattcgcattaaccagtcaaagaaaattgagaatatctctttaagtggttgattagctaatattttttttaccctgctgtcaagtgtgcatatatatatgcacgctgacacgcagtcaaaacataccaacaattaaaatgttgtatatttgcctctgtcaatactcaagctagtcactgtcattaaccggtcaaaagtgaattaagagtgacactcacgcactagttaatgctcctatagcccgccaagccgccggcaagatattaatataatgttgaacttttttcataattgtcggtctttccaaggctgacacttgtcatgatctatcatgatgctcagtaagaatggattattggcacaaaattattttctaattatttatgccgcacttcggaaagtgcattttttcaaaaaaaaaaaaagtcaacatctgcatttttctagactttgttttaagctatatgttagatttatctttttttaacggaaagatttcattaaaaaattaaattacaaccgatctctgcaactatttgttagatttatgatatattatatttaattctttcatatataaaaggaagataattcatcgaccttctgccttcatccacatttctctagtattataaaaattgaagatattttttgtcggtacttcgataagttatccgtgtttgagtcagtttttaagttcgttcgtttttgaaatacagttccgtatttgagtcggtttctaagttcgttcgcttttgaaaatacagaaggagttgtacaagaaatctgtttaaaaaaacccgcatgctagcttgagacaattggacacttaattgcagctcatgatttatatatatatatatatatatatatatatatatatatatatatatatatatatatatatagtaaatttgtttggtgctccatggtgcccgtatataacaataattagattaaaatagtcttcatccgttgtaacacattcacgggtattttttctagtcatctaaaaaattaggccccagtgcattaccattgttacacggacaaattactccgtctagttgcaagaacatgtaccattctagacgcaagattaaaaaattatgagcatcaatatattttaaaatatttgacatgatgttaacatgtgtaggtttttcacctcgatcaaaggcaccttcataatcttacaatttcatcatagtttacatttgcattcatttacatcagtcatcgtttaaagttgcattaattaggagatttaaattgatctctgaataagttagtatatctcttcatttttttctgttttggacatcgatgtctaacgacatgctttgatcaggacggaacagttaaaaccatccaggatgcatcatatgtacgccatgcattttcaatttaattaccaccacgcatgaataaatgattgtgactagccggctttgctacaagattaaacctaagcttgtttttttaataatgacctaagcttatatatgaaagctcctaatatctgatgtgacggtggccgtggaaagagaggtttcatgaatgattgcgtttaattttttttgtccacgaccgaaagtattgacgctgtgttgaacggtgtggatcatcacccatctctgatggagatggcacattggagatcatcagagagtgatcactagtcaagagctagcagcaggaacagaagaatacacacacgacattagtggtaccagccatctattttctatataaaagggggaagagaaggagtctcggagacgcgtgcatggatagatgagttcttagctaactgtaagacacgtagctttctccctgattttgacatgcatatgtgtagtttacgtggtttgttcacattttttggtcgtcatggttttttgtttgttgacgatgtcaaactgttctattaaccactagattggctttgagatcggcggtatggtctaaaggtttgctttgagattcgttattaattatatggtttattttctgggagctaagtaaatggaactgatcatggtggatagtgactgcatatacatgtttccttctacatgacacaacatgagatgattagtagccgatcacttcaaactttaccttccaagctttaacgaagaatacttagggagtgcatgcatcgagacaatatttgtgcatgtctacgggaagataatctagtctggattaacatgtgttatatattaacttattttgacccatagcaagttttcttaccctagctagtagctatctattttgacacatgtccttgatcgatcctagatgaatgaagcaccggtcaagatgtactacatacacacgcacatgcacaccaaaacaaaatgaaatgtttctaatcaataggaaaaaaaagttttccattggtcaacctctttagctctagtttgggtttgatttacaccctataatgtaatacccagtggttaattaaatccgttgcaaattatgtccatataactgttcaagcgagcatttcttttggggcgccactccatctatcaattcttttacacatgccatcctcatgattaaattaattaattgtagaattctcgcatgcatgcatgatttcctttcatgcatcgatcatcaaatcgcattggcccacacaccatgtgaaatgccaaatcactcaataggctcacaaccatccttggacatgatttgcatttttttatagtaaagacattttctaaattaaacaatatcaaataaattaaacctgaactaggattgatagactaaaattagactttccttacatctaattaaacaagttaaactattcatatccccacaatcaaaagattaaataccttcttggaacgggttcgtatcctctaccataatggtactaccattataaacactaacatgtggggtaatagaatagtgtgacccatgtaacagtgattttggaattttgcatatggatttttttttgctggattttaatcaattgatttaattaaaaaccctgcaaaattctaagaggtctaaacttaaactactcattcaagcattaactgtaattaaccatgcacatatagtaacagcttctagctgcgtcaattgcgtccctctccttctctcttttcagattccatttcaatatatatatatacactatggcacatgtgggaaataaggctgccaaactctcttgcaagtggcaagcccttattagcagggaagcaacagcagccaatccaaaggccctcgtcgccaaagagactggttccgttcagttcatcgccgtagaaaaggcaacagcgaaagcgtcacccccttcttccccgttttgagtggctgccaatagacctccggttgctgtcaatggcggaaaaccccccctaaaggttgcaatcttcatgcatgcggtgatctgctggagctagcaccaccggcgccagccgcctgtcggtgtcacgcgcagctagcgaatagcgataacacatatataccgacggggttgtggctgtacttgttgatatatctttttctccgcagcaatgtgcggggtgttttaaaagtaacccttggcacgtcgcccgttgtggacggtcgttagaacggtttccccatcgtggcaatggtgttgtcactaggacatctctccaaggattgttcttaattggcgcgtgagcttttacttcgtgtagagaagtttagggtgctggctcgaaacggggtttgctgcacattgtgtgatgtgaaaggtggctttgttagggtgtggctgcgcatcgagggtgttgcctaactagaaaggttttgcttaggtttgcaattttttttaggctgaccaagataggtgtcgtggcttgttttagtggtagggttacttagtttagcacatgagaagattgataaccaactttaccctactcatttacatgcagcatgtacgtgtgtgtatgcatatagctgcatgtgcatatatatctaattttttgaatcaattaattagttattttgttgataccaaagttatcttaacttttaaaggaagctaaaatatatttaacctgacttgctgaatgtcgtgctttgcaacggatgaaagaaaatatactataatattatataaaataaataaatatatgttttccacaaaatatggtgttcctatccttttgctctacgaaatatttatcttaatttgattttacatgtaattatccatttagatttgattgtcttttaatattatgaagttggaatagtaatttgcaaaaattacaaataaagtaggtgagttggcagattaacaaccaccacgactactttttttttaaatactaatatagattatccactaacaatgctttccaggtggtaataattagttcacgccctccctctaaataattaagcgtcccaactgggatttcaatagaaatttagtgagatcaacgatgtatcattggtgtttcattggtgtttctatctctttcaatgcgggttgattaggggacacatttatatatgtgagcgcgttgaggactgaacacaagttctctacttaacttggttatcaaataattagaaaaaagcttgagcgtgttgagaattgaacacaagattatattgaggtcaaaatcataaactcatcaccactacactatcaagttcatttcttctctactgtgtaattaaacttttgttatagtgtgccaataaaaaggaatagggttaaagctggccttctaccaaatattctcatatttgtttcatcgtataattgtttaacattgtgtaacgtactaaaatcaatagataattcggaatgatatatatgctgtctacctcaggttgatccaggaagataatcataattagacgaccacaacgtgagatatcttcaaaacctttggagacgcgtgagtacgcgttagacaaaatgaaaacttaattaccatgtgctcgtaaacgttagcatcacgaggactaagattcaattacgctcatgtactctccctttgaccatttcaacttaaaattgatgttttctctaacttagtacttaattaactagtaatttaatatcattaacatatactccctctatccaactgaataaggcgtgatcagatttaactcggtctccttaaattttttatatactataatgtttatagcaacaatataataatcatatgagagcaaattcaaatgttaatataataatattatttttatcaaataaaatttaatttataataaattattttttgttcaaatgcttaaagagctaaatcttattccgtgggatgaagggagtaatagtttatctaaataaagatcagttgaagtttctcactttatacataatgcatcatgtacgtaattaaaccgagctctgtgatgaaaattgtgcagtagaatttaattcctttaatttcatttggcctctcctttttggagttcgaggtaaatgtacgcaaggcaaaatcatccatggtacaagtagcagaggaacaaaaacggcaggcagtacagagtacactgtcaaattctaccctttttgggaatgaaaccccatcaaatttccatcgtggagaaaagggctctgtgcctctggtgcctgtcccttttgcctatcacaggataaaaaaggcaaggaccacacagcaactactagtgtaaggttggcatacaaagctgcaaattcaattgccccaatttactactactagcattgaagtatctaattaaaaccccacattaatgtgggtaaactctttgcgcacataaacgcaaattattctcgagaggaagaaccaacaaaataaacgttggaaaaacaaacccgcttaataaaaagaaccggttacgtaaaaaattcaaaaaggacgtacgtgcggagattggttatgtggaattagcgattgaagatgtgcgtcgtggttattccaatgcaacctttttggagttaatgttaatatctttacctgtcagttgattgaacttaacaaagattgactaggaaaaatatcaaataacctataatatgaaacggagaagtattttgcaatggatcacattatactagtgtatagtgttggggttggggaggagttgcatggtacacctagcctgagaaccaaatatgatggtgagacactgagtcagtacttctgtactgccttttgctccatccaaaatgttttggctcgagagaagtgtacacaatttacgagagtaacaccagctatcaaagtagtcctaagtattcacttgcatcatgtatgagctaagcttcaccatcgctttcaactaacgaggggtaaagtggttagtttcatcggttaatcaaacaacattggagaagctgtaactctcgtagatatatttgttctattggcaaagcctgatacacactcaaatgagttgtgttgaacctctcttctctctgtaaaaaacaaacaatttctagattttaatttttctctcaaaatagttgttttttctctcttttacctatcctctatttgtaaaatgagaagttttatccctttaatactccttacctactcaaccaccaactacttttctattaatgattttggtcatttttcctcctactaaagttgtcttggaataagagttgcttttattttggaatatacacagggactacatgtgtctaggagaagctgatgacattgtccattactagtacagtagtacttaagcttttcctcttgttcattataaaatactttctaaaattattgaaaacgaaatattattttagcctttcttactagcatactttgtataaattctgaaaaaaaaggcttgaatatatgaaatatatagacaagcttggatttattctatatttcttgatggcttaaaaatgaagaaaaaaagaggggagaaatcttcatccagtctcttatgggtgactgctaccgattcaataagagtttggcctaggaaccattgtttaagtcggtgttaatcatatctttttcattggaatatatcgcgtaaggttcctattgcatgattaaaaatacatcttcccactgccacaattgataatgtaaatattccattatggcttgacgaactgttaattgtgactattaatactatgcatatgttgtatgttgtcgtgtagctctttgaacttctatttaacgccttctatccctttgcgacttttcaatcgcaagactgggatagagggttttccttttgctcccatgtaaccctccttcgtaggtaatgttattcattcctatcttctataccacttattttcataagtatttctcatggaattcaatctccccctctgatctcctttcattttctttgctttcaatactctggaaaatctcttttaatatcccatggaaagtctcatctagaccaatgttgtatatttaaatttgtgtcactagcatgttgtttgtgcgttacatgagattttaattaaagaaaattatcattaatcagttattaccatcttttctgtatatatcatttcttaattgctgcatatatttgttactgacatgtgaatcctttgaccttacaatatactttttcctccccacagaaagtaaagagttgttaggggtggttgacatgtgtgagccctctagccccacctatcttttatgttttatgctctcaaaaaagtagggagttggtggtgccaccaccacttcctccttttcagagagtatagatatgaaaaacatggtctagtatgtatgatattttgccatgttggagatcgatcgatctataagatgatttaagatagttttaagcttcttactcatatttatatttttcttctactaaagtttgacaatttacatttaaccataatatcatagcatagccatctcgatgttttcattgaaacatttttagacacacacatgccgtttccttcccaatcaaaataaaattctaccaaagtattttgttgatacttatgcagggaaaaacaaaacatcaattgttagatcaaacatatgtttcgattcattgatgtaagatatccagccacaaaaatatcaattaattcaccagctttcattctcttgtaaaaaaatattaactctttgatgggagatatgaagttgaacagtaaaaactgcaataaataaatgcaaaccttatgcatataaattctaacatttaatttaacaaatacctaccaattatatatatccctaacattaatacataaacaccatgtatatgtgtttaatgttagagatacaggtggtgatgtgtaattttgtctataactattaatgttagggatacgtctagtttgtattttgtttgatagcatctttaaccgtacattcatgagatgcaggtaaattaaatgtttgagttatatcttgtttgtatttttaagatatgtagatttttagtgttggagatacaattgttatatatttaaattcattcatgactagagatacgattaaccagatatattcatccatagagattagtgggtatatttggttgatcacatctgcagccatcaaagaatttaaagatataacagttatatcaccaacattaaaagcctacatcttcttaagcatatctttaaagatacacaatccagcaaaaaaaaatacaaacaagacgtatctccaacatttaatttacctacatcttttaaacgtatcgttaaagatatcctctgacaaaattacataccagacgtgtatctccaacattaatagttgcacacgaaatccaaaaatatacacatcacccccctcccctacatctccaacattaatagatgaatttccctcacatctcccatgtgtgcatgcatctttttttgttgtttgctggttgtatggttttttggtattaggctaaaactgtggttaaatcagtggtataaaaaggggtagagggagggtggcctccatcagtcaccacaacccccccccccccctctctctctctctctcctctcctccatatttttctttctcatctcatcacacttggagtttgccaatagaatacaaaaacagcaggtgaggagagaggagagaaaaaaaaacagagctttctctctctccctccctctctctctctcttcttccaatctgcggcgcgaggcggaggtggtggtggtggtggtgggcgccgccggcgagatgggcccgtaggcgccggtgtgggcggcatcctgtcctcgccgaccacccgcccccgccggtgcggcctcgccggcaagaagtctttgtttttcttttctttttttttttcatctttgaaggtgcgtcgccgactacctccttgtgcttcaatctcggttcgaatcgaatggaagattttgtttttcgtgagaaatttcggggcttgagatgaacacatgggcgctcgagccaccccggtgcttgtggggagcagacagatttttctttcttttttttttgggttgttgttgttgggtctatttgatgcagggattaggttgtgtagatcttgtttctgaaacgcttgcagtttttttttgcggtttttttttctgtattggttctgatcgttttgtgtgctgtcgttgcagattggatccttaatttaggggcgaaaagaggggagtttgcaagaggaatcatccctattgggttgtttcttgctgctgggtaagatccaatccagcctctaggttaggtttgtttgctgttggtgaggagattgaagggttggctggtcatgttgggggaccagcgcaggaaattcctgctagagtcagcgagctcatcatctgaagaggttgtttcaagaagccggaaccttgcggttgagagctcggcggtggcggtgacggcggcgggggtgaggaagggagaagaggtggaggaggaggagctcttgaaccgtagaagcaagaagaataaggttgccagtgattcggggaattccggtaccggagtttgggactcagaaatgcaggatgctgatcagaatggtgaagccaacacaagcgagctcataggcgcgatcgggcgggagctggccattacatgcctgctccataccccccggtcttattatggtatgatagcatgcctcaaccggtccttctgctcccttatgaggtccgggcagctgtatagattgcggcgggaggctcgcattgttgagcacatgatctactgctcctgcaatgtgcttgagtgggatggctttgatccgtgccgccagcgctggttcaacatcccttccatgcctcccatagagtgcttcacgcttgctgataaggagtcccttgctgtgggaaccaatatccttgttttcgggaagaaggtggaggcccatgttgtgctgaggtatagcctcctaagtaactcttggacaacaggagatatgatgaactcgcccaggtgcttgtttggctcggcaagctttggtgagaaggcaatcgtagctggtggtatcggtgataatggtacattgagctctgctgagctctatgattctgaagcgaagacatggaccactctcccaagcatgaatagggcgcggaagatgtgttctggtttcttcatggatggtaaattttatgttattggcgggaaagctgataaccataatgagatccttaattgtggtgaggagtttgatttggagaagggcacctggcgtttgatcccagatatggcatctggccttaatggcggcagtggtgctccaccacttgttgctgttgtgaataatgaactttatgctgctgattatgcagagaaggaggtgaggagatatgacaaggttaataatgcatggatcactcttggatcattgcctgagaagtatacatcagttaatggctggggtttggcatttcgtggttgtggagataagctcattgtgattggtggaatgagtgcacctggtggtggagtgattgaaatttgttcatggatacccaataatggacagccagattggaaaatcattggcagccgccgttctggaagctttgtgtacaattgtgctgtgatgggctgttgacataccagggctattacattattgactgtacatcttgaccaaaaggaaggataaaagaggcaaattcttctgagcttgtttagtgattgtgctcgatgggtaatttctgccttctctggcattttaggctgagctgaagattgggtagaatttctcatgtagcttcttacttgcttatgtctaatctcttcattttaattccatttggagggcctgcaaatggtttccagaaagtgggacatgcagcgcagcattagattaataatttggtgcaacctcaacattttgatctaccttggataccttcatgaaagttttttagctccagagagtagtgttacattggcaaaccatttgcccatagattgtaagaaataaaggaagaaagaaaaaatgtccttgttgacgattattgccttgttttctttgcctcttctgggttagctgtgactagcgaacattgtgatttttttgtttatttatgaattgagttgttagatatattgagtgataattgcccattgactatctaaattatggtgtctgagttgttgattctgtgagattcacttgtggttagaagaccatcattggtcttcgtgtggcctaacattctagttttggaagacaaaaggctgcatgagattaaattgacattctgaacttgttcaatagacttatcctccgtgtagtatttattgtatggtgcctgttgttaacatacttgagtttggaacacagtgtgttccctcattttgtcactaacatttaaacatgttcagcttagtacttatatatgaaattatgaacagcatttgtttgttccatcttaagactttgttatgatcaatttaaggaaactatgttagttaagggcataatagccaggagtgagttgtatgtttgttgagttaatgcctaacggggattaaaccttaactacttcagcacatttgagctacaagtttaggctaggactaacatgcagcttatcttgagcttattgaataagctcctggataagcttaagctggtgaggaggtgtctggttgacaagcagaaggccttatacacttgcacattggaggaaattcagaaggccttgtacacttgcacattggatgaacttcagaaggccttatacacttgcacattggaggaacttcaaagggctactcatgataagtgctttctctttttttattatagaaaaaatatcatgcttgtcgtatgcatttttctcctcatctgttcaaaagcaaactaaatatgtgttagattgacatttttattgtctaatgagtccccaggcgacagattcttcttacatggagtcctatggtgcagtcttttgaagcacatcggcagtatttacctgaagtatgataacattgaactactcttccatatgggcttgacattacatgtgaatagtgagtactgagcagaaacaacaattgatctactgtaacaactgaccaaatcagtttctgttcattttcttttaataataattgtatcacaatcccttgcgaattgaaaacaataagtataccgattaccctgtgttgctaatggggcttaaaaaataacagcctacaatactttgtctttgcaggacacattatgagattatagataatcttcactaagcttatgtatttatttggcgtagttatttgaaataaaaatcacatttgtccttatctgcatatctttgtttcctcctttttgttcgttcatatataccatgggcattttgtggtagtctgtgagagattcttttgcgaatgacatttgggaataaattcttcatgtctgcctggctaattttcttgttattcttcttcttttcaattgacttgaggccaatcatataggtcattagccacagtgaatatttacaaaatttaacatctgtgtgcatgggcctgcttaaattcaaggttgcccaattttttttctcagtgttcattcttatggaaaacctttgtgatgctgaaaagtacatatctaacactttaggctatctcagagagcttcaagtcggatgtcatatgtggaacatgttatgagttagcaggtagtttgtggaatgcagtattcaatgtaaccaagttagcagtaggaattattccaaatgttatggcgtaatcctgactaataaacaaggtttgcatgaacagaagaagaaaggaatatacttatctattttattgcttcatttcatgctctgtgtcactccaatgttttgtagggaatacagataagattcaaagttaacagttattttagtgggtatcatgcagttgccgctttgcttttctacacagttaacctgctataaattcttggttcggtcctggactcctgtcagaagcaggttttgcatatcttgaagttataatttcctctttagtgctgttatattcttaggtaacattaaacttcatattgatgacactatactcaactgaagtgcatcgcagtttcagttgctaacctgctatatatcaatcgtcatggtatgttactcctatttggagctaagatattacccctttctttgtttaggttttcacgccttctacagcatatgttgagttaaaattcatgaaaaggaatccgatgattgtgtggtgtctctggcatgactaggtcagtagatgattaccacttaacataataacatttattttgtttatgtttatgctccagagatcctgctacatacatcttttaattacccttttttgcatggtatcgatggcattgtttatctcatttctttaattattaatacatgtcaagtaaaaccacttaatcctctcttgtgatattcagtatcatacatccttccatcttccgagtttaaattgtccgtcaagactgttgatagatgtatcattttctgttggctggatcaaaatactgttaacatgtttaatcagatttaagtacctttaaccatttagcaggttaatagtagttagtatttagtaacatacaaacgtgtaggaacttcatggctttcaggctgtcttgaactgtgacgtttaatttatatttttgtggataagccatttctaaatacaaagtgacttgggaattggaagcaaggtgtaaaacattcaatcaataagtactgctagttgactagcaatggtacattatatttgaacttgaagttcatctcgatatttctggagtcattattgatacttacttaatagccctacttcataaaacttgatcacaatatcttgatatgaggttaggaaattaggatcataatataagacattctcatgcactttgtggaaattagggtgtcggtttcatttggtttttgctatgtgtagtgatgaatttattatcccttccccaaataccttttgtgcctttggctatttgtccgttgttgtgagaagtatcttgaagtggtttgtctagtagaatagacatgatatgattacataaaaaataattcaaaatataaatggaattatagtatagttcatcatgttaactcttatactagagaataggtcatttctgccatagtatttatctgcatcattactgcgagaggagttttctttttcatatagaacaatgggaaacacttagttgttcaaagcaactgagaataaagcttggatcatctagggtacaaaaaaatgtctgtccacctatgaatttagtagtgacagctgcattgctttctagactagttccttgtttgcttgagttaatgagttcagttatgtagctcaaactagacccctatgtttgtagaattttactaagcattgaagcatatacttacaaatcactgttgatattttatgataatatttagtacatgttattcacttctgtggctacttgtgcctatcctctagttcctagatattctagtccaatgaattttgcaccattttagttatggacaatggagtaggtattttatgtccctctccagagaatggcataggacctgctttacattttggtaatttgcagacctgctggcaatacatgaatttctactttgccatcatacttcggtggtaattattctgctctaagctattatgagattaaaaatgtcaaaatgcaaacattgaagaatagtcttgtctgcatagtctcataatcacaccctggtcttctataatttgccaaaattattcacctgagctatcagcagttttcatacccatcatcattttgccagcagttcttttttttgttcaaatataagtcaacatgccatgttacatttagttttttttttttaaaaaaaaatgatgttgcctatttgttcacattgctttcttttagcatttgaatctaatgacatgttttccccttttgatgcctaacagaatttgaatttactttttgtatatgtatattgctactgcagtattgttgatatttctaatatgtttggttttcatccctgttcaattatcaaagcaatttttagattgtcaagttggttttacaccgggggcaatattttcattgctttgatcttttgattcatggagaagttagaacttagaaatgccttctttactagggataatatcagtggagaacaaattaaagcacggaacaagcatataaaatgttcttgaagaacttttccttggtgcttcacctggagaaccaagaaaagcagaagcagaaaagacaagcaatcaaacaaacggtgttactcagaagtgcaacaagcctctcaaagtagaatcaaattctttcccattaatggagatatttttaattatattaaaattttaattataaatatttctttgatccagagaatccccattccgttcatatgtgctgcaggattcgatttggtagaatctccaacagaaccactccattaggagcatatgtcttggtggctacatgatgatgaaagctccaatatccaagatcaaatttcaactctgtaaactatctacgcgtggggatcgaacggcggtatgtaaaagcttcccatttacttgattgaaagcaaatttatatacagttctatgatgtaactatgccatgtgtcattttagaaattccctccaaaggaagctgggagcataaagtcattgctatggaatttgtcctgccctatattgttcttgatacgcacctacttggagcataaaggtgctaatgtcactgctttatgggcatgatgtgtctatattttgttggtatgaagtccaattatgtgttttccctatcaatttgcacaggtcacaacccacaagattagatgcaactcactcagctgaggggcatgtgaatcgcttttatgtggacgttgcactagctcttgagaagacattagcattaccgaacatgtcgaccccaactgaacatgcaagtgaatgtgcatcaggctcgtctcaacgctacagtttctcttcacttcacttcacttgtcacttgctggtcgagtcgaaaggctatgccaatggagacctgtaagttgtttttcaggcttactactttcttggtgctgtcatgtcaagaaattgcatactgcaagttaccaaacattaactgttgggaaagtggcgccttttgcgttagcactaatcacaagttggcagaatcgtggcatcttctgctttttgcagttccctcacttgcggtccataacagagtgcacaactgatctggtataccctatgattcttcaggtgtttccttttcttttccttttgagagtccttggtcttcatcgccatgtttttgttcattatgtgcagcaaatttaagcgatgccatcttagcgtcaactattcgactgctaggttattcttacatattcttctatctttccatagggttacattttaagaacttgcacatagatcaagatgtgttaccgtatgaatggcactctatctttcctttgatgaccttagcatgctccaattcctccagcagtccaacttgctccacctattaaaagaattcgttgcggaggaccttccaatctcgagattcctcgtttccatttgtccatccaacattcctgaaacatggttctggtttttaatagttaggatctttgtttttttactcgaagagcactctggccaatgtgacattcttgccatttctcatatatatgtttggcccacatcctaatatatacccacttgtcttgagagaattgcataagtgtggaagatgctagcctatattaatataatataatgcccattcagatattcttttaggagcctatgggtatagtacctattcatttgacaacaattgatataggtgataattttataagaagatgatgacaatggcagcataataatttcatgatcactagtttcagaaagtgaatcctaaaaaactagagacaattctatgtggtgtttaaggaggccacgattttattgcctgcttcatactcccaccttttttcgaatagttgacactagacaacatgactcttatttcaaaactgaccaacaaaaaaattattatattattctattttgtaggttattaaattattaaaaaatatattatcgtattaagattcgttccacaccatacttccatattattggaagttccaagtaattctaaattcgttatagagaaaagagtgaccgtacttaattgaacactagtgtccatacatgctatgccaataagttttatgggtttgaagaccgactgatcaagtttaaattattgaacatggacagcatattttgctaagtccatgaaagttcactcatagcattgctcacttcatgcaagattttgtttccatttctccttgcaagattttgctcggatcacgcggtttccgtaaaagacaaaaccattcctcacttcatttttgttttgtgctagagtaggaaaaagaaaggagatgccgaagtggacatgagttctgtgagaggtaccatctctcacctgtgctgtcctgtccaagaaagaagaagaagaagaaaaaagagaagaaaaaggggagaagaaaaacggacgatcatgaggtagtccatgtcatatagaatcacaacaagtaggatcaccaaactttccctgttggaaaatgatatatgcttgggcagcattgacagtggatgtgaaggcaagttggcaaatggcaagcatagtggcgtcttagccctcctcctctggctgtaattattccctaatttttgtatcttctctttttcttccctggatgcataatcattgttgtatactgattttgaaatgcaaaaaaaggagaaattttctgaacctcattaatgtttgtgagaattttgtacatggctctgattatcacatcaggatgatgggtacatcagttgaaatgcaaaaaaaaaaaaaaaaaacaaaaaaaacaaaaaacaaaacaaaacaaaacaggaggataaattttcgagcagggtgttgaaatgcaaaacgaacaggttgtttctttttttcacgggaaagaacagggtgtttctgaatcatcaggaacagggttttaatggaattcgatggattttgacgacacttcttcaaaatttgtcgataacataacaggagtgaattatctagcgaacgccatttgtaggaaaatgcgctgtatgattggatttagatcttttggtctgaacatgtaaatattacctgacacgctactaaattaatcttaactacataatccatgttgcaacttccaatccataaaaacactaaaaacagcattggtacgagtgagtataaactagttcaagcacactggtacgagtgaggattaccatgaaacgaatccataaaacagcattgaccacaatgccgaatgcaaaaacatataaaacaccaaaattaaacatctccaggcatatctttaattcgagctacctaacatggtgccaaaaagagctaacataaaccaacatctgaaggccaacctgcttgaattctgaaacccagataggcaagctacagaatttgggcccagttactcagcacagaaagttttatgatcattacggaaacaactagttgcaaacttcttctcattcctcatcttcctcctcaccatcaccgccaccgccgcttgccttcttctggttcttcctcttcaccctaccaggggggcctccaccgaatgggcttgtcagtgagaagtcaatgtgtttctcagactcaaccctcaccatgaacgacgggatgttgacaatttgcctgccgaccctgcacagtgattttgaaactttaatgaatgatcttcaggaaggctatcaacttggaaaaaaatattaacaatggcaacatcatgttcaacttatggtcgacaagtcgtcaaacagtaactttagagtgcattaaagaatgttgtggcagtagcctttttcaggacaaaatcatgtgaagttgccaaatgttctcatcatcgctgtacatagttcaacctaacaaactaatctagaattataacactgcagaaggcaagtaacgaactacagcaacagcaagtggtacgaaccaaattgcttgttcaaagttaaacatcacaggtaatatgtacacatgaaaagagtaacacttgtgctcaaggaacattgaatcctgtttagaaaaatgttgtgcaattaagttcaacactctcaaatgcgacattgacaagcacaagaagagtatcaaatacacgaaaaagactaacttgaaagcatctgcacactcaaattataggaagttaacaggagtacaggaccaatactaatatattatgaccttcagctttcagctcatagggcatgtgttgtgcctaaaatgacattttagctctgcctacacaatgctggatcaagagaaatgatgaatatacagtgaacgattactatgagagaatgatacagcttccatgctgctgtagaagaatcatatagaagcatacttgggaatacaaactaaagagagaacatactgagccatggaaattgtaatacctagagcttcatatttacccatttacaagacaggagatctgtagtagttaaatcatcatacctgatgtggcgttgcctgatcaggacacgagcatggtggatggacttggccatgccagccttgaagacaagagtctgaagacgccttgcgaggaagttctcaacagtgagggcaaggacataatcaagcttgttctgcccatcagcaaggagcccataacggttcatgcggcgaagcagtgcctcaccctcgaagatgcggcgtggattcttctcatcaagtgtgagcaggtgccttgcattgttacggatacggctcaaagcatactgaacacgccacagctcacgcttgcacctcagtccatactcacccactagcttcagctctgcatcaagacgctccttctcgtaagggcgacgtggcttcttgaatgtcttaccatctgcaatgaagtaataaatttgttcataacacttgacagagaaagaaaccactgtagatagtatagttgttcataagaaccaaacaataacatagaaagaagccctacagtcccaaattccttatatcctgaccccaaaaatatacaaagcaagaaagcaactgcacacacaacccagaaagacaatgcaacaacacaaataaagaaaactacagtagttgttgagattacgcccaataatagtatggatattcaagacaaatagtagtagggatcttgtgtacagtaaatactataagagcttcagatatacaaccatgtttgacaaggatttataaaacaattcataacattgtgtctgattaacccataaatagcttacatgccagatttagttttgctgtgttatccctggttagccatatcatacatacctaaattatttgttctactgtaaaatggaattcatgacctaaagcgacaatacttgaaagatctcatcaggaactatcatataatatatttaagaaaatatacatatagaatacaattagcatactacaacttacacagaaattttaaaaaaaataacaaatatagttctcgatggaccactctatgtataaacaaacagttagtgcattacaagtatatagtcctctatattaagctccatgattcattttcgtaacaaaattcacaagcttatgcataactccattccaccaaatgagtgatcaaacagaatacttgagaacaaaaaaactctagctaatgaaactcatatttccagtccttaaaacaggtaaattatcaaattttgtaccataacagaaacaaccattttcaagctacatagtaccaaatgccaaatgagtaaacatgtcctcattcctcagtactaatcaacacatcttagcattctagttaaaacccccccaaaatctacatatctcgaaattaaatccgcaccacacaagtttcaacaacagaatgcgcagtcagtcgaaatcagcacgaactaatcggcataggtacggatccaacgcaatggaaacgagaatatgaacaaagctacgggaacagaccgcgtcgaggcaaatcttgatccagatcatctcgccaaccgaaccagccatcccctcattaactaaccgccactcgctaatcaactaacacaccgaagcaagaaaagagataaaaaaaaaagaaaagaacattctctcgctgcgccaaatcgcactagcaccaaccaagacgacgcgccgttcttggacgagagagagggagaggaggaggaggagctacgtacagttgcggtagaagctgacgtggaccatcgtcgccggaccgcctctcccgcgtcgccgccgccgccgattgctggagctatggtttcccgaggggaggaggagtgaagaggagagcgcttttatatgcggcgacgagaggaaaccctagcttgagggctaggttaaatgggccgagatttctcggcccattaacgcacgggtggcaattaggcccacatatcgagatcataaatgggccttcggtgagaaggcccatatttgcaaggaaaaagtacaccaaaaggtccctcaacttatcatccagatacaaaatcgtgcctcaaccgtaaaagcagatacgtccctcaactaacaaaaccgttcactttatattcttggctggttttgaccccggttttatcctacgtagcaacagagtcagcatgagtcccacacgtcatgtgaccacgtcatcatctctctcccttctctcccttcctcctctctctcattttttacaacatacgggcggcgcggtggagcggtggcgacggctggccgggcgcaggtggggcgccgcggcggtgggtgtggaggctaaggcgaggccgggcgccgcggcgacgggcgcagaggtggaggcaggcgccatggcagccgtaagcgagcttcttggcggcgacggacaggccgcgaaggagcgggaggacctccggatagaaaccaaaagccatggaaggcctgcaccgagaacgactcgatcgggctgcagga

SEQ ID NO: 75964 - DNA, 743 bp, Oryza sativa
ggactgcacctgggacttgaggaacttgacgtagtggatggcctcgtcgagcatgaagcggtgtccatcttggtgcggcccgggacgagccgctgcaggatgcggatgcgctcgctgatgcgctcccgccgcagccgcgccgccacgctctgcgggtccttggagatgcgcacgttgcgccgcttcggcggccgcacggcctccgggtcgatctccaccggctgcagcgccgcgatgtggaagatcatctcccgcatcgcctccgacgaggacgacgacgacgagccctgcggcgcgccggagtcggagcccggtgacgacatcgcgaagtccagctggtgcacgcccgcaccggcgccgtacgttgccggcatggagttatactgatcctggtaaccgccaccggcggtggtggtggtgaccgacatctgcggcggtggtgagaactggggagaaggggtccccatgggtgataccggcggcgacgtcggcgccgccatgaacagcgactggtcactgagcgcagtgagctgctccagctgaagcatcgtgctcatcaggtcaagctgcgattccgggtaggaattgaacaagtcgaagtccatcacttagctaggatatatatcgatcaagcaactagctagctagccaggtattgatgagctagacacacggagcttagtggaaagagcttgagattgagcttgagcttgagctagctagcaggagtagtagctgtttca

SEQ ID NO: 75965 - DNA, 13702 bp, Oryza sativa
cattacaggttggtgacaaggtcccggcgaggcgtggtccatcgatagcaaaggaagtggccaccagcaacgagctttggcgtggggtgtgaacggcggagaacgcggccgccagcgacgatctccgacgtggacggcgcaggaagcgagcgccgccgcagacgtatctgtgcccggctcctgatactaagtagggatcacctgatatctagtaggtatcactctgatattgacgagtatcaggtggtacttcataggtatcacacataatgatacttggggtatcatgtatgaaaccttcaggtatcacacaagatgatatatacctagcaagggatcatacgtaaaaccttaaggtttcatgataccgagaaggatcatgatacctcctaggtatcacatgattctactaaggtatcatccatgaaacccgcaggcatcatgatagcagccatgatactcagtgtcttgatggtgttactcttattcacagatttttcctgcctatcgcctcgatccttagacttcgccttctcagcatgttgtcctcccattggcatcaagttcattgatgcaagcttttctaccaaatcttgaattgttttgattgcaagatcatatccttacaaaacacgattcagaggatgtttcacgggaagcagaggagtcgacggacggcgaggtgccgctggaaggaagcgaggaattgagcgcggaggcgcgcgattacgaggaggtttcaccaggatgctcgcgccggtggaaggaagcgaggaatcgcgcgattcctagaaggattcgccatgatctggagaagccgacggatggtgcgcgcgccggcgggaggaagcgaggaatcgggaagccggcgtttggcgagcgttggtcgtcgttctcgtttttgagcgctggttttgctacaatgcgcgcaagtggtgggtgacagttgctcagagcaatgccttatcgatatcagaatcgtccctttttgaacagcattccggtaagtagcatccccttttctactactacttaaaaaataagaggtgcttccatcgtccgtcaaaaaaaccgggtgaaaaaaaaccggaacgaatccgattcatcaacgcggtaaaagaatatgtccgattccacaaaaatagaaatcaaactcccatctgttttcgtttgagctgattagaactttgtttctgtttgggcgaataggacttggtttgaattataccaagtcctattcggttagcatcaccaggagaacaagtgcatatatacatacatagtataaaaaacatagcacataacaaagaatcacatgcagccttatagcactttgcgaaaaaacaaaaaattagatcgaagggggtcgccgtcagcacacatatatccaaataaaaacaaaaaattagatcgaagggggtcgccgccgctgccgccgtcgccgtcgccgtcgttgccgaaccgccgccgtcgccgtcgctgtggatccggtggaggggagagcaccgccgccgccgcctcccctcccgctagatccgccggcggcggcggcagagggcactctccggtggtgggggagagcgccgccgccaccgtcggtggtgggggaggactccaccgccgccgccgctcgcgggaggaggggcgccgtcgccgccgctcgcggggcgcctccccacccgctagatccgccgccggtggtgggggagggtgctgccgccgccgctcgcgggaggaggggcgccatcgccgtcgccgccgctcgcggggcgcctcccctcccgctagatccgccgccggtggtgggggaggatgccgccgacgccgccgtgggtggtgggggtgccgccgccgccgccatcggtggtgggggaggggcgccgtcgtcgccgccgccgctcgggggcgcggaggagagggtggcgaagtgagatgggagggagggaaatgggctagggttccgcggctgagagggagtgggttttgtttccccactattgacgctcggccgtccgatcaaaaccctagagatcggacggccggtgtcgtccgggccgaaatcggcccaagagggatcgagagtgaggcctcttttccgacccaagcccaggttgcggcctgggggaggaaaagtgcgcccgcgcatgcgcaaaaggccgtgggccgaccggcataggtcggaaataagtctattgttggtccctcgagccgaaaaaaagagaataagtacatttttagtgctcattttttcagaagcattacaattatagttctattgaatatgtttatttcgaagcaaacctataagaaagtattttctttctttttccaattaaataattgttaaatgatgtttgtattaataaaattagcaattaagctctgaaaattccaataaaattccaaagagcgtaactaattatggagaatttaataaaattaaatttaaccatgtcattttatttaaccatggagaatggagaattttacttgtaaatttatttaattatacacatacctacttaaaaataccaaatatttcagcgaatttgtattttaattaattgcatatttttctgatctgtaaacttcccggtgcaacgcacgggcacttttgctaaaccaaacaacacttttggtcaatatacacactctgtaatcacccggtgcaacgcacgggcacttttgctagtttttattagaagtggaaacccctgattaagtcgtatgtgatggtttgctgtgctttgtacggaccacttacaatactactacttccgtactaaaataaactaatctcgtactaagatgtgataacgaatctaatagaacgttgtattaagacgtgtcacattttaatacgaggttgacttattttgaaagtgcgggagttttggagtagtatggaacgacgacttggatacactgtgtgccagactggcatatttattccgatagggaagtgtaaaaacctcttattatcgcaagatacacgtacgtattgctgcatatatacggtccctcgcggcctcatgtcgtggtatttgtctgcaccacacaaccgcgctctaattgcttcgatttgggagtaagctttaccaggagcaggcgatggattccagcagcgccgagatcctcatcgacctcggtggcttccggctatacaaagatggccacgccgaccgtgccggcggcatggagagtgtgcctgccggctacgacgacgagaccggcgtcacgtccaaggacgtcgtcatcgacgctgtcaccggcgtgtccgcgcgcctctacctaccaccgtgcatccagccagctaccgacgacgacggtaagaagctcccgatcctcctcttcttccatgctggctacttcgtcgtcgggtcagcgagctggcctcctgtccaccgctacaccaactctgtcgtcgcaagcgcccgcgtcgtcgccgtcgccgtcaactaccgcctcgcgcccgagcacctgctcccgacagcctacgacgactcatgggcggcgctcagctgggcggtgtccggcgccgacccttggttgtccgcgcacggtgacaccggccgagtcttcttgtccggcgccagcgccggcgggaacatagcccacaacatgaccatcgccgtgggcgtgcgcggcctggacgccgtcgtaccggcgccacgcatagagggcacgatcttgctccacccttccttctgcggcgagacgaggatggaggttgagccggaggagttctggggcggcgtcaagaagagatgggcggtcatcttccccggcgcgaacggcgggctggacgatccgcggatgaacccgatggccgccggcgcgccgagcctgacaaagctggcgtgcgagaggatgctggtctgctcggcggggttcgatccgaggaggacaagggatcgggcgtactacgacgcagtcaaggccagcgggtggggacgcgaggtggactggttcgagtcggagggtgagggccaccacttcttcgtcgacaagcccggcagccacgaggccagcaagctcatggaacgagtggctgctttcattgctggccattaaactgtgcttccagctggataatttgcctcgtgtttctaagagcaaggataacagtagagctcactatctactattagcacatcttaaagccaacacatataatagattagctataaggttggctataatttttcttttcctatctctatatctcacttatacatttattatttttgtcttggagcttgtgataagctagctcttgtatgagagccaatacctttgattttttgttacctctctactccatataagcttatagtaagcttatagctcactattatacttgctctaagatgtcaaaatggtgaatagtttatcccgaagtgagccttgcgatcactctgttctaaacgataatgatagaatccggtcgcccggacgggggaggaaaaatcgggcgctccccccgtcccccgtgcgcggtgcatgtcattggccccaccacagtttctgcccccacctacaacaaatcaatcacatattttgcatattttggaaagcctatgttaagggaatttgatttattttttttcaccaaaaatgtttcacctagtgtactcaaaatgttgcagtgaactgaaatattccattgcaacaaaaaaacccacatattttggaaaaccccctattaagggaatttgttttattttttttgttccaccgaaaaatgtttcatctagtgtacttataatacttcactctgtatggatcaaatgttgcagtgtactgaaacattctttcgctatttgctgaaacattgtttttatataaggtgaaacaacacccgatttaaacgagtgaaacattttcgatctacttagtgaaacaattccgatatacctggtggaacatcgtgcaacatttaaaaataattcaataataagctaaaaaacttttagtcggaatatatccatgtgtggtctgaaacattctttcgctatttgctaaaacattgtttttatataaggtgaaaaacacccgatttaaatgagcgaaacattttcgatttacttagtgaaacaattccaatatacctggtgaaacatcgtgcaacatttaaaaataattcaataataagcttaaaaaaaacttttagtcggaatatatccatgtgtggtcttgttttgaagatttaattgcaacgaatttaatggtgcaattggatcatgatttggataagtaatttaagagaaaaatcagtttaaattagttttgcacgtaaaccatgcgctgacgtcatgctgacatcagcgcccgatttttctccaaatcgatcaggcgcccgaaccgtagagtcgtcctgttctaaaagaaaaggactactccctctatactcgtaaaggaagtcgtttaggataatgtttaagtcaaacattgggaatataaatcataaataactctcaaattgttgagtttgaaaatgtaaaaattatatgaatagatttgtcttgaaaaatactttccaataaatatacatatattactttccgataaatatttttataggccatgtcactgttcaaaacattatactttccaataaatatacatatattactttccaataaatatttttataggccgtgtcactgttcagaacgttttctttactagtacctgctttccgtctggaagaaaacctgttcaggctgttcacagaagcgtttcacttatgcaaacaacgaactactacctccgtcttctccgtcttttaatagatgacgccattgattttttctcacatgtttaaccattcgttttatttaaaaattttatgcaaatgtataagatataaatcacacttaaagtgctataagtgataaaatatctcataacaaaataaattataattacgtaaattttttgaataagacgaataatcaaacatatgagaaaaagtcaacggcgtcctctatttaaaaaacggagggagtatgacgaacgtaatggtctacctttttccaaacaaacttttcaggctcgctatcaaaggcatcaccaaaggatactcttatcatttgacaacaatcaggaacttcccctaaataaccgcaaacatcagcatgtgtctaaagtttgaaaccaaccttgcaagtgcatgatgctatatgttagctgaatgattgaaatcagactgatgactatatatttccaccaagtaaatgtgctgctcagtcatttgaaaatggtcatatgtagcaataaaaagtgccactagtagtcatgtagaactgtaaagggtacatttccacaattatttgatacaattgctgactgctgagatgcccataaaactatcatttgacaacagtcaggaacttccctaagtaaaaactggagtgcccagaaatagttgaaagcgagctacatggcaagttagctttgtgtcatagagtacttggtactttcaaatgtagaagcatgcaagtactataatccagttcctctttccagtgggtgaaagtgagatcaccagattaagatcacacactacattcgaatccaaaactctaatgaagctggagccagtttaaaagatagtatggactacggacaacaggactatgatcatcttagataaagcaactatctacagtacatccctgaatttccctatcagcaggtttatgtccgcaagaattgaatgttggaatgtggttgtttttgttaatggttcattagaaatgaagttaaggctaaaaactagatttgcatacggtaaaacatggatccaaaatctatttaatcaatctcaattctcaaccaaatgtctgaagaatattggtaaaactaatatctgcaagcattccaatgagaatcatttgcaaatcaagcactcaagtagctcgacaaacatagaagcaaaagacaagaacaaacagaacaagtaggataagcatcacaagtagtcaatactcaacacaaaacagaaattacaaataagttctaatagtacggttcaagtgcaatgtctgtgaagatatccacagcactaactggcatcttagagatcatgacctatactatagggatcataaaaagaaaaggaaatagtggtgatcattcattgtataacagctataaatccttactcagccatccgctgtagcaaatggatcatgggaaggtcctacatcatttccaatggttctttgcactaagcgctgcaaatcagccatgaccttgtgctctcgcttcgacttctcctcataattaaacatagcaagcgccctcttatcctctgcactgtaaacctggttttccttccttatacggatagcattcatcctctggtgcctactcccactcatcacatagcccaaatcctcgaacttctgaatctcctctgcagatagaccaacctcaccacgtcgtgggatacgtttcccttgctgtacgtactgtgcaatagcatcaccttctccaggtctcagtgcaccaccatagctaatatgaccttctgcacgaggaagaggcattggcccaaccggcatctcattctccaaagcagccttcttttgggcctcgagcatttccttgaatttgattgcttctgggtcaatctctggctcatttgtctcatcgatttccttaacaccaaggtcggcatcggatggggcctgatcttccgaatcagactgcttgctcctcttcctccgtgagctccggctcttcttcttactgtccctcaaggggctagggcttgatcctgaagccgctgccaccgcctcctcctcagagcttccctcagaagctgtatcattgctcttcctcttcttcctcctggagctccttcccctcctcttagacttcttgtgcctccgcgatctcttcttcttcctcctatccatagagtcctcggaatcataagagccctccgaatcctcctcagccttgctgttgtcgtcaccctctgtatcagatgaatggtggcggcggcggtggcggctacgcttgctgctacggtgactacccttacgccctttcttcttcctccgggtatcatctgatttgctggaatcggacaagctatcagactcaccggagtcggattccgacgaacccttgctatcctcctcttcgctcttatccgaggaggccaccttctttggcgattcctttttctcctcctcctcctcctcctcgtcgctgtagccataatcctcatcctcaccttcgcggcgaggagggctgggcgtgatgttccagatgcaccgcttcatgctcttgcggagcttctctctcttgacgcggcggtactcgaagtaggtgagacccttgagctgctcgtcgtcgtcatcgtcggaggcggaccaggcgccggcccccgcgccgccgccgccgcgacggggcgcagggtggtctcggtcccgagcccactccctctccacgtcgcggccacggtcgcggtggtagggggaccactggcggcggcggtcgcggtaggggctaggggaccggtccctgcggctgcggtaggggctaggcgaccggtcgcggcggcggttgcggcgcggggagggcgaccgggacggggagcggcggcggcgaggggagggcgaggcggagaccctggagcggccggggaggtgcaccacggacgcgaggcggccctccgtgcgacccatggcggcggatcgccggcttaggtcggattggggatttggggaagctagagaatagagatcgggttggacgcgtcacgcgtgggggaagaagtgtggaggtgagggcttctcggaggcgaagtcggtttggaatttggatcggcggtatgtgtgcgttattgggcttgatggaccgaaagaaggcaaggggtagttatggaccttagcataggccgatagaggaggcagctagttcatatattgtaaacagctcattttaactccctcaattattggccgaatcttatccatgtttctcaatcgtgaaatcaggtatatgagtccctcatctattcaaaccgatttaatttgactcctctagtagtttagaggatgattttgtcctacgtggtgcctacccgtcaaattgattttgttattttttgactaatcaaattgattttgtcttcgtctaacgtggcatctatccggtattaatatcagctaaacaaattaattaatatagtaacacccacatgggatccacatgttataatgaccactttttcttctctctctctcccccctctgttggtctgcaggggcaacgatcgatgaaaaaggagcaagaggcagatgcaacctcatagacaggagaggcgtcgatggcgcagtgcagcggggtggaggcctagggcaaggacgacgagtgggagagttctaacttagtggaggtggcgctcggaaacaagttcgcgttgactcctagcgttctcgagcaatcaaatccgcgacagccggccatgccatcgcagctgctgcgcgcaccatatctgcacgagatggcactagcctacgaaggggagtatgcggctaccaagctaggttataaccctgaaggaggcaatttgatccggttttaatatttgggtaaaattatatatctgattttatagttgaggaatgaggatgcagaacaaactcagctgacagttgaagaagtcaaaatgaactttttctcatatgtttgatggctgaagttgggctgaaatgtgtgtgaagcatgtatcgatctgtcagagtgattttgtgcgggtgggctttaaggagagaacacaatgtaatgatgggcctcgaacttggacatgcctgttttagcaatttcatttcaagaaacctattcggccgagggactcaacagaactggattatctaattatccagtagattaattgaatattgcatgtattactataaagccaaaaatataataaaaaagaaatataagaaatactattttttttagagaaatcacacattccaaagcgtggcatgaataatccaattaacaattgtctgcattaacttagtcaattgtaagatatttcggtttagtttatcggatgtgtgtttgtatgatagggtgtgaatgtttatgtttacatgggtgagtgtatgcatatgtacatgagctcacatataaaaaaacaaagaaggataagaatcattttgttccacaagctatcagttcttaaactgctcctaagttttacgtgttagagtttggagccacacaagagaaattcaaatcacatctactctgaacgctattccttcctcccctgagccaaacaaacattatagcgtgacgccgtggccaaaccgccaaagcacagaagtcaggatggccaggttagccgccgcccatagctagccgcgtctgccagacatgcccgtacaagtacgaccaccccgaagcccaaccgtcggtagtaccggtcactctgcgtactgcaccgcatcgcactgcagcttcccgcctgcatcacgcatgtttcggcaatgaatgccccgcacctaagttcccaacaaccggatcgagctcaaaacaacgttagtacgtagtacgccgcgacgcccggccctacgtacgtactctcctgcatgcgccggccgctgcagcaatgcgatgcaggctgccaccgcctgcgctgcaacccctcgttgcttgtctctcgtcgtcgtcggcttgctgtcgtcgtcgtcgcgggtacttacgtacggagcagggggggccggccggcggagacgcggagagcacttagccgccggccgccgcgcgcccaggccccaggctatagggatagagcgatcgagcgagcaaactagctagcttggccggcccatgcatgtggccctcttgcttggtcgggcagcaacactgcgcccgccccggcgcgagcccctgtagcccggcagaaaataaatttgtgtcccgaggcaggcacatccgggtacgctggtgcacaccacatgactgcgttcgcaacgtgaataaatcctgccctactcctagatgaattgcttcttcttttttttaagaagaagatgatctgcttcggtatctattagtacggccaagagcggattatatgtcaaatgacttattaccccttcagattgataatacttgttgtttcgaattagattttagttaaactttaaaaactttaactgtaaatatcatctaaaatatttgttatacaaatatggagaccatatgcatatattagtcttaaaaaagttttaataaaatcatatatttgttgatagttttatacatattgtaatacaaaatagtagtcaaagttattttttgaagatcatgtccttatctaaaacgataaatattattaacatggatggagtagctacttaaaaaaattaagaaaaaaatatatttatccttaacgacttaaaagctaattaatgttgaaaaagatactacttgaaaaattatctaaaattaaaatcgatattaaaattttaaatttaagttttggcagcgactgatatgatatagggcaaaccgataaggctatatatagtcttttccttctttactacatccagggattgtgttaattttctaggttagtggagttgcgtcggatttggttcatgcatgatgcatcattggtgatgaggaaatgatcagaaactggccggaatgatcctaaccagatcgtcatgatcgatatggttctgggaaaagaataatgttcacgatcgagatagtaacctgtggtgtggtcacctagcgcataagccgtgaagatgattggattatattcagatatgacgttgccagctggatttgagatatatgcatactgcttgtattactcccaacgtccacatgcagtacaaatacatgttcaaaacataatttctcattgactttaatgagatatccttcgaaagatatattatgtccgacaagaatgtttggtcgcgtcataaacacattgatgccttagatggtgtttggttggaggaactaaagtggggctaaactttggtccctctcacaaaagcataagtccctgagagggactaaatttagtctctagttcctaaacacccccttattttcttccctttttttaccgtggtgattaattagtagttatgagcattacatttgaccatgtcgctggtctgtcctacaggctacagagctacaggactaagacgtcatgctcccttgtgctcttctacaggtccatttccaagaggaagtggttaaggtgcatgcatcctgcccaacatatttctttcttggacgcagcagcatccaccagccttcctctcttaaaacacttcaaacgaagggttggtgcacaggcccaaatcagggccaggggcccccacaaaaatgatcatgaaagggcacttaaaaggggaggcattatttggatcagaaaactatatgtgcttaagctagccgatgtatacaattccccacatgttatccccctctcaatttctaaaccaccacatattccaaatcagacagccgtcgcgagcacaccaccagagcttgatttgacatgtttgttccttgtcgtgagtttctctctatgtccttctcctggccttgcttggaccaataacgattttattcgatcgtttcgtgtaaacataaactattaaactattgtacaatttctataaagaaaagtaatttgattttgagagaaaaatgatttgttttgtgacttaacggaatgaaaaatgcgcacacacacacggaacacccacgaatacatgatatgccccctaatacaatcttaaaaagatgaagaccagtgataaatatctgactttttcttaaaaaaacgaaattgtgtatgcgtaatatgaattttagatttttgttttgaagagattttagactctgtgttgctttaacggtaaacaacatccatgcatggaagattgctagataactcttttgaaagtctttatgtgccaaatctaaaaagaagatttattcattgtaccctcaacgacttaaaccagcccaatgtcagaaaaaaaaaagaaaaaaagaagaagtgcaccaacattaagaaacagagtccggacggatatgcaattatgcatataggtagggagacataatcagggtatgaggatatatgaaccaaaaagacataaagttacgtttccttttcaagagaaggacgggtttttcacggacgcgtgccgcagccccattggctggatgaattgtccggagaggactcgacaaattaaaggcaaagaaaatctaaacaattaacggaaaccataagaaaataaaaccagcgtccaaaagttcgaaccagcgaggaaggatcagccgcgggccggggacaccgagagcgaggtcacaatcagattcaggaggttcacggcctgttctaaacaaagacaagaaacaactgattagttacataattgcatgcgaaaccaaaaacataacatataactacttgagtattaattattactccctttttatattttaatgtatgacaccgttgatttttttaccaatgtttaactatttatcttatttaaaaatatatgttattattatttattttacagtgatttgatttatcattaagtgttgttttaaatattttttttatatttgtaaataagatgaatgttaaacattgataaaa

SEQ ID NO: 75966 - DNA, 43015 bp, Oryza sativa
accgtgatggacgacggcgagatgatcccggaggagaggctcacctgcgaccttcgacgcctcatctcgtcgcgccacgtctgatttctgccgtgatcgccggatcgatatccacgaacatatgatagtattttcgtctgatttcttacctgatctgctgtcatatacctgatcaacctatttgctgtcgtttggatcttgaaagaaatatttattgtctggttgtccgaaatgtttgattctttctcctgcaaaatgaatgctatatggttctttaatccttttgtttgaataggcatgttcaattcatcttttacaacaagtttgttgatgatcttggtttatttttaccctgaagattctggttggtttctgttgctctgataatcctagaaaatataaggctgtgccatgataatccttctgctttttgtgcaaacaatttcagaactacaataattaagtgaatcacaccttccaagagcgaacattcttcttgtaattactaattacccagttaccactgatagccaaatcagcagccaacataatccatcccaaaaccaaaatgtttagcaaagacattgatgttatcttacagacaggtatagggatgagatcacaattatgaaattactgggaatgttagataaatgttcttagaaagataagaatacggtttcaaattttttgcagactcaaccctcatccatttcagcggaagataagaattgcaattttttttggtgatacgggaaatttggaaggaatgaaatgctatgatcccagggcagagattagtactaccaggtaggcaaataccaacacagcaacatcccagcctttagtcctaagagaaagagttttcccttcttaatggatttgttaacttctccattgtttcagtcttttttaatcaaggatattattactaccacccagtttgctaactgagatatttgtggtgacattcccatgagcaaaactctttttagtacattgtaggaattagtgacatgatcaatcacagaatcacggcctatcaactgatacaagattattattaaaaacccaatgattattcatggcattatgatggaaatagatcctcagacgtaacgtcctccctgacgtggtcagggacatataggcctcaccgccctcaggcccacatgccactgaccacacgttatggctttacgttagagcatcccaatatcatagtcctagcatcaagtttttagaattcagaatgacaccatgtatcgcacaagcctatcaatggcagcattagaagctccatcatcctccacgctcttgcttgccttcgccttgagaccacgcgccttgtccctcatggccgcgccttcttccccaaccatcagcttcctcaccgcctcggccacgcggtcccggtcgaacacctcgccgagctccagtccgacgccccactggtgcgtcacgtacctcgcgttcaccgtctggtcgccgaagcatggctgcgcgagcatgggcaccccttcgcagatgctatccagcgtcgagttccacccgcagtgcgtccagaacccgccgatcgccgggtgcgccagccgccaggacgtctctctgtggcgcccatgtcaccacctttcccatgccgttgtccacgacggcggtgagtggttcagtcagaggcagggcgtcggagacgatgccggtgacgaagcctgggcggatgacccagaggaatgggacgccactgccggcgagcccaagggccatttcgtcgaacacctcgcggtcgatgcgcgccacgctgccgaggctcacgtacagcacggaccgcggcgagtgcgcgtgcagccacgcaacgcagccgctgtccggcgcgtgcaggccgtgctcctccggcgcgccgagcagcctgtgcatcggcccgatggcgaacgccgggatcctcggcaggtggcgccggatgttccgcagcaccggcttctcgatggcgcggaaggtgttgatcacgaagcccatcgcggccgtccgcatggcgttgtcgacgcgggcgatgaactcgcgcacccgctccgcgtcgccgccgtcgacgcggatcaggtcgcgcccgcgcagcggctcgaccggcggcaacacctcgtcgcggctctcctctgcagccaagaatcagacgcgatgagcactgctgcaagaatcgccatgaacacgatctcataccggaaacaacttgcctttgatcgggaggtagccggagtagcggaggcgcgagtagctgagcatgcagtggagcgcggcggcgttgtcggtgcggagcgcgagcgcggcgacgccgacctccgccgcggcggtgagcgccgcgtaccagtaccactgcccgtcgaccaccgcgcacgccacctcgctccacccccccccccccccccgacccgcaccacccgccggagcgcctcgcggaacggcgcctcgcaggcggcgttgagcgccagcatctgctcgaccaggtcggtgccggggtcggtggcggcgtcggggaggcgctcgtggatgggcacgaagatgagctccgggtggcgcgcggcgtcgggggcgttgaaggtggtgcggacgacggtgacggcgaggccgcggccgcggaggagctcggcgagctggagcatcggggcgatgtggctgcggaacgggaacgggaacatcacgacgcggcggcagtggcggcgagctccggtcatggctggcaacggcggcgagctctagctggggtgagatcgtcgaggacgacggcaaggttggcgcggtttatatatggtggcgaggtcgcgcatgggcgggggtacgtggacgtgcaaatgaaagtgtgagactgctcctttgcttgctgtattttcttactcagtatgacgcgaggcagggctaatgtgtgttatccattgctagcattaataattatccttttgacatagaaaatctgctttgtgatctatacgtatactaagttgatatctcgtgctttgatgcggaatatgtggatgaatacattgctatatattatagaaatgatagatgtatgtgtttaaataatgtgaaaatgatatgaagataatgatttaacattgcttgcatattgagttctaaaaatgcaacaaaattataaatggtatgtcacattaatttgcatgatatttaaagtactctcgataataatttctagtgggtcattatgtgacactcttgcatgtgatttaaaataccctacataataattgctagtgggtgatgatgtgacacacttgtatattgtgcttagtacttagtgggtattaactttacaggaagataggatatggtttttaaacaaaataggaagttcggtcgtgataggcatctcatttattatttagtctctccgtccccatatataaggaatattgaacggatgtgacgtttcctagtactataaatctggacagggagcatgtccagatttataatactagaaagtgtcacatttatccaagaccccttatattttggaacagagggagtactagcaaaatgccccttattgcaatgggtgtgtaggacctgtggtaaccattttaaaggtaaactctcacttttattttatacttagtaatatgataatgcattataacaagagaaagcaattttaattgtatgtacgctgaaaaaataaaattggtatgggaagagaacatctcaaactccctggggagatgagcaagcaagcgtgctaaggttcaaagcacaagtttcaggtgttaattaaaggagtaacttacattatacacagcgaaatttatgtgaacaagatgaatacaagctgggagaagaattacacgtcattgacactcatgtagcagtacgtgttgaatgtgttagtcgtcaagttaaatcttggcaggaacatctacgaattagcaaggtctaaccaggaatgtgttgtttgaagaatacaagcgaacgttcaagcgaacctgcaggctagaccttgctatttccaagtacatcttcgcagaagaatgcttgcttggagtacctcgtcggcagctacaacattagccgggacatcatcgaggtcgagcagcttggactcttggagtacaccccagccgcagctgcgggtccatccacatgaacagtagaaggctcaggaacccatctcgctgaacgccgctgtcggcagccgaatcggctggctcggcaaacgctaatgcgcacatgaataaccgccagggagctgcgagctccttgatgccacgcttgatccgttcgatcaacaagggcttggattttagctggatgaaaaccaaaatggatatgcagaagcgcgtgcttaggactcaaaataatgtgacttagtcccaaggtaaaaagtgaagaatgctgaatagagctgaagctgcatgattatgtcctagggtgcttatgaaacctttttctagtccaatccccataaacattggcaagaacatcgaaagacccagctgcacaatagactgagaacccatagccacttgaagtgcacgattccctcccatccgtgcttgcttcataattgcaaactcaagtccatttaatgctaagtaaagtcttccgtccaagaaaactagggtttagtggcgggcctcgtgtggacgatgcattgaagcagagcacacgcagagctcccaagaattggacaaagctaatacatggaacggacgtaccaaaattctaacagaaatatttttaatttttatgatagtagtgataaagaaaatgctttaaagaaagttgatcttgtcaaatttgctttgaaggtcacttataatcgtataaaacaaaaagaagaaatctatgttgtgaaatagataataaactccgattaaatggtaagaatgtctcttatattgcatctatctaggccatccatcctgtaatcggtggatgcatacattgacccccaccaaaatactccctccatttttctttatttaaactaaccaatatcaaataaaaaacagagggagtaattaattagcagctaacaaactaaaagaatctggtgtctccgggaaaaaaaattcaacaaatatgcaaagccgcgggaacaaaatgaaacacgccgctccctcgcttttccggaccaatatcaaagaagatgaatctacatctcatgtacatttatccagaaacaagaaggaaacaaccaggaaaaaaaaagtcctcaattgtatcaaacaagcgagcgatgcaggcaaacttccatctctgtattgttttatagctcaccaaccaaaaaatgacagcagccaacagatgccgcctttctgcaagctgaaagtactgatacaggttggaatgtatctcaaacattatgtgttggtcaagcagactcatgtcaaagatacaaatgggaggaactgacaattttctcctctcattgtgctcaataatttgccgaactaccatgccaaaaaaggaagacaatgatgttctactaccaataagagcaattgcatctctaagctcacatttgaggctgatttccaaggagctgtccaactaaattagtcacctgaaaaggtatttcaggaagaacaatgagaaattaacttaaccggattgaaagcaaaactaaccacaatacttctaatctgttagaatgatgatgattatgcttactaaaaaagaaactgaaaagaaccacaagaatattactcggaattaatttatggtcatgtttgtttatatgaagggaaagagtgcagatcaatataactaaatggagaactatgcaattacaaagctgtatacactataggggtgaggagcagccttccttgcactgtagaaacaggaggaaacaatcagagaaaattttcaattgattccagaacaaatcagccatcaagtatttcctatggaaagcagattggctggtcctttatgtaaacagtaagcttctttgaacagagagagctacaccttccaaagccaacagttaacaatcatcttaaggaggttcatttttcacaattatttcttcactacaacaggctgaatctacttcaggaagctaaatgggaagtaaatattaacagtccagaaaactgaataaacttgcctgccaatacttcgaagcacatcgatcaatgcagctattctcacccatatttagttcagcttctttatgcctagagataacagaagttgcataagtccaaataatcgcatgtagctcatcagttcatgtgctaaaagcatggctatgaactccatatgtacagagatgtcgtattgtatgccatttttagtattgagccttgaccatttaactcatgattatttttccatcacaaaagggtttacagaacagcaaaacactaccttgactaaacaaatctaattcaacttttgtgaattacagcgtcatgggtgaaaagaaatgaaggttgaagtcactaatagtaaaaacagaggaccctgaaatacaaaggcaaaccccatatgttaccttttctcaatgcacttgctgaaacatgtttgtgtaagcctgcataaagtgaaacaagggtagacaatcaggaaactgccaggtttaggttaattgctttagcatactactgtaataaacttgaaggatgcaaaaataaagggcgaacattttgatttaagattaaagaacagtcacactaaattatatgctacatgatatctcagtatacatttagataactccatgccgaagaacaacctgaactctctgatagctaaaggtagaactaatcaaataaaaagaagacgttacttcactaggtcactcaccgattgaaaagatccaccctatattccatctctttctctgccaatccaaacatctattcagacacaaagaggaaaaatattattaatctttagtcaaagaggttataattatcaggaaagccttagtcacaaactcataataacaaaggtcaaagtataaactgaatgacattacatacaagaactatcaaagaaaatgataggacaaaagactatctgacaaaccaacagttccaaatactgcaaattagactggataagtaaattgtaagacgcatagtggtggtctttcttagccatggcaacatagaatctgaaaactatatttcaaacaacaaatagagtaacatacaacagtataaacaccaacagtttgaaaaatacaaacatttgatttaaactttcttttaactagtacgatgttaggtaccactaggactggaaagaattttcagcttcagtgtatgctactccaaggaaaaatggtagcaaaagtgaaaaaaaaaagagagaaaaacatatattccctctttttttatatatgacattggttagtttaattttgaaccaaccaacatcatacatgaataagaagggagtactaatattttgtcttgatatatgtacatctcaagactcattcaagtttctgtgggtcaaatgaagtgaattatcctaatgctttacaaacaaatattatacacaatttcctagcttcctatttattttaaaatcactctagctcctatataaacttgttaatttcaccttacctagcttcctatttattttaaaatcgctgcctcgctgactggtatattctttttatgtatattgttcgtttatcactgttaaagaggatgttcaagctgtccttgcctcctgctaacccgactacagaaacaccataaaaaaatgtagaacagatccatgcatacatctggatggcagatcttattaacgcaaacgattctcagaagggcaaggtgcagccataacttgcacaaatctgcccaattttcaagattgttgggatcacaacaaaatcagcaagtttcagtttccctctaatcacatccagagcttcagcgtcagtgtaattaaaaaagcaggaaaatcacttgtgacaaagtagttcgaaaactgttactgatatcaccatacaaactgatacgcgaaatcagatgaaccaacacagacctgctccttctgcatattcacctgctccttctgcacattcaccggctgacctttcgcggccatcgctgcagctcacttcatgaaaacaaaatataccactcagcgaggcagcaatggattaatccagcaagaaaacatcgcagagagggggggaaacagtacaagatcccccgggggtcaaagaaaggcagggatccgaactcacctcagcaaactagaccaagaacgaatcggggaaacgggggcgggggtccgacgcgccgacacgacggcgatcgcggcaggacaaggctagggttttcgtggcttgtctgatcgattggagatttggaggcgaggaggtgttttgcgatttcggagcttgaggatggtcgatctgcaggtgggcccgcctgcaaacgtggtttggaagccctgtttggcctggtttgaaatagcttacggctgtaggcaaaagataattaggagtttagattaaggaattgatggtgagattaatatgggaatttgattttttaagttttaatctagtattatttagtacagatggtgggaattgatagtgagtttaattcaagattagatcttaaatgaaaatagatggtttcggatttatttaggcaaaataaggaggaatttcctcccattaccatccctataaaggaagttactccctcaattccttatccttattcatcaaaactccaatgtctttcaaccaaacagaacaatggcacatccctctaaactcctaatccctcttaaaactcccgccaaccaaacgacccgttagggctagtggttttgtgtttaaaatttgagggattcttaaataaatccctactttttttttgcattttaattagtcttcaggcatcgtcaaaaaatacagttgttttacatgatatttttagaggtgttttataggaattttagtgtacttcttcaaggaaacaattcaattctcccatggattgcagaatggtccgaacatgggatttactattgagtaaatatcatgattttgtcaactaaaaacatatataacttttgtcaggacaaccgacagttttagaaaagaaaatgatcagagtataatattctaaagtgtgagcttatctactttcccattagccataaggtttcttgggtatacacgtgaagagaaaatgcttgtccatcttattattggtgtcttcctattacttcctccatcccaaactgaatgttttaagatttctcagcacctctatttatttgattcagttgctatttcagtactccctccatcccacaatataagggattttgagtttttgtttgtaacgtttgaccactcgtcttattcaatttttttttgcaaatataaaaaacgaaaagttatgcttaaagtactgtagataataaagtaagtcacaaataaaataaataatcatttcaaaaaaatttgaataagacgagtggtcaaacgttgcaagaaaaactcaaaatcccttatattatgggacggagggagggaataggacatgcacttcaaaaggttccagggaatatttcatgattgcaattaagtaatgaatcattctacaacaatcattagcatattcaaacatttgaattaacctatggagggtgcttttgacgccagggagtgcccctctattttatataaatcctgaaggaaccatcttatttcattctcttcatcaacctataatctaactcaacaacacacatattaaaatggttagagatcttaatttaccatcagaagatgaaagaaatgaagaagctttccctgacctcaatggaggagaagctgatatggacgaaaatagaagaccagttgttgcctaaggagatataaccttgttcaagttgagcaccatgaacatgaacaagctgtaattttttatctcaacttacatccttttgatcttaactttaaggctacataagaaaaagaacaaatgcatcaaggtaaattactttgctttaaggctttatttttcaagtcaaacagcttggagttggggacgtcaccacttccttgtcctcaaagtcaagcgtgaagccggtgtcagggggcagctcggagtcggggacaccaccaattggcctcgtcctcggagttagggatgaagcagtcgtcggtaggaggagggggcggggggagggggggtagctcggtgttgaggatgccaccatgtgcctcatccttggagtcaagaacgaagccatcattgggatgccgctccatgccgaagatgtagccacctgcatgttgctcctcaatgaggaagtagaccttgttggtgccgagcaccccaccaccacgtcgcatgcctcatccacgccttccttaattcatttgtctattgtgagtcgacatccgcttccgccgcacttcacttgcgtgtggcccttctgggcagctgagccgtgacctctgcgaccgtgacgagcggtgaatcgtcacgtgtccgctgctccattgcacatgccgatagtggagaggagaggagaggcaagctaaggatactagggattagggatcggggatcggggtaggggtgactcaaggtattgagcgacatgagagtgaggaaacgctcaatagggaaaaaaattagaaacatcgagtagtcttgaatgagttaacggaaatagactgatctcacttctctaattaagttgctaaaatgatttttttctaagacctcactggatagtagtatctagtttttttttgtgatgcaagacatatgtatcgtcattatattgcatgttaccgcactcttactttcctttaccttcctctctgtcacgaccggaattaacccaacgggcattccatacgtgtgtgtattgttctttgtcccaggaggcaaggtacaccaaaagttgatacaattcagagtttaacaagcggaagcataaatagttaatttattacatgggcgacaaaggcccagcacacacgaagataaacggaaaacagcggaagactagggcgacgaccacaggcacttaacggcaggcacgagctaaacaccaaagccttcatcctccaagaactcctcttctgggttgggggaaaaattgagcaagattgagtacaaccaccgtactcagcaagacacacccacaaatgcagattaaatgcaaaggagtacaagggttataatataggggtaggatttgcagtaaacagcatttaaaggtcatttagttgcccaaagctattttataaagacgatcctagagctacactgtgttattactcaaggccgtgaacccacacgaacctgccttaacccaaggcctatgatgattcagaccgaactggcaaccagacccaggtctcagctcgttccaaaccaacccaggccaaccattcaacatttttgttgttaagcaggttttaagaaataaaccactaacttgggtacattgctaggcttgcccataaccgagggcgtggctattcgaatagattatactccgatcagaggtgtacatctttacccacaagacacatcttcctcacgtgtaaccacgtgccacataccaccacggcatacggacgaaagacgtgacatagttcccaacccatcctagcaataaacaagagtaccgacccaaccctggctacggccggaatcctgagacaggtaaccaaggttgagcccctagcagcaggacaccagccctgtgccatgacatctcgactaccgggccgcagctcatgtagccttcatttgccctagagatgtccatcgagccctgacgtcatccatctctatccgtgtactttttcccatgaccagactgagccacaaactacgccttacccactagacatgtggaagtacggtagtgctttgcaaccgaggcccgaagaccagtccttatagtggccgaggtgctactagcaaaaccatgcacctcgagcccagcctaaaaccattttgggggttttgaaaggaggagaaggggtgtgtccatttccacataatccaaccattccataatgtccaaatgatatgagcattcccaaagtctaaggttataaaaccacctaatgttgcctaattaatcagcgaagcagctagctaaattcatactagtggaaccatgaatagagtacccactagttggggttttgtttatcctagggtgaacaaggtaataataacaatagcaataataataaggtcataacaaaggtaaatagtcatggctaaataaaacagtgataacacgggaatttaaataaagcgataatgtagtaatttaaaccaaaatagttttataaactggaattcaatatgctcaaggatgatgtgacttgccttgctcgctttcaaaaacgtcggcttcaacatccacgtagagcggatcttccgaagctgcagcgtctacacgaccaatgagaagaaaaaaggcttttattctaataaactccatataacaagcagaaacatagcacagaaatgggttcttgacttaaggaaaaattagagacttgaacggtccaatttcgagttcaaacgaccaagttatggccatttgaagattatatgctctttaggtgaatatttacaatttccttcaattacttttgaatttaaaacgattattgcgccagtcgaggggaggcgtgcgtgcggaccgggtccacgagagtggtgggccccacgcggcagcccctcggtccacgggcggctgatggccgggccacatggcgcgcccggacgcggccacgtcgtcgcggccggcaggaggcggcgtccgcgccccgatggtcgccgccggcaaccactggcgcggcggagcggtggccgagagaggggagggaagggggaaaggaggcggcactccacggctcaccccgaggcgacggcggcgacggaggaggcggccggagcggagggaggcggtggcgcggctcgggttgacggggtcggcggcattccggcggtcggcgaccgaaatagaggggtggacgatgtcggcgaggtcgcggcgaaaccgaaggaggcagcgccgaggtgggaggtggtccggggcgacgacggcggcggaccggagctcggcggcgacggcggagagagagagcgacgacgcgagctcgattccggcggggagaaggggcggcgagtagcggaaacggtggtggggagctcggggagggtaatatagggttgggagtgagagagggcggccggaggggaaggaaaccggagcgggagacccagccgccattaatggcgccggcgagattaggggggcttccatccgaaataacgagagagagagagaggggaaaaatggggggaaagggagagggaatcaggggggaatatttccccccttcaattttgaacgggagcggcggagcgcggcagatttggcgacggcggcggcgctaggcgcggggggagggaggccgagtgggccacggggagaggagagagagggagggaattgggccgaattcggcccaagagagagggggagggttttagggttttctttttataaaaccttttcaactttgtttatttcttgataattattatttgtgctctgaaaattccactaaaatttatttacacatttttaggcttttaggaaatttaaaaaaaatcctccaagccttatttgacttttaactttgcacattttaatttttggaggttttcactaggattttaattattctaggtataatttaaagaatatattttagggtcgttttgggacgtgacactctcctgctcacttccaacttctctcccaaatttaaacatgtgcatcagcacactaatttattttccaacagtttgcaaaaaaaaatcaataggcagtaccaccaatttatatcgttcttataaatatcatacaatatttcaattcgacatcaatacatattccatcatttacctatttaccccccgcaatactaaaaaatctgatccatctcaaggaagaaccagatcatggtgatgccaatagaggaatggtaaggccatcccaacccgaaaactatctattaatttccatacttaccatgtcatatagtcactatgtatagaaactatatctccaatggatggtatcttcaaattaaattttcatccaatcatctctcaaatctcctttaatccacatatcccctgttgtcatttttggttcttttgtacatatggtttcttgcatgagaaatggtttcatcatctttttacccctctcatcattaattcttttgccacatcatatatttttttttcttatgtgacaatgtatttaatattatggacactagataacatgcagggttgaggatggtctaagagcaagtttaatagtatagcccactactagctccaaatcttctatagccaatgtaatagtcaattcatacaatagttgcttaatatattagtaatagttggtcccacatgtcatacacatattacgtcttggaatccgtgctgtagctggctacaaatctatagctcactgctcttctctctcttcttttatctctttaaaatatgattataactggcttatagcttgttattgtacctgctctactaaggttcctttctaatgctctttttgccattagaaaccatcgttttgcatgcagaaaagtggcaacgactacgtggcaataatcaatttctaatcattaggtatctgtgtctgtgccgacgtgctcacgtacccagtcatgtggataagccgtttgtggccgcctcaaccctcctgaccctctcaagacccacgagagctcaaaacgcaccacaaaaaaaagaagtgaccgtgcacacgcccacgcttcacaggcgcacacacatcacgtaggcacacaaaagctagcgatggcgtcggttggtttcggcaccacggtggcgccggcggtggccgccgggagacgcctgagccaccgtcgggcggcggcgccgccgccgccgtccgcacgcgtggcgcggccgtcggcgacgaagagcgtcacggcggcggcggcgacggaggagaagggcctcttcgacgccatcttcggcgcgctgtacaaggaggagcagctgctggagaccgaccccatcctcaacaaggtcgaggagaaggcccccgccgccgcgtccagggccaccaaggccagcggcgctccggccaagaaggcggccggcgacggcgacggcgacggcgggttcagctttggcgggctcttctccaagaaagagtagacgccgaactcatatctgctactgtctgaagaagaaagctccatgacttgattctgataatctgatttaagggctcgcaaacatacataccactttgttgattctgatccatgatgcgattacttctctacttctcatgtgatatgtttcatcaatcaaagagtagtacagtatttatttcgatctcttgataattcacaaatataaatatacatcagaggaagttaattcatggataagcaacagtcagtgattttttgcggtacaagataaaccctacaacgtgacagaaatgtacttcttctacaagtaattattattactcaatgtaatcacatttaactcacaacagattataccctctcgcttctacatgcatatacaattaccgacatgaaatatttctaagtattatatatatcctgtattcatgtgcatggcagaagttcttgatatattgcttttgacgcttacgaaagaaccaaaacgttcttgccatgccgatgcaggtgatatatccctcagttcctagcctcattcataagctggcaacctttgcactgtattaagtttatttgctgcatcgacgttgaaggtcgaactcagatccccttatgagtttcaaagatgtacttcaaatgcaacaaaccagaagggattgatatctgcaagtagcaagatttgtatttaaaagcaatagatgatgctacacatccagtaagttggtaatggatcctgacaaagtcctgtacatactacaatgacaaaaactatttggtaacttaattttaatgtctttctttgttcatgcacagactaaaaaaagaaaaggccaaccccgagaagttaacaaaaactcagtcatgattgaagttggaaatccatgtaataaccataaacacacctcctctcacaaaaagaaaaaaaaccataaacacacctcggatcaactaattttatgaaagttgatgtttggacattctagatctgagagctacaaataaactcgtgctcatgccatatctcacggtactacagatccagatatgaccgacatatcagacctaagttctgagttatttgaaattttgaacagtcatccaagtcatagtatctaaattccatgtcacaccaaataccgtgaaattgtttttgggacaataaatctactatgcagtgtgtgggaggttattgagaatatggtagctgtcgttaaactcctatcaaaagaatatgttactgtcctcacaaaggagtcataaacaagataaagaaactttctagaatgaacatccacaatatctatgctaagcttagtggcagaacttttctattataagccatgtaacatgtatatggagtagttggacatctataatatccttccagctatcaatatcaaaatgattatgcatcttgttagtttgcagaagaaaataccgtaccacataggcaattcaggtgttgtaaacaataaacagctttggaatttttttttgtttattgtgtgcgtatatattcttgtttattgataccaacatttacgaggagcatttcttgtctaccaaacttcagaatggtgcgcttttgtccaatcgaactgatatttttataatcctaattgaataaagcatttggagaaactcacctgcaaatatttcctttggtgattctctagataactgtaccatctggaatcaccgcatttttaagcactaccgttatcccagaacgaatgtagaaaccctctaatggtctctctgcttcttgcacattctgcattcacacaagcaagggaaaactcttaggtctcagcatttgaactgtaaacttaatgactaaagaaaaactgcatatatatttaatagcatagacaagcaagttgcaaaagctgctacgatgaactatgtgcaatgaaggccaaataggttgaaagagcgctttagtagattgaatgaattttcctcccaccattcttatctaaggagatatgaggctttttttttctctaagtagacattaacactaatacatactttgctacctttccaaaaagtgcattttttccttgctcctgcgatacatacttgttacaaatttcgaattccataaaaccaacatgctcaatgaagtgaatgaatttaatggagtcatcttatcttcactaaacggttgtggaaatgagcttgcaaatgttataaagatcattgcaaagaagaatccagaaggctctcctagacaatgatactaagaaatagtcttatgcatgggggtcatacctgtgagttcataatcattacattctttccaattcgagcattcttgtcgatgatacagttcctgtatgtcaaaacttagcattacataacaggcaagttaccaaatacatatatgcatcattgctcatactgaccttattatggtgttttctccaacgccaactggtacttttccatcagacaattcagaaaatctctcagcttcagtctgatagtaatctgcccccatcatcatggtgtcctatacccagttgattttctttttgttaacgatattgaaataattaaacatccattgttcaataaaaatgaaaaaaaaaatccattagaccattaccaacatgtagggtacttagtgattgcttcagcataagttggtatgactaaatgtactttctgtggtttaaaaactatgtgcaaatctttcatggttaagggcataaatgccaacaaaactaggggaaaaaactcgcatggcatcaataggacatggcgagactgcagtaaatgcaggtattgaagaaaaaaagagaacactgtgatcaagggaaaataaatggaacttgcaacctgtttcctgtggttctaataatgttaatgataatagaagctaaaataaatggattgtatccaaatggccaaaatattagaaaaaagactaatttatctctggtttatctagcattgggatttgggaaacagtattttctctttaaatacaatttccgaagattgttcgtgcaggcttagttcctaagattctgtattggtatgctttcatccatctctgcctcaattatttgaatggcaaacttatgagttccaaataactgtcaagtacattgaattatgagtattcaacaattcaccttcagctgcacccccggttctaatcttgaacggacaccaataacagagcgatcaacactacattctgttagaaagcacccatgggaaactatagagttcagaacctgcacgtaaatggttagatcaaaaaaagctgctactgaaggtataaccaaagaaaccatctctaagagaatctgaccttgcagttttctactttcgttggaggtaaaaatctaggagatgtgaatatgggcttcacaggatcataaaaatagaagtttggcgactacaaagaagataactgaatttagataaattgtccacgcacataaagatatagatggagatgatgttaactaaaaaagtaaacctgatctgtgagagcaagatttgcctcaaagaatgactttattgtcccaatatcttcccagtaaccatcaaatagataggcctgtcaccacagaacaaggaatattgcattcatattcagggttttgtgaaaagtaagatcacatgctcattttgggatttgaagaatttctaacggttgatttatgacaatggaatttcttgcgtacatacagtttgaaggattatgaagttgtaaatacctgcacattgtagtcttttgcagccattgggataacttctgacccaaaatcattcgctgtaggataatgtcctctaaaagatacagaacaaagagaaagagtatcagcatacctcaaactggcaagaaaaataagaaccaaggagtgcagacaatcccaggaatgctatctcagcaaataaaaccaacagtatgtcttatcatatataacaaaccatttgttatttttgcacatttgactttgccatgcatcagaaaataaagttacagaaaccaaatgcttgatatagaagataaaactacaatgcaactggaacatttatttatcatgcaaacctagtttccaagattaaggaaagcattgctcatgagatattatcattagaatttaccttagtcttaatcattagcatttaccttagaagtcttaacaagatatcagtcctgaatacatatattcccattgaagccatgtatttgcatgtatctgcaacttctgggcgcaaaccaaaagttcccatatctagttgctgcattaataaatatcttagattatttaaaaacttattcgttagagccaataaatcaaggaaattgagctaatgataaagaaataaagaacaaatctccaataatctagataacattcacaaaagcaaaacaaaagccttgtgaataaaaccgtggatgatttaacatatgcaattaaaggtgatggaatgcattcattttacacctttttcaggtaacaattcagtttaaacatgtgtaaacaaataatttttagtattcatttgtctttgattcagtgaagaggcatataccattgatttcaagctttcatccttgggcttttcgagaaaatcagtaatgcgtccattcttgtcagtcttcatcaatccaaaatcagaagctcgactgcaagtagatgacacaaattttaaaaaaatatgagaggtgtatgtcatcatctgacccatcaattaaatatggaaatccacgtgtattgtctacttgttaatttgcaatacaatattatgatattcacaagtaatattgatgattagcgtgacaaaaagtaaacttctaaaactgtgaagaattacagcatgtacagtcctgctaactagctagaataaagacagattaaaaaaaagaaaacgattcagatagggcaattatgaataacctctcatccacaggaacacaagcgactgaaatatcagcacctttgtcaacatgcttctgcaaaacaactcatcatttagattttttttttttacaatactcaaataaagtgcaaaaataatctttgctctagaatatcaacatgaagttcacctggacaaagtccatataatccatcctatacagatgatcaccagatagaattagtatgttctctatgcgtttgagccttgcatccttgtaaaaaaatcaggcaagttaaaactgggaaagcgataacatcccgtgataagagtacaatatcatgagatgacactagacaaacctcaaatagccacaggaactgcctgacagcatcggctgttccctggaaccatcgctttcctgattcccctgttgtctgggtagctgccagcacctacccaacaatcaaaacaaaccaccgtagaacattatcaattagagatcaccgacccattgccacagctgcatgtttccactcgatttcacctcataacaaacactaatcttacctccacaaagccatcaccaaatccaaccccctcgccaatgttataagtgcgcgcgatgtgacggttgagagactgggagttgaactgggtgagaacgtagatcttgttgatcttgctgtttatgcagttgctcatcgggatatcgatcagcctgtaacatcccccaacaggcacctgacgtaccaagaacatacagctcaatcactaatgatgtaagcatctcacgattcaatcaaccaatagtcaatggtgtcaatagcaaccgaaatccccactattgcacacaaccaatgaaatgcttatcaaatgcatgacgaaatgtgcgtgtaaacactgtaaagaaaggataatgtgatttgattaccgcgggcttggccctggtccgcgtgagagggaagaggcgcgtgccggcgccgccgccgaggatgatggacgccaccgtgtccggccccacgtccctccgcgccgccgccgccgccgctggctcgaccgcatccgcctgctccaccttggcacaccaaaacacaaaaccaaaccaatgaatccgcacccaacgcacaggagatcagctcacgcaatcccaacacgcacgcacgcgcgcacgcgcgaacacggagctagccagccacctaccttgagccccttgggcgcttcggcgaggacgcagctggcggcggcggcggaggcggcggccgtgcggcggagcgcggcgacgcgcgagcggcacctggcgggcgggcgggggggcgccgccgccgccgtggtggcggcccacgagcaggtcgccattggcggacgcgggaaggttctagaagggcgaaggtggcggagtaggagaggggaggggagagtggtttgatcgaggaagggggggttttgcaaggggaagggcgcagatcgggacgatgggccgagaagagtggggaggcgcgagttacgagggcagcggggtgggcggtggggaggtgctttgacccggccgcccctcgcatccaccgtccgttttgcatcctgacatgcaggccacatgtccccgaactacgaggttcacaaggttcttgcacatacggtactcgctccattccaaatttaagtatacaggatttgtgtactagatttattttagaaagaaaagaatatataatttataacttttaatatattgttaactgatttttttatgtacttcctgtatactccctccacccaaaaactcaatttctaaatttgaatttcgtcctataaaaaaatcaacttcaatatcatatctacccttaacatataaaacgataaattttatttctttaataccctttgcctacctatcaccattactattttttttcatattgtcaaacaaaaaatacttatgtgggggaacggtagtagaggtggcgaggatttggtatttttattataacttgttaaatttgaacttgtatattcgtgaagtgatatgtttcatactaatttatcacctccatcccaaaataagtgcagccgtgggaatccgtatccaacgtttgaccgtccgtcttatttaaaaaaattatgaaaaagttaaaaaaaaagtcacatataaagtccaattcatgttttatcatctaataaaaaatactaatcataaaaaattttaaataaggcaaatggtcaaacgttggacatgaacagtgcaaaactacatttattttgagacggagggagtatcgtactaattttataatttgttaatgattatttatgtgacatgtaaggccatggccaacgctccacactagagcgtggtctcaccattcccgacgcgaatattcgcaccagctcggccgggatcgtgccctcgcaaagcgttgcaaccctctgcagagcgtcgcataatttcctcaacttttggcgaggaacgggtgaggaaccgcattggggagaggcatcgctccgtaccgtagcccagggacattgcaatcaactacctccacgccaagggtgaagaagacgaggaggtaggcggggggagaagaagatggggcgccgccacgcctcgatccgcctccaccactcgatctgccgccgccgtgcctcgatccggcgccaaggagcggagaggcgccgctgggaggggagaagaggggagagacgccgctgaggaggggaggagagctcgagctagagagagtgaagagttcggctggtgaagtgggatgacgtaagaaggggattggggtgtcggtggggaaaagagggagggaggagagattttatattaatttctagattttagggtgtttaatataaaatttggatttctatataaattgaaaaattgtgaggaataaaacaaaaaaacaaaccaggggctgaaataaaaaatacgagactgccacccgaaataaattagctttttgggtgttgccccatcctagattgcaattgagggtaacccttgcgttggccatgccgtgaagaaaccagggataatctgctcgagagatgaaaaccccatccctcaactcccacttcagtagaggcagcagcaggcttcccgtgtacacgccgacatggacggcacccaccatcgccgccacgtctgtttgaccgccggtggccggatcgtacacccgaatcacgccgcggccgtgctctgaactgccgttggcccacacccagaagacgaccctcccgtcgtcgacgagcaccaccgccggctccgcgctttccgcgtcccacggcaacggcagcccgagggcgtggtatggcatggtcaccgtgtacagcttcgtccaatgctgcggcccaaccttgccgccgtcgccgtcgccggcgaggaggaaccataggtccaggacgccagctcggtggtcgtcgtgggccaccaccaaggtgcccctcagctcggcaagggtgacggtgacgtcccaggggtcatcgtggtctccggcgggccaccgacgaggtccggtcgccattgctccgcctcaaggtcaaacgccgcgatccagtctctcctccatagcctgtattcatagagcagcacgaagtaggcgaccccgccgacgacggccgcgaacctgcgtgacgtgctgacggtgtaaggctggctcggccgtacctccctccacagcgcgaggcggccgccgttgacgctgtcgcaggcgagggtgaggaccgagcaggcctgctgctcgccgtgcttcagctccccatccttggtgatgtgcatcaccttgtactcccccgtcgatgcgatccgcgcgagcgtgacctagtacttggtggggtggctgatcttgtagtcggggacgacggggacggcgccggacaccgggtcgagcacgcggagcagctggttgttgtcgacgaggagagccacgccgccgtgcgtggacacctcggccggccggtcgcacctcccggcgcaggccctcttcacgatgtcgccggaggacgcgtccacgacgtagacgtccaccagctccctcccataggagttgagccggccgcggacggcgacggcgaggtgcggggccgggtgcctcgctgcgtgggcggcggcgaagaccgggtcgcgagacagcagggcgcgccacggccggcacacggcatggaggcggcagagcggcctcgctgggaggcatagcaggacctagtggagcagatcgaccatcaggacgccgtcgttggacactgcgacgacggggtagtcgccgccgttagctcgcgatggcggtgccattgccatgctaaggtttgtgttagagtatatggtagttagagtcatattaggatagttagagtatatggtagttagagtcatattaggataggattgatttgtgtggactccttccatatctgtaatccttccttatctcttcctcatgtattcctatatataccggcccctgaagctcattataatcaatccatattacacagtatatctctcctatactatccaatatggtattagaccgcctccgctgccgtcgcccccgggagcgagatcgctcccgggagcgagatcgctcccgggggcggccacccttttcttttcttttccttcaagttgttatgcttcatcgacgggatcgattttgatctcctcggccgcggcctccttcgtcgagtgtacatcgctgtcgtcgtcgtcctagaggagatcgatctcctcaggcgttttcgtcatcttcacttcatggcctagcaccatcgcgtcgacctccatggcctagcagatcgcatctacctccatggcctagcaccgttgcatcgacctcgccgccggggggatgggcccctcgccggcgcgtgccgctccaccggccggccccgagctcctctaccttggctgccgccggcgggcgctggatctccttcgcgccccggcaactccaccctccgccgccagcacgcctcctcatccccatctcgggtcgctgccagcagtggctcgtgctcttccacaaccttcgtgcgtggcgcgggtcatcgtcgggtcaccgacgctgccctgcggtcatccgcgtcaggcgccggagcccgccgctcctcacggcgccgaggtccacgggctaccatccaccgggttcccaccgcagacgccggtgtcccgacatggggggcttgtaacgcctcgattttcgttcggggttaaaattcattaaataatatattttctagaaattaaataaaagttaaatcaatttaatcaagtgaattattgggaggaaattagagaaaattaaaatttccattaaaaatcattagccaggaatatttagtaatattctttgtgtcctaaaatacactccggatttttccgcgaattttcggagctcaagaaataattttaatagtacaaagatcatttaatcaattaaataaaaagaaaacaaaattaaaatccccttcctccctttcgggctcgggcgaaaatcctcccctccctccttctttcccctccggcccagccgcctccctcccctctcctccttgggccgcttgacccgttcgctccctttccctccaaagtccacatacccccagccttctcactccctctctctgacaggtgggacccgatgaaccgccccgccggcaactgccatgggcgccggttccaccccacgacgccgctgtttccacccacctcctccactcctcgcgcacgcgctcgtccgtgggacctagccgcccacgtctccgctcttatccccctttcacgctcgcaaaaactggccgccaactcccccatgatcccacgccgctcccccactccgaccagcgattccgcccctcccggcctcgatctccatccaccgcgcccataaaaaccatccccgtgccctcctctcgagtttccccctccttcctgagcttgccgtgcactccctcgctctccccacacgccgccgctcaccggcgtgctccagccgccgcctcccgccgccttggccatcgccgcgccgtgccactgccaccatcggctccgccacgccgagccacacctcggcatctgctctgcctccctgtatccctgtcggaaccacctctgcaccgcgtacccgagccaccaccgccgttcgctgcctcagtagcccgccaccgccgcttcaacctccaccgtgacttgccgcttgcgccattgacttcgccgtcgcaagagcaaggccggccgccactttgtttgcccagtccaccgccggagcaccactttcgccatcgatccgaggtcgccacctcatttgctgcctccgatcgctgattcccgccgttcccgacctcctcgcggtacgccgtcgcctccctcggccacgcaaggacgagagcaccctcggccaccacctcctcgccgccgggagccaccgtaatcgtctccccggtgagtctcgccacaaatgttgtgctcggctggtgttcctcgccgtgccgcgatgcctctccctcctctaacccctcctctttgcttcccaggtcctgctgacctcggccgcacctccgccgcggtcgggagtcgccggagcgccgtccccgaccccaacccgagaagcgccaccgccaatcctcgtcgtcggccgccttcccgacttcgcctcgccgtccccgtcctcttggtgagccccctctcccttccccgctgccacccgtgtgtgccgccacatccagcgccgctgccgcccactgccggcgaccatcgggccgagcgccaccgctttccggccggctgccgccgccctgctcgcccgtggctgcccggcccctttgccgcgccgcgcctgcccgtggccgttcgatcgaccgtcctagccgatctgggccgtccacgtggcctccctgtgccgccccgcgtgggtgctctcgtggcgccacctccgctagcccgtccgccatggccaccacgaggctgccacatggtgcgcccgtgggcaacgcgcgcgtggaccgagtccaccgtgcgccgacctcctttgagccactgacaggtggggcccgcttgtcggcgccacctattcccctcggtgacatcataaaccattttaattgcgcaataaatcggtaataattctataaattcatataaatggctcaaaacttctaaaattcatatctaattcatacgaactccaaattgggccattcaacttgcaaaattcatctaaaattgagctctacatgtttgtttactttttatgtactgttttcttggtttttattaggttttttttcttgttttgcatgccagcgtgtagaatccgtcgtttcggaagatcgcgatcgcgaggaaaagagttcagaagattgttgtgaagaagcaaggaaagtaacacattcctcttgagcatgttgatcccaatttataaatgttttactgtttgcaaataaatatgcatcgttttgctaattacatgggatcagggtttacctatctgcttgcttgtccttcgtcaaccttgggtgataaatcgactagcttgtgttactttgatgacctagctagaactatatgcttagccatgcttaattaccactagctcagttgatgggataattacagtattagacattttggtatcagaacgagctgcgtgctcgagacacccggccatgttttattggccgtaattatccaactaaaatgcgactgaatggtgggctgtgggtgcatggttttgctggtcgcacccatagcaattaaggaccggttcacgggatgcactggaagacatacaatgcttgccacaagcgggaatgggtaactgcctgacttgaagtatagctcttctctggctgacgcatctaagcaatggtgggcgtgatggagcgggatgggccctgcgacggcctttgtcgcttccagattcacctaggcacgagaggggactgctcgctgcctgctgggggcggggtgaaacctaaggtatggtgtgcttggtcagagagggtaatatgaagggtcttgtcacaatcacttgacatggtgacgcctccggccgggcacggtgacatgctgatggattgtgtcttgtaggtacagttgtgcacctctggccagagaaactattcgaatagccgtgcccgcggttatgggcgatcgaccagaatcaccgtgattagtctcacacttaataaatcgactcaatgcactgtagttcatatgggttggttgggcctgttcaacgtgatgtagcattgatcagtggagatttaatgttaccttaattaaccaactgttttactgttttactcaataaaatgttttacaaccgcctttatgcaaatagccacaagccgttcttaaatccacttgcacgtctgcatcattggtgtggtttgctgagtacggtggttgtactcagccttgctattattcccccttttcagaagtgtagtgcttctgagttgaagacagagttagatgaccaaggctcagaccccagttgagttttgcctgtggagtggagctgaagccccactaggatcgtctttttccactgctgctgctttcatttcggtgtaaggattaagtgcctcttctgtaagtatttatgtttagaactgtatattacttaccgttttgtgtaccctggctaattcttggacaggaaaacacaaaatagtctggaaatttgggctaaattttagagtgtgacagggctcacggccgccaccgccgccagcacccatcgccggcgtcctctccatccgccgcttcgagagacttggacttgtcttcactgccgccggagggagtgcgcggctaaaccagagatcccgtcgggccacacgccatctggcctagggccctaggctggcctctacccgttggctactcggctcctgcctcactcgctctctctgcagtctgcctatctgtttctctttcctgtcatcttgcacgtggttagcaaacagaagagagagaagagagaagagagagagagaagatgggtgtagactgtagagggctcgttgaccggcatgcatggagatggagggttctggtcttcgggacatggtgctaccgtgctgctgcagctggtgcttgtatttgtgtgtttttttccttattagagatcggatttgcgtcgtccaccgtctcgtcgatatctgcacatctccgatataagcatagactcggcttccacttcgtcgtcctgccccgcgcatcattgacttgatcacccgttcaagcgctcggctatgacgacaccatgttgccggtcattttcgagtacgtctactacgctatcgagcttcgggttgcggctgcgttgccccctcggccgcggtgccactgcctgcggtccacaccaccactagttgttgtagtgctgagaggcgccctcctcagcatggctacatcaccggcggacttctcgccattgcatcgacatggagttgtagctgtgttgtcctctcggaccgcagcttcgcagctagcgtcgtcttcatcgccattcgcgcatcaacaacctcgccgtccgcactggttatcgtcagccattcagggtcttcttcctctacttcgagcatcgccgccgtatctccaagttgccactgtcgccgctctaggccggtggtccagctacctccaaatgcctactgacatcgccgtccaagccattggttccgctacttcgccatcttcttcgtctagcatgactcatcgccagcgtcgccgtatcttcctcgactacacttcgctcttctccggcaactgcgtgctgctccagcaattctccctctatgctgttctcgcgccgcgaccgtcttggaggccttctctgttagtctcctccgacattggcgtatggttcatggtggtccctgccttgcccgtgcggtattggcaacaccggcgcacgcattcgtcccgagttgtcccggggtctgacaaaccttgtgtgacgtctcgtccttcacggtttgactacatcggctcttcggcgtcatctatctcaatgactgcctcgattgcgtcaccgtcatcgtcttcagcgcgtcctcgtgcacctcactctacggcgccccatgcgcgctctgtggctcggctacttcgacatcagcttcctgactttggctacatcgaccacggctactctacgcatggctacctcgaccacggctccctcacaccctacgctttggctacgtcgactacggcacaaagggctatcatccgtattgagcactcttgccggtttattctccagtccaagtgtctgcgctgcttggacttctttcatatctgtaattcttccttatctcctccccatatactactatatataccggatccctagactcaatacgatcaaacagtttgcctttcatgaaaaagggatctcgtgcgccctccttataacctaacacaattcggtcactggaactgattataaatcctaacgcaattaggggtgtatttttgtttaacgaattcagctagtatctctttttttttcaagaagaattaaactatttctaatggtttttaaattgattgttatttttatggagaatgaaaagatacctgacgatgttccgtccaagggagagaaaaacgatctccctcgtgttctggctttagaggattcagattaagagaccccctagctctttgataatctcattttgttgggaaagtgattccatctctcgttctgtgcatgccacctaaataatcatcaaaaagtttgaaaaaatttggcaacatagattaatatgaaatatgtcactctacaaacatgcaagtttaaattcgactactacatgttataacaaaaataacaaatatagctgcgaagtttaatttgttctttttgatgtaacttgtagaaattgaatttggtcttgtatgtttgtgaagtgatatatttcatattaatctatattgtcaattttttaataattatttaaatgacaatcaaacaacgaggggatatcccatcgagggatgaaaatccacatcccattttgtttgggataaaaagcatacagcaacagtgtcttgatatttgaactttcaataaaagatttgaagaaaatgttaactatataaaaaaacaagcctttataattactaatttttatttccctcgttttaaacaaaaaaatatatttttttcacaatctggtgtgtgcagcatgcagagctaaagggtctcacggagatggcatagttgctctcttcaggagcaaaaatcataacttccaggagtaaaactaacgaatattgtttttgtgtgcaaccttgtagccattggaagatacccgggccttaccttcctcctctgcgaaacctgcagctgtactcgtctccaagggcaagaaatacgtgcctcacctggcctggcaaaaaaaaaaaaaaaacctcaccaagcacgcaacactgcctggtccatccaaatccagcatcgtgttgatggtgcaagacagaattaatcacaaacgcataagtttatatacaagtagacgcatttcttcgtaagaaaagaatctggatttaattttcgctcagtgttaaattttgaggtgaagggaagtttactggcttttatagagagaggtcagactggaataagtagattgcaaggcattggattttgttcagtggtgtcactagtctaactgtcactggtggtgggaccgaatatggaaaatggcaagatttggtggaaaaagttcatgcagaaccaagtcaaagcttccatgcacatatgattgtaaattatgttatcatggaaattgcaatgcagatgcttgatgacattatttctgacaaactctgtcttccttttatctgactgcaggcataatggacattctactcgttaagcatgtgtttgattggagggttttgctaggttgggttgtggccatcttttttttttttacagctgtttggtttcaagactaggtgggttggtttggtttaaaaaaatgttgagttttactgatcaccaaaaaatgaccgggccgatcgaaccagcttcccgctcccaccccctctaccatgcatttttccccatcgcatcgctccccaatgaaaaatgtaggcggcggcggcggcggcgcaagaagcgacagcaaccacacgagtgcaagagagagctaacggcgacgactcgtggccccatccctaattcgtccccccatcgctgaaattcagttggtcaacatcgtcatcctctcgccattggctgctgcggcaaaacaagattcggtgcccccatcccctaacggcatcgtccatgtcctcctctctactctgcaactgctcatcctcgcaatctcagcgacaaaggtaaggaaaccctagcatgaaaccctagatcttgctgaatttatttttatgagatgattgccccttgttgtgaaaaggaatagttgaagcaattaattcatagatgattaattcactcttgaaaccctagatgattacctattgatgtggtattttcttgtcaagttattcacggtagatttatttctaatgtgagcaagtaatctgtgattatatgatctatgcttgagaagagattttttttttgctttcctttgattattgtaatgtagatggataagaggaccaagtttttaatttttgctgctgcggcaaatatattattgtagatgatggccatgattattcaatctagaaaaaaaagagaggtgcaaggacagaaggtactaaatatggcccattggatgaaagggatagaatgagaattgagtacctagacacaaaaatttggagaatgatataacttgtgtcaacatgcttagacttagaagaaatctttcttttgattttgtaagctgtttagaaatcggggtttgcttgaggatattatccacatgtgttgaggagcaggtggctatgtttcaaaacacagcgggggcacaaccttagaaataggttaattcgcactaattctgataggtccagagaaacagtttgtcattatttcaacaaagtacttcatgttattggtgagctaggagatgaactaatcccccccctcgttggacaaccccaactaaaatatcagggagccacacatgggatccttacttcaaggtgtgacatccatctgtgtctccttttttgatttttagatgtaaagatctctgtggtcttgcaaataactcaagttcagatcatgataccgaagatattgaaactggaaatgaagaggtgaattatgggacaaccactattgatcttgatgctgaaacatcatatgtgagcaagccaaagacaggctaaaacaattgaaagtgaagatgatgtgctgattagggcattacctagtgttagtgaaaagctcgccgctggtatagtgaaagccggtgagccagtcaatacactgccagcaagtttatttgacaccctgaaaagccttcctggttttaaggacaaccacatatctttctactatgctcatttggtggccaatcctcacattactatagcttttgatggtcttccattcaaaaacaacctacactgggttgctttgttcattagtgagaaatttcctggatcaatgtagggttgtcggatgagttgtgcagttaatttgctattatgaaatgtgttgccagtgggtaggcattatatgtaagacttgaaagtatgtttaaggcaaggaaattatgtgtagcttctatgcttgaactgccactatgcttggactactatgtgtaagacttcaatgggctattatgtgatcagactttaactcattatttgtgtcttgaacttcctatgtatgtttatgtgtgattgtttttgtttttgattctacaatatgagttatgagtgagattattgttcttccacctaaattatgattgaatggatatatgtgttgtacgtatggtcagaaaaaataacatggtttggagagccctatgttttgctgtaattagaagttcataattgttgatcattttgtgttgatctcggtttgaatggatgcatgtgtcaaacggtcctattattctctatttttctgtaatcagaaggactgcacatcaattttaatcttgtgttgagcaatcctcttgtgtcatgatttatcaaggatgatggcactagcaatatttcagacctaagtcttgctcctgcatttgaatgacgggtagagaaaggaaaaatgttctcatcaaagacaacatccctagaaatataaacatgacttgaagatatatcaaggcatttaaaacctttttggcgagtactaaacccaagaaaaacacattgtttggagtggaactaaagtttgtgggtattatagtggtgaagatgaggccaataagcacaatcaaacactcttagggacgagtctggttttcggttgaacaattatgagataagtagccgcaacaaaagcttcatcccaggacttaagatgcattgatgcatgagacaaaagagaaagacccacttcaacaatgtgatagtgtttccgttcagctaacccattctgtcgatgggtatatatgtggacaatacaaatgatgatcgattcctattttagagaaaaaggaattgagcatctattactctcctccccaataagccggcatggcaataatttttctatcaaacattcattctaccaaggcttgtaattctctaaacttctcaaaacctcatatttatatcttagcaagtatatccatgtaaacttactaaagtcatcaataaaactcacgtaatatttatttctcccaacagactctagagcaagtccctagacatcagaaaacacaagttcgagaggagattaagacacactggtaaacctaacataaggtagctaatgactcttcgctttttggcaagcattatacacaaactgattggctcactcatctaagcattggagatttttttttactagtaacttgcttgacaataggaagaaatgagcgacctaagcagttgtgccacctggatagagatagcttgacggctccaagggcttgtttgttggacgaccggccaaaggacttagtgatcaaacagagaccatgcctacatctccctttaaccagaatgtccttcgttacctggtcctttaaagaaaataatttaaagtgaagctcaaggaaagcagaattatcagcagctaattgactagcagaaatgaggtttttctttgcttgtggcacatatagcacattattcaaatgaatattatgactaggggtatgaacagtagtatgaccaatatgactaatatcaatacctgcatcgctagcggtgtgaatctgctcgccgctgttgtacttctcctttgtgttgagtttctccagcacaccagtgatatgatccgtaccacatgtatcaatataccaatttgtatctacaacatatgaattagtggctgaagctgctagtttttcatccgcaacatagtcctcatcaaagcgataccagcagtcgattgctatgtgttctcgcttgaagcagacttgacaggtgggacgcttgtccggtcctcttgtgccgtgtcctcggctgcgtccttggccaccaccgtgtccttgcgacgtgcccctgtcgctgctgccggagttgttgccgccatcgtgtctgccaatgcccctaccgcaatttgtgacaaaaggcagcccccccttgactggtgttgcggtaaaggtcaagtagggtttcatagttgaggagttgagagtacaactcccaactgtcataggtttagtctttgtgcacagagtggagacgattggactgaaatcttcatctaatccggtgatgatgtactggactagatcctcctcatcaaggggccggccacctactcccatctagttgccaagggccttcatcctggcaacgtactctacaaccttcatggttcccttcttggtgttgatgagggcgagccaagtgttcactgacctcgcgcgagtgcaagaggagtaaatcttctcaattgctcgccatgcttcagtcgctgttttccacatggcaacttggatcatgacatcccttgacagaggcgataggaggtagccaaaaacttgctgatcattggcctttgttaacgccaacgccaacagtatactcagctcaaggtcagtatactaatactaacaaaccttatcttctagaagctctattgcatgtataggaaactatatttcacacatatggtatggaacttcacattagtgaatgcccaaaataaaaggaatattccaagaaaatattaattaggtcatattgaaagaaattctataaggatatcacaaaacatgcatgtgtatgtggtgtgccaaattaaggatcatataatgacaagatttataagacgatcagagggtggaaagaggtatcatatgaagtaaaacaagaaaaaaaggtcgatctaggtagatgacgaagcctatgacctttagggcgtttaacttattttattaagtagattaggcaacttgacttgatattgttgctgaatatttgtactccttccgtttctaaatatttgacaccgttgattttttagcacatgtttgaccgttcgtcttattcaaaaacttttgagaaatatgtaaaactatatgtatacatataagtatatttaatgatgaatcaaatgatagaaaaagaattaataattacttaaattttttgaataagacgaacgatcaaacatatttaaaaaagtcaacggcgtcaaatatttagaaacggaggaagtacaggcaacaaatatcaagtgtacgtatatgcaatatttttagaacatatttgtgctttctgaaattaatgttgatgagttatgttctttgtttgctatataggacactaattttgcgcttgatgttggtctaacgcttttgttaggagttgatgtttggtaatttaaccatgttctgagagaaaaaaaattcatccctccgcccagggaaataaaataaaaatgtgcgggcgtgcgagtgtactaagtacacaaaataaagtggacggaggaaaaatacattttattataattctcgaagaattacaaaaaaatacagaatccttggtcaaatacactccacggcccataagcaaggtggatctgacttggcgattgtgatctcctggttcccaaggtttcggaagacacccggttaattactctcgcgggttaaacccgtgagatacctccgattaagctacgctagtcatcgtcgtctgtcttcgcttcacgttctctcatgcatgatggtgatggtggtgcaggtgtgtgagtggcgccggtggtgttcgcggcctcgtcggtccgcacgccggtgttggtgacgtcgtctagatgtcgactccacccgccctgccattttagcctcataggttttggatggcgtgttggtttatattgttgttgaagatatgcatggaatagtgtagcctggatgacccgacgacgtaggaattgcatcggaattacattataaaagtaaaatgatcaatgcgaatgatagccgaattggtcatggctgggaagtttaatacgcagcagccccaaatgagtatgaatctgcaaactcatttttgcttgtcaccatgtacagtagcaagcatgcatgtcttgttttgttggctcgtcaccgtatacaataacatgcacaagtcagtcagcatccgcgacatgggacggctcagcagcgtagcgccctggcggctgcctcgactccctttggcgtgctctagtgaggcacaatgacaaaaaaccttctccggcgagcagcggatgatgacgagcatcgcttggtagcgttgcgtcgtctacggactcaggcggctcggcgacgacgcgacgtccccggcaactccgacgagatggcttacgacgtagctggagctagtgacgccttgcgggcaccgagtagtggcactccggccggcgttctcctcgagcaaccagctgatgagttcgaagaagatggtaacgtcgacgagagcgagcggacgtcagtgatgtcgcgaagaggaggctgcgaccgggaaggtgacaacgtccagcgtctcggcgacatcacaaggcgtcgtgggatagaggttgcggccggcgaggcaaggacgtcgtggcagcaggtagatgtgtcaccggcgaccgacgtctccgatgagagggagtgacgcgatctccggccggcggtgcgtccgacaggcggagaggacgctatatccggcgggccgaacagcaccagaaacttgcctcgtcgccgtgttgtgcatgcatgatgatctgaacagaaagagcaggaaaacaaaagagaactaataagctgtacccatggcaatggctgggtacgtgctccggcaaccgtctcctcctccgcgcgcctcctcgccggacgccgaggcactgcggccaacgtcaccgaccgccgagcgcccgtgttctcgctggacgccgagattctccagccaaaatggtgtgtgtgtctctctctgtcacttttgtatgcgtgtgtgttctgtctgtgtgtgttcctccgtttctgtgtgtgtcctcgttgtgtgaaatggcatggccttttatagtgaagaaaggcggttccagccagtacatgcatggctcgatcagtgcatgcgtgatcagccaattgcctaatttagcgattagcatttctttccatatgttctgtgattcttccaattaacagagatccttattcagcatgattccatccgtgttacgccgaccgatctcctttccaagttggaatgatacagagggatcattttcctcgtattctcgtatatacgcgcaatctgtccatggtgaggcatcgataagaaatcaactgccggcaaatgatttgattattgccctctaatgatgatgctacagtggcatgcttccaaaatcaatccaccgtcgtttcttctttccgtcggtgatatcgcttagccgtgctgccacttattccaccatctattccaggcatatgtatttatatattctatcccggctggaatacattatatatatatatatatatatatatatatatatatatatatagagagagagagagagagagacgtgagtatattcacgcctgtacattaattgggcagcactgcacgtgtcgtgtcatataacattctcatgtacgccagattgtatcattaatgatgattaatcactaattttactattgtactgtcattcccggaattaatattttgacgcaccccatttcttataaaataaaaaaagatgtacaaaatatcatcgaacaaacccaccagcaggaacaggaagacgagtcaaccattattttaaaacgagaggatgacgccggttaaaaagctttgatacaggacctaaaagctttgaaacttaatttgaaaatttcaaatctgagttgaaaattttaaaatatgggtcgaaagttttaaacttgagttgaaagtttttaaatttgaattgatttttttataattttgaggtaaaagttttaaaaattttaaattgaaagtttcaaattcttagttgaaagtttgctctttttttaaaaaaaattactttttttgaaaaaaataatatataaattaaattaaatggatgtagctttcttaaatggagattaattaatggatcacgctggattaaatttcatgcatgagccagctactgatcggaatatcggatgataaatttctcttggtcttttgtgtccagaagttttttttttgctgattacattgggattgggatggagggagtactatattgcttcccatcccacaatcacaagttttgtttaacatcggtatattttaataaaatataaatataattctcgtctgatatccatcgagaatcaacgggacatatatatgcttggtgtgagatcaacttgtcacactgatggaatgcaaaaataaaacatgaatgggatattattgtgcttggtgtttcgagaattcccgatcatatatcacgtactaatgacagaaacaaaacatgaaacgaaggagagaaggttaattttaaccccatgaaaaggaagacttaacttatttacgataaaaatacatatacgtttatgactagggttcaccaccataaaaatggtccgtacttttattaatttgtgatacaaaccatatatgatagatacaatcactacaagaaatataacattctgcgacgaattcctcgtgacatcggagctattcatcattagcacattccatttcatgactattagtatgagatggggtggcttagtgatgaaaaaaaggtgttcatcgttaataccaactagaaatcatcataaagtatttcaatgggacattgtgacgaatattaatttgtcataaggggcaaaaagcaaatgtcaaatatttatataatgcatttctagaaaaatatattaaaagttgaagcaatttaatcaggtgaattaataagaaaactaaattttcctttaaaaattatggccggaaatatttttgtaatattatacgtggtctaaattattctctgaaattttccgtgaattttcgaagctcaataataactttaataccacaaagttaatttaacctattaaaataaatggaaaacgaattaaaatcactctctctgtcctcgggcctttttcggcccaagtgttactctctcccttcctcagtcggcagcctctctctccctcctcgggccggcttccccttcccctcctcctcttcaggccgccggcccaaccctttcgttcctccctcgccgagaagtatattttgcctccttcctctcaattcaaataattttttaggtactaaatgatttcaaatgaaaaaaaattatcaacaacaaagttgcataacttatcaatatctaaaacttctgttttggccattttgttatatgactttgtttcaataatttgaatttaaattttaaattatgacaatttcaaacaatattttcaaatactaaatgatttcaactgaaaaagtcatcaacaacaaagttgtataactcatcaatatctataacttttattttggtcattttttcatccgacaaattgatagtaacattatttacaaaatttatatatcccttatagtttataaaaccatataacagatataccgtaaaaaaaagtccgtacttttatttatgataaaaaccatatttatagatacaaataatgactacggactctcttattcagcatatattgtacgtaatatatgtatcttaggtgcattcatgcatatagaaacggatcctctaacttagtacgctctctaactaatatgtaggttcttaattataccgaacccatatagtattagctagtaacccacgttagagagcagtttattagaggagactcgatcggcttaacgtagctagtaggggcgctccccgttaatgttgccacgcgggttgtagttgcaggcgatcagcgtgctgctgcgaccgttgatgttgcagccggtgacgcgcgcgcagccgatctgggtggtgcggctccacaccacctgcgtgtagtggccgcacaccttcccgccgacgcatttgttgctgctgcgatcgtagtacggcttctcgcccacccagctccccatcgcgtccgctggcttcccgacccagccggcggtgctgctccacccccaccacaggttctcgccgtagggcccctgtatgtggtccgtccggcacgtgctggcgtgctcccgggccttcgccgccaccgcctcgctccacgacacctgcgccttgacgccgaccgcggcccgggcgtcgttgtggagcttgacgaactgtgccttctcggcgtccgacaggtcggcggccatcgtcgtggtggtcgccatcacgatggtcgcaatggccaccgccagagcaaaggcagctcctttcttcggtacacttcccatggtatctccgaattcacgagtgatcttagtcctgctcagcttggctagctatctgagactgtatgcagaggtgatgattaacgcttgcattaggcagtatttatactaaatgagtttgctctgcatgcatggatgcaatgtctctaatacaataattcatttttgctctatggttcttacggaaagatatacctcgtgccggtatatggatgtagggcacattggttcaactcggaaaaacgttatatgcctatatgttgtcaacgagaaaccatcaaacgtttcatgatcgacgaccatatataaatgttactttcatggttgagatttagcaaatctgttcattcaacttaacaatcttttttttaggcaaaattggttatatagcatcgaagttcacgttttttgttttatagcaccgaaagttaccggttcactttaatagcacccaaagttcaccatgttcccatttttaacacttctgtcaattctcgatcattttccgtctgtgttgatccagccacacacacgatatgacgtttctacccctcacaagtataagtataatgcatgtcaatgaggggtagaaatgtcatatcatgtgtgtggctggatcaataacgatcaagacggacgaaaaattgacggaagtgctaaaaatgggaacatggtgaactttggatgctattaaagtgaaccggtaactttcggtgctataaaaccaaaaacgtgaactttcgatgctatataaccaattttgcctttttttattaacttaacacatacttaactagctaggttcatatccaccagcgtcatcctctcgttttaaaagaatggctgactcg

SEQ ID NO: 75967 - DNA, 1690 bp, Oryza sativa
tgcacttaaggactgattccttggaatttcatccgaacatataacaagtacgaccgcatgggtggaatgggacacccctggctgagtaattagctaatcaagggagccttgatgccgggagacaagtggattcgccagggtggtgtcggggaggacccctgggcttcctggcacagtatggtctgggacctaacctgttgttggtctgggacccctctcgtcgacatatggtaaacctgtgtcggctctcgaaatgccttgtcatgaaagcctcaaggtcaccagacatggctgttctgcacggactgggtgatccggattagtaatgtcgtgtgggtaaagtgtgccccctctgcagaggttattaaactgttcgaacagccgtgcccacggtcatgggcggatgtaaggtgattccttagcgtagttttgtttgactactgctttgtgaaatttctgttgtggaatgggatcgatgttgggaaaatctgcagctgatgggatcagctaggcccgggtggccgtttgaaagctgttggccgggtgccaaccttgcatcaatttaaagactgatacattgcacatactccgaccggacgagacacactgtctcatccgtgtcgtttgagaagcactcacttagttgtttcaaaaaggagtttaaataaaatcaattgcaaaaacaatagcctttcctttgaagcctgcattaaacacttaattcccatggcttgctgagtactcctgtactcacccttgctctatataaataatccccccccacttgctgaagaagatgatgtggatcccgccgacgaggagttcttccagaagcaagtcggctacgatgagttttaggatttcggcctagttcccaagtcgcgcctgtgatgattggtccaagtcttggcttctgctttcccttttgtaatgcagttgtgagctggggatctgtccgcagcccaacatgactgtactcctactctataataaagagacctctgttgctgtgatattctatcttcttgtgataccagcactgtttcctgggactggtatcgattaacaggttaatttggagcgtcacgggctagttccgttcggggctagttcggggcgtgacatctcttcctcctttttccaatctcaccaagtgaccggcggtgaggaggccgatgacgggctacagggagggtgccaaaagttgcgagtggagaggagaggagtggcgcgcggtgaccggtgggagagaggagcagcgattgacaagggagaggagcgacgcgcaacggtcggcgggagagagacgaaaaccgcgtggcggccggagggagaaaggagcggcgaccggcgggatagaagaacagtgtgcggcgtggaggggagagtggagcggtgtgcgacagtcggcaggagagaggagcggtgcatgttaccggtgagggaaaggagcaacgcacggcgggagagaggaatggcacgcattggccagtgggagagacaggaacgacacgtgacacgcgggcgatagagaagcggtgagaggagcgacttgcggtcacggtggccggagggagagaggagtggctcgtggcggccggcgggggagagaagaacggcgcgcggcgcagcggggagagatgagcggttcgcagcggccggcaggagagaggagcagctcaaggcggcg

SEQ ID NO: 75968 - DNA, 11778 bp, Oryza sativa
  unsure (1)..(11778): unsure at all n locations
ggggtctgaatctcatgaaaatgaagataaagatgaagattaagtgttttacgtaaaacgaggtggtaataacatgtgattaatttagtatcttcacaagaaaatcatgtacataattaatgacaactacttaagagtctaagagcaagtttaatagtatagccaaccattagctccaactcacctatagttaatttaatagtcaattcatataatggttacctataaacatatactacgctattaatatctggtctcacctatcatacacacatcgcgtcttatagtccgtgctgtaactgacaacaaatctgtagttcgctactcttgtctatcatcttttatcttctcgacatgtatttatagttggtatatattccgctattgtatccgctctaggatattaagagacataacttggtacataaattggcgttgcgaaattgcgcccctagtaagtactagtagtctatttttaccctctagaacacaacggaagcatgatgaagatcattgatgaaggatcagtgataaagctcttcacagacaaactggacgtcaccaattcaccaatctgcccgaactctgaaaccgtaagcttggaaggcgttaggaactactgcatgggcctgatcagttcatcagcacattcgtgccttcttctatcctccatcagtccatctatccaattgaagggagaagaacctacaagaaaatctccggacgatcgatagtcctgcgcgccaatccgcatctctgattctttaggctgagttcgggagcctcctgatacggcgcataattaataaagtattagttaaaaggactttaaaaatagattaacataatattttagacagtggttgcgcttatacgtggtgagtttgttcttctccaatgacacattcacaaacgacgctgagatggagtagatgtggcatagaaggcgcggcggatgaattgtctgctcctagacaccaccgaattgaagtggatgctgttagttgagagatgttgttctttggccacatttctagttaaccttttcttcaactaggaaggattaatcacgcgggcatgcatcgtagattgtgtttgagaaacttatataggagaaatattaaccgaaacatataaaatatcatttggcttgtctggattatctgagaacatttagaaaaaaaacccttggtaattggtatattttatctaattaaaggcactcgatttttgatccagtggctaagactattcatatttcactcgatatgggcatatgtatcttacattgttagtttaattataaagagagatcnattagataanaatcaaatgtgtagcttataaaaaaacactatagttgtttcaatattgattgtttatcttatagtttagtagctaccaaaataaagaagaggatggcggtgtttttttgcatgtgagagggaggaggagatggagggactttatttttctaaataatttaagtgaaaaccgattataatatgtttctttttttctcaaaatttcttttattgcttttataacttttaagacatgacacatgttgacttaatgttttgcaaaaaatatatttaattgacgaaaataatgaatccatcgagttaatatgaattgttttctaatttttaagacgtaacacattattagttgaaagtactctgggatgtttaatcaatttttatcatgtaaacttatttatgacataatgcatatagtcaactttttttaaaaaaaaatttcattcttatttggtttccatgaaaaaaattggagtctacttcaagtgatgtattttaatttatggtaaaatatggataatgatgaacttgaattatttatttagtacaaataaaacaacaattgaaacaaactaaaaatcatatactccctccgtcctagaagataagaagtttctagggttggatacgattattaagaaagtaggtagaagtgagtggtggagagttgtgattggatgagtagttgaggtaggtggcaaaagtgaatggtggatagttgtgattggttggaaaaagaatattggtggagaagttgttatattttgggacaaatcccaagggctaaaagttattatattttgggacggagggagtacaacttttaaaattatagtcgttaagctatctgattattgatttttttatatgatgtgtatgtgtggggatgttcatgtgaacacatatattatgtgtgaagggttggaagtgggccttttcgctttttatactgttaagatatcagttgaaaataataaggacaccgtgtttaacttaaaataatcaatggttaggttttgtacaagttaaattatagtcaacgggtgcattaaattctaatttatgattttaatcataaatagcataattacacaaatataacgtataatttggtctgatagaaaaaaatttcataaagaaaaaaaggaagaggggacatctccttttcaaaaagagaaaaaaatcaatcttatcctgcggcttggagtggtgggcctattaattttagtaaaaattaaaaggctagttatttcttttttctcatcttttctaagattttatctaatttattaaagcgccacgtagtatcataggagtatttatatgagcgtcatgtggtggcttagaagtgtttataggaagtttaatggacttttattatataatagatagatagattgattgattgatattgtcgatataattcagcgacacatgtttgtagaattatttaaggtgacatagtatatgttgtcaacttttttatattttaaaaatatttcattgttatatttggttgccatgtaaaaaaatagcccatagaacaacatagatcttgaattatttatttaattataaataaaacaacaacaaaaataagccatgtaactattgaaattggaagattaggaaaaggtagagaatatgagaggagggagtacgtaacgtacgtactaattggaggagggtaacataccagcgaggaggggaggttgggaccggtaccgtgaagagggggattttatttatttttattactaaggccctgtttgattcatcttaagattattataatctagcttattaggagtaagctgaaataaacaagtagattattatagcagattattgtaatctataagccagattattataatctaataagctgctctaaaagagcttttttcagattatcgagtggctaaagacccactactcctacatacttgagaaaaattacccacctatgccatcaaccgaacagatagctgggggcattatagactttagcctttcaaacccaataatccatgcctccaataatccagacaaacaaacaactcacagcttattctatatcagcttattataatccagcttatagcaatctggtttaataatctagattataataatcataagctgaaacaaacagggcctaaatctaatggttgaaaatattggacccaccaatttaaagaaaaatcaacggttgtattttagagtgccacttgacggcttatgagcgtttgtaggagtgacacatggcggtttaggagcgtgtatgaactaattggaggagggtaacataccagcgaggagggaggtggggaccggtaccgtgaagagggggattttatttatttttattactaaatctaatggttgaaaatattggacccactaatttaaagaaaaatcaacggttgtattttagagtgccacttggcggcttatgagcgtttgtaagagtgacacatggtggtttaggagcgtttgtaggaagtttaatggacttttagtatataatagaagatagatagatatatagtagcagatttttttttaataatggattaaaccaatctctgcacccaaggcaaatgtacacaacatatagtactagatagaaaatgaactaaatatatagtactagatagaaaatgaactagtaaacgggtttttatatgctgctagcgggtttgccgacatacatacattagccgtcataggttacaggagcaagacacaaatgatgttcgcggcgcctctggaaaaggtaaccacaggtaattctaatctatcactaggaagttcatcccgttttcattggacactgaaaattcagtctgcgcctgcgtgcatctattaactggcagtatattatatatttatgtcatattttattagacatctttggtgccttctaatctactccttctagatatagagtaatgtctacatttattgtactatgatgtgttatatcctagtacgtacgaggttagtttttttttttttggacggatggagtatactgattctaccgtgcgatcctgatgaatgttcaacaaacaatattgcatcatggtgcatataaagtgcaaaacacgatctcatgtagtttgcgaacatcatgaacatgaaatttatcaaatctcaagtttggcaaattttgtctgccttgaataaaactattatagatatctagtgcacctgtttgcaccggctcgtgcgactgtcgttccttcttactctctccgtccaaaaaaaacttaacttctaggctttgaactttgtcccacaaaaaaccaacttctaccatctacctaccgtcagcacgtaaaagaataagttttattccttcaatagtttttacctacctatcatcattactacttttttcaataatgaggagcattttgatcattttcactctccaataattttgcattgggatgcttgggactgagggagtagctttttagctagaggcgttattgttggagggtctttatcgcggttcaagtgttgctacagttgagtatgtagatgacaattgtttgtggctgtagctcgccgcggaatgatattaatttgctgtcgtcatggctttttctttttttttcccaccttaataaatataggttatgttcatcctatgcagaggagaggattggtcttagattaagtgtattactatcttgttgtaatagtctgggatataaaattcctttatcgtaaaaaaacatttgcaccgttgcgcagattaataagatccttttcacaaaagagctatgaaaataaaaatgttgtacataccataagcttgccaaatgaaaaaaagaaacagctcaagcaaggagggggctatgttttctaagagattatgcaaaccaactcctggaagacttactgtaaagtatttgccatactgcccatatgggtggtttcaaacaaaaaaggcaaaggacaactgttcttagtttggtttgttgtaaaaaagtaagaaagtaaaaaaaaacttcaagtgctttctgaatccttattgtgaatgagcttcatggaaccaattgcgtgttgccacgttaacattgagcgaactcatgttgactgctgagcaaatctggtaattgcatatctcagctaggtcatgcaagatgaacccaaacaatcgttcttccatataagaaaaaaatagtcttatacaatgagagcatattgaaactcttcctattcaggattaaagaaacataccaaagtacattaaaagcttgaagggtacgtggaaaataaaccattgcatcagaaatagtgcccattgaaacattaaagaatctagcttttcagaagttcaggcatatatagcataggtgtaaagtcaaacaaataaatagtaatttgacaaaagaaagatacttgagatgggaatttatcttacaacataaacagatatccacagggaattgcatgagctagtgtaaatcctaatggcctaagctgaagacctggacaaaccaatcacaacagggagcaaagatcacctgatcaacattagtcaatcccgatataaaaataaattagtgttgaactgacgtcggaaaactaacatggtttttttcctcaacaaacttgctggagtaattaggaaggatcaatcgaacaaaccaacgtaatgcagataatcgtcattttgacaaacggtcagcagctatatataaaatcaagttgttgggggtcaaaacatcggcaaggtaattcagcatcaccgaggatgagaaacatagattagtagttgtatgcacttactgctttactgaatcaaagggctggttagcacgctgcttgagcacgaaatcctcctacatgaacaccatgtaatccaaacttgagatgaatgcaaagaaatactgggaaaaacgtagggaaatcatcaaatatgctccctgacaaacttgtgtccggcaacaatgacgacgccagtggccaggaatcggaagggatggagaagtgaatagattgaactacaggatgagtgagatatcattttctaaaaaaaaggatgggtgagatataagcctttattgggtcgtcggtttctggtgatcgatgatcatggtttctggtgagggaggcgaagaggatgcttttcatgacttaatgtcagccatcaagacttctcgttggttggcgtcggcatttgccgcttttcatgatacgtacgtcgaggaagcgagcagcctggaggagtcactagtaaaaaaaacctcatatagatcagcactataggtgccgaaatagctaaaaccggcacctataatgcttttccctcctccatggactcaaaacacgtaaaaccaacacctttaagcaactataggtgccggttctcaagaagaaccgacacctatagtataggtgccggttttttttaaaaaacaacacctttaatataatataagtgtcggttttctaaaaagaaaccagcacctatccaaattgagccgatccaggccgacgcatcggcctcatcctatattagtctcgtccttatcagcctcatcgatctcttagtctctctctcgcctctctcgatctctctggtctctctcgttctctctcgcccctctctctctctcgcctctttgtgtagcgcacggcggcggtcgggcggcgtcccggcggaggcgtcagtggcggcggtgccctcccctccaccggatccggcggggggagacggcgggagacgggaggcagcggcgccctcccctccgcttgatccggtgggagggaaggcggcgggcgacggcgagcgcccttcgctccgctggattcggcgggaggggaggcggcgtgcgatggtgggcggaaccaaggagagggaacgcatgcagctgttgagccgggtggggaaggtgacacagaatcgtcggggagatggcgcggatgagatgggcccgcccggaggaatgcccgtcgcctgcatgcacgcgggagagttaacgttttggcctatcgggtttttctgtgaatagcgtccaggatgttccactgaggggacacgcaggaccatcgatatttgatcaaacggatatggatcaacctgatgtaggcacacggaggaccatccagatacgattgaatgggtgtgatcaacttgatgacgtggagcaaccacagtgcaggaaattagtaagtggggataatttgtatagatatataggatttcaggcgaacattgggtgatgagccacaacctatacatggcctctaaggccaaataaacgtacatatcttaattagtgctagctcttgaatatggagaaattatgtgattaattaagaccttctaattatctgacaatgagtactatatcatgcaatttaatgcaactattttaaacacaagacatagcttcaggctttcagccaacgaggttttaccttatccctgttttatttttgtcatttcagctcagtacacagattagagatgtagaatcagccaagtacaagtggtccaatacttttatgtgttcatttgttagaattaatgaatcttttttggtatcataaaggcagcgagagatatatatgagaacagatgacatgtatatatatatctcacagtttgcttcttttgttctaggttttagtttcgccattaattctcacaaaccaacatgtgtttcttttatttttttggactcatgcagtcatgctggatgtaggtttgggaagcattgggagattggtacgtgccatcttggctcgagtgatgccaccactccgcgacgactactcctgtagatagtgctgaaatcggagggattgattgtacgattgcacaccaataagtaagccaaccagagggggtaattcgttgtagtactccaaaaccaaaacttatagatgaattaaaagattcccttgaatcgatgaagatcggtctgaccggagttgatgcaggtctgaccacctagaagccaccagtctaactggtgtagtagctccggtttgatcgtcaatcaccggtctaaccgccgttcactcgccgaaacctaagtaaacacaaatcgaaattctcccaaagtagattgaactttattgtttctattcgtgtttataaaatgcaacaacaacaatacggctgtcatttttttttctaaagtaaaatatcattggcagtgcgaacaaatatgaaagtacatctgaagcaaaattcaacgatactatttttatatcactaaattttatattgttaagctaattgctagttaaaattatttgaaatgaattgcatgctgtttgggtcaccttttattaccaacactttggaccaccatttattacctagtgcaaagtgaaaatactgtgcaaattattgtggtctaaagtaaaaaattggtgataaaattttgtaataaatggtgaaccaaattgtagttcactctgaaatttatagactttgactcttgaaattgcgtgggcaccttgtattttctagtggaaggagtagtattatagttctttttttttgaaatttccccaaaatttctttattatttcaaatttgaattggatcgaaataatttcgatttgctagcggaatatattcctagaaaggccaggtatcacggctcaccgtggaaaccggtcggtatttaccgaaatggtgatccttgactatttatgaaaactattatttgcagttctactgacacattacacatggcctctcaaaaaaggaggacatattacacacatgacaatcgatgcataggttcatatgtaccttcacatatgccatggtcttatagtactgaacaaaatagtatttgaacacagatagctataacataacgtggtctagaaattacaaaagatgaacaaagattatctcaatatcttgtctatcacaaatttctttgaagcaacaggtttgggaggtatcaggaactagtgcatctgagctagagagatcagagaacattcttgccctccaattcttgcggttcttggcactctgctcacactggaaacaactgtcaccgcgcattcatgatcactgacgtgaaagaggaaaggattgcacggctaagtgagaagatccaccgatgaaaagacttgcgtgttttcgactcatccatcggcattggagctacaaagagtaagcttgatggcaaacgtagcaacagccaggacataattaatttagatggagttgttcagaacatggttcagaacttcagattgcccacttgacattggtaccatggatccctcccaaaatggtttattatcaatttaattttctcctcatttggttgaaatttgttggaaactcattcaaagttcaaaatcgagtgagatatcaacatcacgtatggacttaaatttcaaaaactgatattgtgaacctggtatagagttgactcaatggatatagtcaatgtgagagaagcatgaaataattctctcttggatagtctctatatctctctatttgtgctatgtatgtagtagtattttctcaataaataactgtaaaatcaatcataagcaacactttaaaatatcctatatatattgttatcacaatttttttgctattaccaattgaagtaaaacttctcgtccataggttaattttttctgatggatctatcatggcatgactaatgcgagccacagagctactaaccaataatttcatccctctggcacatgcacatgccacttatagataaaaaagaagaacatataattaatttgcaaaaaagatatcttgtacattagtgcatatacatttaataactggttgctaacatacataacttggtccataaattggccttgcaaaattgcacccattgttgacttaaaccgggagacgtttatccaactgggagaaggccttgctacgtctcaaaagctagctaaagaggtgagcgacttcctccacttttaacctgattcaattcttcataaactattaatgtaggactattcccgacaccactaataagtactagctagtagttgtatttttaccgtctagaacacacaatggaagcatgatgaagatcattggtgaaggatctatcagggataaagctcttgacagatattctttcaaaaaaaaaaagctcttcacagataaactgcacgcatcaccaattcactaatgtttccgaactctgaaacagtaggattggaaggcgctgggaactgctgcatggacctcatcagttcatcagggcatccttggcttcttctgtcccccaaatttccagttgaagggcgaagaacctacaagaaaatctctggacgatagcttcaggtcccgtcctgccaatctgcatgcatctctgattctttaccagaacgcgtatgttttgaccatccaaagttcctatgcatttgatgtgtttttgaggacagtcatgaatatgaacatgcatgtaaagtgcaaagcatgtcctaatgtagtaacatcatgaacacatgaaatttagcaaatcaggttgtcaatttttggctgccttgaataaaattattatatctagtgcaccgctacaatgatggcgtgtgcacctgttgttccctgtttttggagggccgttatcgtggttcgtattgctatagtgtggatgaaaatcacttgtggttgtagctcgctatggcataatatttttatatttttaattagattaattttatcatcttgatgtattgtctgagatataaaactttctttatcttaaaaaaatatacactgttctgcaggtttaataagctacttttcaaaaagagctatgcagatccagtgatcaactggtattaacaatttgtaaccacaataatgtacatagcttaattagtgctcttgaatattgagaaatgatgtgactaattaagataccttcttactttatatatatgacaaggagtgctatatcgtgaaattgaatgcaactattttcagacaatttcatgatatggtttgtacgcaaggcgtagcttcagactttcggtcaatgaggttatgccttatcccaattttcattttacactctagcatacaaagtagagatgctgaatcagcctagtacaagtggtccaatacttttatgtgctcatttgctagaatgaatctttttggttggtgatcataaacatagagagaggccaatatatatgagcacgcatgtgtatccactgtttgcttatttgttctatgtttcaatttctccaccatcagaaaccaacacatctggttcttctatcttttggactcatgacgtatgtaggtctagaatgcattgggagattggtatgtgcagtttaggatgtcgactgatgccgacactccgtgacaactactcccattgatagtggaagtcagaggcacaattttaaagaattctatcagataataggatcaactgcattg

SEQ ID NO: 75969 - DNA, 2990 bp, Oryza sativa
tagcatagcttttcagtcttttgtagaaggctggcgatgttggatactacgtcgacgactgacgaatgcgaactaaaaactgtatgcattttgtctgctttttagccttgacgctttggttagtttctggggtttctttttaccctctgaattcgaagcatgcgtatgtcgtttttcagcattggacggtccgctgttatagtacaagaaacaagttgttacattttgtattatgtttgttcctaaacgtttggcgccaataccgagctatcgtcaactcgtcatgagtttatttgcatcacctcgcactgactatcggatcttatactccctcattttcaaaatgtttaacaccattgactttttagcatatgtttaaccgttcgtcttattaaaaaaaattgtgaaatatgtaaaactatatatgtacatgaaagtaatttaacaatgaatcaaataatatgaaaagaataaataattacttaaattttttaaataagacgaatgatcaaacacgtacttaaaaagtcaatggtgtgaaatggagagagtacttcatgacaaagtacccgacactataccgtgaaattgtatctgccagtgcatccggatgtactgcaatttcctccctatttacatgcactctcacatgtgctcggcttgcatactcttgttctagtacagaaaactgcacattatgcttcgtatatgcgagatcgatcgatgcattgctgttcaattattctcgccaatatgtgcgaggagagaagacaagaaatacaattcctcagatacatttttggctagtcagagcatgtgcaacagtgcaagatgatgagaaatcgagggccaccaaagaaagaaatcaaagatgcatggtccattggtccatgactccatgggggttaaaaaggccacatgatttgtagcgcagggatgtacgtataaaaaggattacgctgcctttttctctccctctcgtatggttgaatctgaatgagtggtgcctgcaaaattcaggtatatgatgtggcccatcggtggccgggtactcgaatactcgatgcacatcgctgtttgtctctctctttctttctcatgttacagccatgtcgaagcaccgtttgtagagtccacgaaaaacgggaaaatgcagtgcggacagagcatgtcatctcattttcctcctgcccaaatcagttcggagactcattttcatctttgcccaaatcaggttagggacgtgacatgcttacccaataattgctgccaagtgccagccaataattaggtttgtatggtttaccagtagtatcacccatatgcctacgtttctagaacgggaggagaagaaggcctaaacaattcaccgatcgaggtcggcgcccccaaagtctactacacaaaagctgggagatgagacctcctataccgctatacagctactcaaaagctgggagtatattactaggaatcgtaaagtagtaacacgctgcatagtccaaagcggcgaattcgcccatggattcggctgccgccctgaaacgcccgcgcgccggcgccgcgatatgccgcccaattagccccatctaaccccaaccacccatgccgccatcggctgctgccgaaacgctcgatgtctcggtcgctgatacgtcgaacgtcgtcatacgtgcaggacggcgacacggcgtgcagcgcggcgcgggggcgtcgcggtacgcctcgcacgtctcgaaaggtggccgaggagtgtcccggatcgcggcatatatggggcgggcctgcctagcggctcgcaccgcacatgacgtgaaatcatcaccatcacgccgagtcgcgcggatgaccgggacggccggacggcccggatcggcgtacagctgctcaaggcccggggggatgagtggatgaccggttcggtttgtggctggtcgcgcggtttccttgggcatcaaggacctcccttccaattcaaaacagggtgctctttaaaatactactcctccataacaacgtaccaaaatactagtaccaaaacgtaccaaaacggaagctgtttaattgaccgtggaatggttctcccgtgaatgagcacccccgcgtttcttttgcttgaaggcaagcaacgacatggttcaagttcaacaatcctctgcatgattttctcgaagaacctgagcccgcccgtgcacgaacaaaccccaccgcgcgcgcgcggtaccagcaaaaccagttgttcccaaccctggtcgcgccctcgcgccgtgccgttcacgccgcccgctctctcgcgcgcgcgcacacacgtccaaaccgccatccaccctcgcgcgccaaaccggccgcaagccgccaattcgcccaatccacccatccgcttggccccgccgcggcgtctcgcgcgcccccggcccgtcccgtctactacgatctcgtccccggtcggtcccagccagccaggaaaaagcggccgccccgctcggcacgtgcccaaagctcgtacgcaccaccaccactcctgcaccccgcgacgccgcgcgacccctcccctccccgtctcagatccggaactcgtggctccccccacctccccccacccaccaaaacgctccaggatcggacggaccagccatacacctccgctccgcgaagcgcgaaacacccgccgggtcgcgttcgcgtcgcgtcacgtcgcgagtacccccgcgagacgcgcccccaataccctactactgctactgtaccaccggaaccgggcgcgagacgagacgagccacacaggtcggcgcggcgcgggggacgcacgcggagcttggtcacctcaccggcttccctctgtcctcctgcacggtagttataagaggcctctccgcctcacctcgcctcctctcctctcttctctccgctccacccactcctgctcttctgctctttgttcgatctgtgtgcgcggcggtctgggttggggggatttgaaacggagggga

SEQ ID NO: 75970 - DNA, 31406 bp, Oryza sativa
cggtcaaacatgtgctaaaaagtcaacggtgtcaaacatttcgaaacggagggagtagtttgtatgtcatattgaccttgcatagttaaggtctcgagtatatctccactgaaatagtcagatggcaacaacattacagaaggtcactcactggataacaaagttatcattgatgatcaatgtgcgatcaatgccctttaggacgcctttcccaatgatttggaactatctctttagccctttttaacatttctcatgatcggattataagttacgggttttatgagtggtttgttgtgagaatagtcacttcacacgtatggtttgttattatcttttatgttcgtgttgatccaatcttggttggttgcatgcatatagagcatttacagatacacatttactatttgctcaaataaaaatagagacagtttagtagaggatgattatttcggaaaaacatcacgttgattatagatgatgactttgttatccagcgagtaaagaatcaatctgtatgcatgtaaactattaaataaactataaaataaagacattattaatagtttgtttccaatacttgtatagaatttgaaagaaaaatgtaagaaaatgctacttactagtctcacttgcatccttaccaacatccatcgatccatccacgagcaccaaggtaatcgcgtcgtcagtacgtcacgtacgcggcggccggctaggatatgaccaaggggttgatcacttccccgtagtactgtcagattagttgctattcttcgatccgcatgagctattctagaagcttcaaaacactgcaatctcgatcgaaagtcgtcctttcgaggtaagcaaaaagcaacttaaattagcttttgtaaacaaaaggctttatatacaatccagtccgtgcaaagcaacttaaattatcttgaaataagccaaacggtatatttataaacgaaaagtaatttgtaaatataacttttatatacgcgcttttagcgatctaaaagcaaaaactaaaaaataaacttcagcgtaaaaaccacaaaatcagtttcaatttaaaggttgaaaatttaaatttagctgataaatataaacgaaaagatggagcccatctctactcgtcagtggtatcacttgattaattaggggtttaaccattggtttcctcgttgaagctgttgcggtacaaaatcaagacgtgctacaggatatgaccgggcgttgcgccgttgccgtcgccagcgcgcatcgtcgcatctccggcaacccgggaatcgatcgatcagctcgtcgcgtctccaaccataatactcctcgtcaaaatctctattctctagtggagcttggcgtatcgatgcgtttgtgcgaggcagagtgcgcgtcggggaaactattttaacgtacgttctttgcatgtcacttaaatggttataaaaaaatttgaaaaaaattgggaaggtgtattaacatatgatataacactccacaaacatgcaagttcaaattcaacgtctacatctcgtaacgaaaaaacaaattgaaccgcagctagttaacgtatattcagagtcaaatttgtttttttcgttgcgagatgtagaagttaaatttttacttgcatgtttgtggagtgatatatcacatattaatacatcttcttaattttttttaaattttttcataaccatttaattgacatgcaaacaacgaggggatattccctcgaggatcaaaatcctcttccgtgcgcgtcgtcgtctgcaccgcggacggcgcaggtggccatgctgcagggagaggctgggctcgacgtggccccgtgccggcgcgcgcccttgcagttgccggctgtgcgtggcactgtatgcaccggagcgcgcgacgctggggcgtccacttcgcgttcggacacgcggttgacatgctcgagagacgagacccggggccgttcgttcgatctgctcggcctcgcccggcgccgccgacgaggcgaggcaaaacgatggtcacgatcgacgcagcgatctcataggctgcactgcagggagcttgcgggtctcgacgtggccgtgcgcgctctcagctgtgctggtgcaaagagcacgacgcgcgcatgcagtagtgccacaccatagagcgcggaggcggtggtggactggtgggtggtcgatcgcacagtggcacaacacttaagtaggatggcaattttacccagggtcccgatatccgcggatacccggctcaatgggcatgggtatgggtgtaatattttgcctatgggcatacccgcccgagacccgagaacatagcgggcagcatccgagtattgttttttacccgcagataacccatgcccaacctaatacatatgtatttgctaattttggcccatctcttattcctcgtacccttttctcttagcccatttgacccactaaccaaggacatatatatactcaactaatagaaaccctaacctaattccccaccctcttctcctaccccaatccccatggcggctggcggcggctgcgcggctgccggtggcggcggcagcggcgcaggctagcgacaatgcagtggtggctggcggcgcacagcgcaggcggcggtgcacggccaagcaggcccgatgggtactcatcgggcatgcccgtgcttgacgggcatgggcacgggcataggattttgcccgatagaccttgcaggcatgagtcaggcacgggcacgtgggtcttgggtcgggcatggaatcgctttacctatgcccgatccgacccgttgccatccctagggctgtattcggcacccgttcttcccaacctctcttccttatttttcgcgcgcacgcttttcaaattgctaaacggtgcgttttttgcaaaaaagtttatatacgaaagttgcttttaaaaaatcaaattaatcaatttttttaaaaaagctaatacttaattaatcatacgctaatgaactgttccgttttccgtacgcactgttaactttgggaaccaggctgtccgaacacagccttaatcaacaacgttttcatggtagagtttgagtttgacgtccacaagctgaaggtcgtcgtgtcgggctcgaaccacatgatgatctggccactagctcactacgcatggcacccgctgctatggtgggccaattgagttctttttaggttattgctagaccggatatccgtttccgtgtctacgtccaacaaaaacagatttattatattcgtatttgcataaaaaaagatacgaattttaaaaaaaaactcatgtatgtttccgtatccgttttgggctaccctaagcccaataaaataaaaggaaaagcctaagcgcagcccaataggaattcagcgccgcatcaggtgattcattgcagcgccgatcatctgaattctctccgctctcgccacctccctctcatcggcggccgcctcttcttcccgctccgctggtcatggaaactcctggaccggagccgaaggcggcgacgacggtggaggtttccgatgaggaggaagtgaaggcgatcgctgcagatgcgggatccgtcaccggggaggggaagcgtctcgacgcggcggcggcggcgacggcctccactgcaggtggagacggcggcgaggaggagaagcctcctgtcatggtgcagatgcctctgaacaccatcgccgccatcctctcactgaagagggagccgaggccgatgcccgaggacctggcgcgtctctcgccggaagagcgcgacgagcgcctggcgttcttcgattcatgggaggaggtcaacgacgagttcgaggagttccagaaggagatcctccgcgaggtgaaggagactggccgctacatggtccaccagagctacttcacggagcaggcggagatgcaggctcgtatggagaaagaatgggccgagatcgactggaccggcgtcaaattcggcgactgggactacgacgaccccacttgctgtcaaccactgtgatttcaggctcgcccgctaactgagatgctgcagaggactacttctttactgtatcttacccaaatggtctcaagccagcttagcttttgagtactgcctcacccttagctactaaattactagctctctgtcgggtagtagtatcagttatctatggtgtttgctaggtagtaatgtcttgtgtgatttgaccgacccttataaggaagaccatgtggcttatgctatgaatgaattactttaatagtagtaagtctgttattattaagtttctgctggtattaggctcgataatattctttcttggagttcctttgtgatgctctatgtgattattactgtgctaactctatctgtgatttactactttactaactctaacccttggttaataagggggcataccagtgctctgtgattagtggtaattttggtatttagtttttgttattctttgagactgcttccaagagagcgcaaaaccctcctctaaactaaattttgggaattaagtctgaaatcatataccaaatccccttcctcgacggtcgccctgcacacttcactaggtgaatgatctgcttctctgttctgcatctatacgaactgtgatggatgagttgttgccaaacagaactgttggtacttctttggaaaatatgctgttgaacttgtcttgaaaatggtacagcatgtttgttgtaattttgcacatggttggacatatagcacatgtgatgtttgaaagcagcatctttttggcagtcaaactgccatgtgtgtagcttagctttacaaattgcaagaaacatagcaacctgaacttctagaagacttttgccaatgcctctacaatcagatttatatccgtgttcattttcttcatctgcaaataaaccaagcaataacagagtttttagatgtacattaattgagctgcaataatagagttgttagtcgttttatggcataaggtagagatagcaaaagtcgaagtactaagaaatcaaaatctgcgtgaaaacataccctatagaagtcttcaactttggaaatcattatgatccagattactatagctgaaaagcatttgtccaagtgataatctatacctagttgatgatgccaatatcatttttggttgtgctttcatggcaggtctaattttggacagcagacataattttgtctgtgcagatctctatccagtttatttgtttgtggattataaagcgagcactacattgttttgtatcacctaaaaatttatttgattttaccatgctaattatgccctcagtccaagtgtgataatctgttgacctagtttatgacttgttcatgttaagattatatatgtattagtgtgtatgtgttaaggggtatttctgtcttttcacgttgtattcatctcatattagccctaagggccaactcaatgaataaatagttaaatccccaattcactcactgattttgacatggtatcagagcagagatcctaaccctagcctcaatccgacgtcctccccggtgcgccggcggcggacgccgccgccggcagccacaccatcaagccgtcagctctgtcaagatgcattagcttctcgtcatcgtctcattcatcttcaagtagcagccagtagcagcagccagcagcagatcgtctagacattgactacctcatcccatcgccagtcgcggccgccgtatcctctgccggcgggcaaaccgtcgtcgtcggccgtcgcagcctcgccgcctcaatcactggtctcgtcctttcatcaccactcgcagtattcgtcaagcaaaccaacagcagcagccctgctttcgtcgtcttcaagcagcaaatcattaagaagcagcagccattgagctagttgcagacttgcagcagcatgtgtcagcagcagcaagtcatcttgatccatttcatcctcaagcagctgaggaaactcctctgctttcttctacattctcaccaaatctaagtggatctgttgcatttaggcttcagtttgagcctctgcttgttgtcctggaactccattttgtgcactatcatcaacatcctttgtttcctatcctatattttgctagtatcagattgccatgctataagcttgattgctcatcatcattttgtgcactgctagctccttgatttatacctaatatcagttggcacaagttctaaaacctcccgcatcatgcttctatcatgtgctgcaacacatcaacagcataaaccagtggattacttgggatatttctaattgaaattggcttcttgattagtagatgatcttcaacctttagttcgaaatggttctcttccattgatatgccatgatttggatgaagcatctagggtctcagtctcacagtcctacccacaaagagtagtgttgatttgttagcctctaatcgtattccatcaacagatctacttatttcttctacatttgctatgtttgcttgctgctgccatcaacaattctactaatctccttaggcctattgatatactatgttgtcatatttcctttacaatccttttgagtccatccaagtccaatacacaacgattcgttgaagcgtgctaatctatcttcatcactagttccccactggagctggtttatcacaccacatcatctgcattgtcaactccccatcggagttatcatctccaacttcaccagctccatatcggagttggacatcgttatcagtcaaggaccgaagaacaatttgtaaaggtccattatcatcaccatcaacatctctagatctacaaaggtctgaagaacagtttgtgaaggaccttcatcctcttcatcatcatatccacatctccgaatcagtgattggccgaagaacggttcgtgaaggctttaaggtaccaaaggagctgaagaacagtttgtgaaggctccaagatcctcttcattgaggaagggatggatttccatcttcatcatcattctagagttgcacgattcgacaacatcttcaagcatggactgtggatttattctagtgtgtcattaatctatatttagtttcaaatgcaatgttacatatacattgcatttgagtaggggtgttaagaatatatatgtattagtgtgtatgtgttaaggggtatttctgtcttttcacgttgtagtcatctcatattagccctaagggccaactcaatgaataaatagttaaatccccaattcactcactgattttgacagttcattcatcaaatttgagctgcatccttttactgaaaaaagtgtttactggactattgatagacttgatgtttcgaggttcagagactattaatttggttccctgataatgtctcaagagttttgtgtacgtactattgatgatggaaggagaaggatacttcactaactcgttgaatgagggaagcattatagattttggcaaagtaggtgtgttcattgtctgttatagtcaacatggttagccaagggctacatgagccaaatctgtgtatgtgggtgaaagaagaaaagaaatactgtccaagtgctatgtgagccaaatctatgtatgtgggtgaaagaagaaaataaatacaggaatcatttatattcattcgaagatatttgattctgtaacttcctgacaagagtttctttattgcattttctttgtctagcttttaccttgagttttattgtgtgcaagcatgtgaagccaactacctccaagattcagatgttgtatccgctcgtttccaggtaaattgttattatttcctgcaggcaactagttctgcacatacatttgttttgttctatgatatacaattttctctcttccggtttctacagaaagatgcctatggatcttgggagcggtatctttggtaaccgcagtctggttgtgaacttgtgaagtgaacgtcgtgaattcttgtggcaacctctttttaccttcattctgtcactcggcttgggaatagatatgctatcttgcgacctgcatttccactgctactgtgttatttcttgcataccttttaaactttcatcaaatgatctttcaaaatatttgggtttgcctgatgttttaaaggattctgtttaaatcccttttagttgaatgtatttatgaacccagtaataaagatgtttttacttgcattttacagtatttccctatatgtcacaaacttagagatggcttagcttctaccaaagaagatacctcacctggcacatctggtaaaagatcttgaagttaactttggatttccccataaatatcttgttagttcacatgcatttttctacactgtaccgtagcattccagtgccgttttatgtgcacgttactatggattagaaggacctgtatcttcacgaaattctgcttttctcccctggtttcaaccaacatgcagaaccgtcacacgacaggccaactacggtctaacgctgggggctcgctctgtcttcttctgtataaatcatgcttgtttacggtttacataatatctcatatttacatctgcttgttgtatcctgataatcctagaagatccatgcagtttttcgaatacatactcgatattatctgctatatgtcttgccttctagaaaatatctttcaggaacaattgagcactcgagtagaatgtagtcgagtacgccgcattatcgagaacgatctcgacaaatgcagagccgtcgcgcccaacctgccaacgaagaccgacgacctatctcatagcaccggccatcgctgggctactcgagagaaggttgttaacggataattcctcgcgaacgtcgtcggcttgatcacctgacatgattgcgaacggacatccgggtatgctataagttgggtacgcgagtcatgctggccacatgagatacacttgcaacaaaccaactctagcgcttccatcggtgttcgagagataattctgctcgctcactggttctcgcaccaggacgtagcaatctctcacaccacagcttccatcggtgttcgagagataattctgctcgctcactggttctcacaccaggacgtagcaatctctcacaccgcagcttccatcagtgttcgagagataattctgctcgctcactggttctcgcaccaggacgtagcaatctctcacaccgcagcttccatcggtgttcgagagataattctgctcactcactggttctcgcaccaggacgtagcaatctctcacaccgcagcttccatcggtgttcgagagataattctgctcgctcactggttctcgcaccagcacgtagcaatctctcacaccttaacttcaagtggttgagttacgactactatctggttctcgaccagccgtgtagcgatactcccactacttcgacttctagtggtcgagttacgactactatctggttctcgaccagcaatgtagcgtttctcccactactttcactttaagtggtcgagttacgactactgcctggtcctcgaccagcgatgtagcgtttctcccactatttccacttcaagtggtcgagttacaactactgcctggtcctcgaccagcgatgtagcgtttctcccactatttccacttcaagtggtcgagttacgactactgcctggtcctcaaccagcgatgtagcatttctcccactatttccacttctagtggtcgagttatgactactacttggtcctccaccagcggtgtagcgactctcctactacctctactccagcaaagttggtatcaggtacataatattgccaagtgttttacccagagatcccttacaacgacgacacctagcgttgaaacctgtcctactgttcctttacgccgtgctgacaaggcctccgaggaacataagtgatcttcggctggggacgcccatagccgataaggccttgtcggattctgtagagacgaaagaccatgtaagacctggtcgtgtaaaagttctccccgtgcggattaaccaagccgtgtaatcggaaactgagctttccaacttcatggctgggggctaggattagtgcttattcaaccaaggcaggtcaagggtccaagagccttctcctccgaaaacgattctccaacgacaaggctggggcctagggagagtgtataactcaataaactgactggtcgaagtcggtaaaagagaagacgctcatacacaaaacattggtcggtaaatttaattcattcttaatttaccatacatattataacatgtcaccctttgagcgttcgctcgggggctatttctatttgatattcttttctgagtattgatttcaggaaaatgctgctcgacattgttgaagactccatgtctctatggttctacaccaagatcgactaaggcgagtacgaccaatgttgacaaggctccgtcgtagactctacgccttctcgatcgctcgagaacggttgctggatctcgacaaggaatacggaatgaagaaatggtgtacccgccgagataaaatttcctgacttcaatccaaattctctattacggcaagacgggaggcttagtcgtacgctctgtactttctcggtcgacaccagagattggcttagacaaaccctttcggtgcccgcacgaggctgataaaagaagtctaacgttatccctaaactcaccgagaacggtcacgtgagctcgataacagttactccatggtcagcggtcgagaatatgaattcgttcatttgcattgaagtcgggggctattgtcagggttatgaataccacatacctaatagtagttgactaaatctcagcagggcccaccacataccatgtcttatacggaaactgacttcgagggagttccggataaggaaagacaaccaaagttctacatggaaacgataaggactactcggattgtatccatattggcttccctagttctacttggacaaggggacacctatgagtataaatacaagcccccctgggaggacagggggatgactgaccatgatatgagacgatcaacacgatcaacatgatcacacggtcaccacgatcgagatccacctcaatcagcaaccaccacaatatacggaacaacagaagccaatacaagctaacatacgccaagacacgccgctggatatcgacttcagggataggcatggctattcccctacggtgtctccggataccgtcaggagatacgaaagtgctatctctgatctcgctgggcacggattcgaggaggaagactaccttgttgtcgactacgagtcagaccttcagaccgacatgtcgacaacagttagataggctacccacatattgtactggtgtgattatggtgaataaaagcaactccggctccggccaacaggatgtagggttattaactgacaactcaggggcctgaacctgtataaaaatccttgtctccgtctcttttacctaagtctcgcgtatatcctagcaccaacgaaccccatactgtctaaataccgtagtcgagacatcaaatgtcgacacatatatattctaaaattaatttcttttctttgtgtatttatattttaaaatcaatatgtttatatgatacttgtgttagagttagatatcattgagtgattagagaactaccttaagtgctaatgatcatcacatttgatgatatgtcttttctcaatcatttatctataaaattattctcgatatgtttttgcaaatgcgatttgagtagagatcagtacgctacgtgggagaagcaattgactcacccgacaaactaaggatgagaattgaacaaagagtaagtatgctacatgggagcagcaaccgaatgagactcaaccattataatagacttgggggctagagttaagttggggcatgcatcgagcagtaggtgaccacaagaattggatgtttgccacttactttagatcaaggcaatcaacacattatttcagccatctgtcattactatttactgacttatttttcttttttttaagaattacacagtataacgtagacactcataacgcacacacaatcttatttgaaacactagaaattccaaaatcttgaaaaagaagttgaccaataaacctttccagaggaagcagttgaaggtcagattccctgagcatgggagaagcggtggaactgtgtaaacaataaggaaactcctatttggatgcatggaaaggtcagctttggcggggtgctttgcaaaatttcttgatttcaatcaaaagctgatactaaattttagacacttggttttacaatttgttttaggggttaattcgtaacttttgttgtgtaactctctctcatgacaacgtatgatactcaaattctgtaccctaatgatctgtatagatgccctcaattccgtctttctttggtatcatctctacaacttgttcaacaatggaactgtgatagtgtagagagaagcacactactcaaatttgtttttgggatggagagaccacaaggaggcaaaagtacttgtggaacctacatattatcagcaacaacaacaacaaaaacactaaaatggtttaaaccgaaaaataaaaatgtactcctaaaaagtagtgtaccggtgactaccatattacaacaggtaagaaagacgtcacaacagtaatcacacattctatttttatgtacccatagttcttggttctagcagaaactctcccgtgtcgtcctcccccacgggcgacacgggaggtggaaactgccggcgtcgcccgctcctcccccctcctccctctgccgcctcgccgccgcccgagcggccgccggcaaagccgcgcggctgcaaggacggcagcggcggggcttcaccctcgtcttcgtctccctctcccgtcgcggtggggggccgcgcgcgggacggcgaaaaccgcccagatccgggctgccgcggccggatctggcggggaggccgccggcggcgggtcagtgtgaggtggcggcggcagttggtggtggtggcggcggggattgaaggtggcggggtggcggcggtagttggtggcggctggcaccgaggaaggcgacgacggtggcgagggagatggcgacggtgacggggatggcatgcgtgctggcggcgtgctgcttctcttgctgggggcgtcggcggcggggttggagatggcggcagggatggaggtggcggcgaggctagcgacggaggccggatctggcggcgaggctggcatcggcggccggatccaggcgctggattttgccacggatctggcgcccacggcctcgcctgggcggctgggggcggtcgcggcagctagtgcggtcgagacggcagcggagagctcggcgacggtgttggggtggctgcgttggcggtgacggcggtttgcgacaattgctgctggcgtcggtggctggtgatagcggcatcggcgacggcggccgacttgcagcggccgtgattgagaagacggtggcaacgttgaaggatgcggcagtggaggcggggaaggagttgggtgtgaggtgacggcggcgacggtgaggtgatggtgaccgtgacggtggtgggaggaggcatggcggcctcggacggcttgccgagggcgtggtagatggctgcatcggccggcgcagcatcatttggaggaggggtcggagaccggctggacgcagagtggcatagccgatggtagcggaggccggctcggcgcgagaggcgtgggcggcggagatggaggctagcttggcacgagaggcgcagcctatggagggaggctggatcggcgcgagaggcgcatccggtggaggaggccggcttggcgcgagaggcgcgaccggcggtggaagaggcgacctcggtgcgtggtggagctgccggtgggtgtggcgcggtcttcggcgcacgaaggctggctggcgaggggcgtcggtgcaggggccccacatgtcggcagagtttgagtggtggtggagcatcggtgcatcagccgtagattcgtaggtggtgagcggcgggtgaaaacccagcccggcgttggccggaccgacaacgatggttaattctccctcctgagggcgttgtcgtgttgtctcacccctcaagggtgattgccgggcgaaagcccagtcttggctcctttgagccctgatggacggcggtggcggttttccgtcgcttctcttcttgaagacatcgttttggcaccctccttgctgtagggcgatctcgtctgtgttcttttgttggtctagcggcggccggtcacgcttagtgacggccggtctggtgctaaccttctcctggccgtagtgggtggtggtatatttttttcctttctcctggttatgaccctccagggttgtaatcttgtatttttttcctgctctatcaatagaacttcgcaccgtctcgtgcgagtcgttaaaaaaagttcttggttctgcacttctgcttaatggatgagtggacatataagcatgcttttctcaaacttttatatatgaatttcttagaatatatattttttttaaaaaatcataatagttaattcatacgtttgtacccttgaataattatcacaaatcatttttctactcggtcattcagtcattggcacaaaagaacacataagcggccaaaactgcaaccccaggacagagcatatttactacagtttcatgtttgctatgagctcaaactcaggacataaaagaacagtcaaactatgaaagaaaacaaatatttgctgaatcttggaaggttggcaatctgctacaagctatggcggatctgagagcacaattccaattaaaaactgagattgaacttccaacaaaaccacttcaggtccaagaataatctgctgctactaatggctaccagggacaccaattgcagtctatatcattcttgattgattcactatcatgcaaaaacacatcttccaaatggttcagcgttattttctcaagtaaaaaggctaaacaaatgagaaaacagagcacagctgcatatattagattcattcagttggtggagagaaaatgttaacacaagatggtaaaagaccctgaaggacacaactgctaaaatctaaggaataagaacattgccccattgttacgcttattcatatgcttatttgaatcgcttattagcaaataaacgatcatttgtgaataaaacttttacatatgtttagaggtgaagatttctggttttgcggttaacggtcataaaaaaaatctcgctgttaaattgagggacctccggtgaacttattccatatccgcgcctacgtggagtcaacaaatcccatgttgggcccagcccaggcccagtttgtttggaggcctggagcgagagagttcgagtcggatccctaccgtctcccacaaatccccaagacccccaactatagatggccatgtgggccgcccggcacggcacggcccaggcccggccgtgcctgggccgaggcttgtcgggccggcacggcccgaccgacgcaccgggccgtgccgtgccagcccacgtgccgcactcacagcccaggcacggcccaacacgcctcgggccatgccgggccggcccgaaggcacgatgggccatcgtgcttttcctcagaataagtctaaattttctccctcctattgggctgtgacattgtatagctaaaaaaagtctattttacctccctcttctttgtgatgtggtatataaatagctaaaataagtctatttaaggtccctattctttagacattgacatttatatgtctatttttagtccctatactttgtgtaccgggtctggcccgaacgtgccgggccagcccagcgtgctggtggggaggcccaggcacggcccgacagtcgggccgggccggcacgggcccgacccaagtcgggccgtgccgtgcttgggccgggccaaaaaggcgtgccgtgggccgggccttcgggcctcgggccttatggccaactatacccccaaccgataaagaggtatatatatatatatatatatatatatatatagagagagagagagagatcttctggcgattccagatggccggtgctgctgttccgcgcatcaccgagttcatggcggaggcggcgcttgaggagggtaccacgacggagaccgcggtggtggtggagcgcgcgagtaagctgggcggcggcggcggcaaggcggaagcggcgcctccgcttaaggagcgcgacgcaaacaagaagagggagaaggcgactggctctgctcaggttgtcaacgccgagtccgccgtcgccgtcgccgccgcgggtggagaaggcgaccagaagcgtaaggtgcccatgcctgagaatttcgtcgccatgatcctggcactgaagaggagccatggccgaccttcgagtacctggactccctctcgcttgagaagcgcagtgaggaattgaagagtgctgaacgccgctccaagctggacgacgacttggagaagctccagaaggatgtccgtgacggcatcgacaaggatggctactatctggtcgatgagagttacctcgctgagtcggccgcctgcaaggctcagatagacgaactatgggccaagatcgactgggatctctacaactttggggactgggactacgatgacccagaatacgttgtgtacctgtgatgatggtgatttctagctcaaatgacaatggtggacaaggactgaccggcctttggggaattcagttagcccttacctatctatctaagctatctctatcagttagttagtagtatcaaccagttaatatctatcatgtatctatttatctctctcagcaagtatcatgtttagttgatgacgtttgttaggtaatgcctatctatgttattcggcactctacctatggagactatgtgatatatatcttatggatgaattgcgtatggtagcaactctactattattaaattcttgtcgcattggctttcatgtggttctaatgcttggctgtggagctgtcagtcagggatgtgatatataatgctctctttctccttgtgtgtgtgatagtcagtttctttattcctctgtccaggtaactaaggctgtttgatgctaaaagactagcactactagttaattttgtttggtgatgaaaattgctactcgtgctactctttaaaattgcaggcctatgatttgtttgtgacaaactgatggtaccttttgattctgttatgtaaactctgtcttttgagtgtgtttctattaaatttgtttgcaactggggtgtttaatttgtttagttgttgtgatcttgtacaattttcgtgttcgagcttaagttatgcctctctatggcccatcttgcagcccttgtgtatatatttatttctatcaagtcagtatcagttatgtctacccttttaattgatgatgtttgttcggtaatgcctatcaatgttatactaccgaccctttgtataactattcttgaaaaatcttatgagctggtgtggttgtttatatataaattcgagaatttgccactcaatagtagtatcggaagattttccaccatatatctcactgatgtgtgtcccgattccacatgttatagagtatagacatataagaaactgtatttttttcttcattgtccaatgtgtccttcaattggatttgcttacagcaaattgcattgtgtgctggtcatttggtgcatctgcttttcttagttgcactgatactaaagaatgttttctgtccatgaccactcttcagctcttcctttttaaggaagaaagcaatttgataaaatggctgaatgaaatatgttttgttcgatgttacattatcagaataagccaaataactagatggtatgataattttcatagcaactgtttgaataactatatcttcagtgttgaagttatgtgttgccgtggggaatatttttcttgcatttggttttttgttctgttctaatccaactgtagctgaacttcttgacaatgtagcagacgaggtttgtagtaccttatggaaacttcatttgttttcatgcattcatattaatcttagagctgctgttgtgtctgatggaggaggaattggtcctacctaaaggggtaaggcgatggatcagtctaggattcgcaatcaagaaatcaaagataaccagtgtaagtctcatcttgttttcctagcaaaatttgaagacctttaccaatctgtgagggatttcaaatagaagcttattgagtactaaatttctatatttctttttgagaattgtgtattctgtaccttaatgagagtctactaaattaagaaagcaaacctgcagaaagatgacatgatgataatggataattttgttacctttgctatagtgttttaaattatttcccctgtattgtttatgatatgatactgaactgttttcattcgatatagggcatgacaacgagaattaaatgcagtccttttttgtactagcatgcattgacaaactatggtgtaagaaatacaaaagatattattgaggcaagtctgatggtaggctggcagcttgaacatgtgtaagatatatagttatatataattctctgaaatgaaagatgaattgatccctaatgagtaaatatattttggagatcttcaaatgtaaatctgtgtagtgtatactgttttataggctctgttccttacaaaatggaaatatcctttacttgtatcaccaactttgcagttatatatatgcaatttcgtctgggcattgtgtgtgcaattaatcttataaaactgtcatggagtgttttagttcaaatatttgtaacattttttcttttagtatgtaggtgccttatgctttaattttgtgtcaaaacacttcttaatcactgttcactgactgttagttgtttattttgcacttttctctacagcacagattgaaatggctttaagacgagcacaatgagacttcgtgctgatgcaatagtgttggcttgcgcaatttttttcattttaatcattgtttatcttttttctgaacaattcatggcaatttaaacttctgcagctatcagcaattatcacacagttcttaacagatgattatttttacagtttgcttgtaagctcaaggcttgcttcccttcctaccattttggaatccaattgataattgagaggcatatggtctagagtctagacaggacagtgttggtgccagcatgccaccatcgaggccaagttttttttttttgaattaatcaccggggggggggggggggattccccacctgaattatattgaaaagaggaagaggggtacatcaggaagcattacaacattagctagagcgaatagaggaagaaagaagacttttccagttggtcacaaccgacctatcttctctactgaggcgctcagcccacaatgtagcgtcctcaatacatttagccactaacctcgtccgggagttagggagcctccggaaaacaatgtcgtgtctatggttccaaagtccccagaaacaaagtaagaaaaaaacttggaaatgcttgacaggcaagtggcagggagcagcgaggtcagcgagatcatgaacattcaaaacaacagatatacgcaaagctctctagaattcttgagcgaattggcattgaagaaagatatgagtcacactttcatcagcacagttgcagacaatgcacccagctgttggaacaatgttcttcttgtgcagattagccttggtagggagccgatccttagctagtagccaggcgaagaattgaactctcagaggagcttgattgtcccagatgaagcgccggttcttgcacagagggatgcccaattgagtagaagaatagatacactttgtgtgaaggatctcgggagcatcacgcgacgtacgtaagagttattgaggtagaagttttgtagcatctctcgcaattgtgataattgggtttcagcagtggaggacagcccgggggggggggggagagattacgtaaatcgaggccaagcttcaaacaacataaggttaaggtatgaacctacaccatattttcagcttcagaagagatccaattatattatcttttctcttttggtggtccatctttgatttaaattgtcaagtggggcagccaagacgaaattaattagtttttatctcgattacatgtgtaaaccatggcaccatgtattcaccctttctatattgaacgcttgattgatctgaaagattggctagatttgttatgttggtttgttggtttcttgggactttgtagcaaaggagtggtgttatagtgctcatccatgggtggaccatggacgatgggcagcaagcctgagagtcaggtaaaggagttggcaggaagctcagagaaagactgtcgtcaagaggttacaggccatcatacccagcttgcttctttgcttagattatggtactataattgatttggcttccatatgtggccacatgatcgcacacaataggctcatcttctattcttttttaatactggtgcaagaaaccatataatttctctctctcttttttactccagtcatcgtagtgcctccattgttttagttcttgcaatatccaggtgaccaaaatttttccttcttttttaagacagttttcctgaaatttagtagagtttcagaaccactaacactgaactttgtatggaaacaaatgttaattatttttggagtagtatgatgttagaatttcttatagttttacgtttacctccaatcacatggttgcagaatcatggtatcagccatttcatcattgatattagaaaaatccatgtgtagtatcattgggtatttagaaagttcctccaatttttggctgtaaaaatgttttactatacataatatttgttgtcctctgcagttcagattgttttggcactacgtttcaaggatggattaaacatcccaagcatctcaatctgtggttgtacaatccttcagaccacataaccaccggttgtctaattttctggataatagcatgttggatggctattttgctgtgttggacggacaaacagattattcaaatgtgcattcagtaccgtgaatgtaacaattaggtacctgatcattccagaaaaagaatgtctatatagagcatctttttttgttgaacaattactccctccgtcctaaaaaaataaaccatggattttggtgtccaactttgactgtccgtcttatatgaaatttttttataattcgtatttttattgttgttagatgataaaacatgattaatattttatgcgtgacttgtctttttaatttttttcataattttttcaaataagacggacggtcaaatgttggacacggaaaccagggtttgtctttttttgggacggagggagtacgtatctatctgatcattccaggtacaaaaaatgcttcatcctcgggcagacaactgatgtgatctcgaattctaggcagcaggtgcacgctctatgcttctatcctagggccttgacctttgaataaaaggaatgcagatcctctgcctcaccttggcaccagaattgacttggcagcctttgtctccactatcaggtaaggagtagtatttcccctttatctactttgatcatcactatttcttctttagtttctccattaactttcagttcaaatatactacatgtcatcttccaatatcagacgtaattcattgagtccgaacaatgcatattaaatttcaaaattgaattcatactcgaatggccagcatttaactttgcttgtaatgaacataatggttcagtttgtcagctataaaaatagattgccgtaaaaataccagtggtcaattggagcattctgtcatatccattatcagttgtgcagctacgaaaatatgcgtgcagctgaccattgcagcctataaaagtaaagcggaggtgaatactttggtgatggcaatatgattatgcgtatgtgattcttaatttattttatatggtttattctctgaaataagagggagaaaatgctgatttatgacagtgtgacaatgtgaatgctaattttatgtgctatgaacaaattacggataccaagtccatatgctatagaatttcagagttatgatgctacctatacataggtttgttggactgcaagtggtcaattgcagcattctgtcatccattatcagttgtgcagctactaaaatatgtgtgcagctgaccattgcagcctataaaagtaaagcggaggggaatactatgggaaaactaaaatactctctcttgcagtccaaaccactcatgtacctatttctggtgaagtgagagaccaaagtttatttcactcaagtaaaccaagttctatcccacaaatgcatatacttaattatgtgctttcttctgattaagagatcctcaagctcattttactcaggtaaaccatgggccgggagtttaagcaaacacatctaagtcatgtgcctttttctggtggagctagagaacatcaaattcaagttagaccaagggcaatgtcctccagcagttcaaacaaacacttctactcatagtagttcaaacaaacacttctactcatagtagttcaaacaaacacttctactcatgtgagctattctggttgagttacagaacaactttctcaggcaaaccaagtatgaaatttttcctgatacatatgattatgattactgtttgcttatggaaaaataatttaatagtgtatgatttagtcggtatatatgagaaccgagaatttattttattttataatttatgtcggtattatggaattaagatggtttattgccttttccttagcatggttatagtgcctttagtttagcccaccaacttttgcatcctttaatgtccttcctgatcttgtgatgtcttttacttttctgtgcccaattttcagcttgccctgaggcggcaccggtgagttttgtgtgtcagcctcaggcattggttaaccgatgaaaacttttttttttttggtatttggatcgactatttctttctgcagcattatccaacatggagtgctcaattgcatcgatgcagatcctatagtttcacttatccttatgcttatctatacggcttattgaaaaaaaaattatgggtaaaacttttataaacaatattgtaaaataaaacttgatgaaaaaaaatacaaaatcaactttaaaattaagttttaaaatttaaattttgacttgtaaacataatcataagcggaataataaggctggaagtggctagaagagctggaattccaaaaataaatattatctacctgaattctgttggcaatttttttgaagaactgaaaaacactacatgaattctttaaggcattttggatgtcttatccaatatgtttcttacgcataatgtgatttcataagaaaatttttgttcatcatcttctttctttcttttttagaaactccatcattttcttttggcataaaaatttgagttacataaattttgatggtttatcttttttttgaagcgggcaaagcccactgacaaagatccactacatggtccagtaaccttttagcaaagatcgctcatcggcctattacatgatccaatagcgcgttagaaaatgactgagcctgacaacctcttctaaaaaaggaaaaagtacatcgaaggtcctcaacttgtcatcgagttaaaaaacatcccccaatcacaaaaccagatatagaacatcccttaacttacaaaattgttcactttaggtccttcggtggttttgaccccggttttatccgacgtgacggctaaaacagcgtgggacccatgtgggccccacatcagggtgtccacgtaagcacccctctctttcccctcttctctcccttcctcccatctctctctctctcactcacttttctgctctctagcagctgactggcgggtgggtagggcgccagtgacgcaggagaaggcgggagagcgaagaggacagggggagaaccagatgtatagaaattctgatcttttttaactactccgtatatataaaaaaagtatcatatattttcttagttttggatttagagtagccgctagtctgctatccattctgatcatcctggtaaaagaatcatccaatacatttcacatacaggttctcatggtcttctgtcaaacaaaaaaaaatcacatggtcgaattacaattcacacagtcatatttaagcaggataagctgtgtaatcgaggaaagagaaaaaaaaacaggtcgatcttgttcattatatagccatgatatgattttggcaaatcaatcaccttgactacattggtcaaacacagacaagaatgaaaattccatcacaaaccagcacaataatatgagaccaacaaatctctttattattataaataatattacttaatcgatatatatcacagtgatttgaaccagtatatataaatcatttgcagctttgtctaactcagctttccaacagtagactgtcaatcacaatcatcacagcgagcgatagcaattggggtcgtcgaagtcctcccagtcggcgaagacgatgtcgccccagtcgatcttggcccatccttccttgagctgagcctggatctcggcctctcctcgacctcgcggcggacctccgcctggaactcctcgaagctgtcgcccaactcgttgcaggtggcagccatctcctcacgcatcttgcggtgctccggcgagagcatctccccgtcgtctgggagagggaagggcctcttcttccatgccaggatgtagtccacgtactcctgcggcatgggcagcttcacagacggctgctgctgcttctcgtcaccgccgtctccgtccacggtggtcgccgccaccgccgcgtcgtcggcacagtccactccggtgacaacttcagctgctgcggtggcggcggcaggcgtgttctctgcctcgtcggaagctgccgccttcttcgtcgcagaagcgtccatattttgcgcgtttgtcggtgatcgatcgagcggaatgctgctgctaatcggcaacgacgacatcgtcttcgttttcttgttgcctcgttcctgagcccctctcgatatatatagtgccgctgcgttcggagtcgatcgatcgggagtgggagtacgacaacccggattggtgcacatccctttgattgatttattgagagggtggtggttttatctaggctttattatcctacttcagtaatatatgaggcttattcttgtgtattaattagtaccctggatcggttggtacagtatgacttttattagctagcgatgcctatctttgtgagttattagacccctatggagacacttctgttttatcactgagaatcctttctatgtggtgacttatcttctgatctaaagttgcttttttgttggcttttgattggtacatgtggcgccccttcgatctttagagaaaaaatcattaatttatacaagacaaaaaaatgcttacaaatcatttgtgatatttttttcacaagaaaaaaaaatacacaagtatgagtaactagacattcgtgatctagtggtggaaaaggtgattgacagggaaaaaaaaagtaccaaacccgtcacttatggcttgtttagttggcaaaaaaattttgcccctgcatatcacatcagatatacggacacatatttaatgtattaaatgtagtctaataacaaaataaattacagatttcatcagaaaactatgagacgaatttattaagcctaattaatctgtcattagcaaatatttactgtagcaccacattgtcaaatcatggtgcaattaggcttaaaagatttgtctcgcaatttcctgacgaactgtgtaattgtttttttttcatattaatacttcatatatgtatccaaacatttgatgtgacaacgcgaaaaaatttgtttgagaactaaacatgcccttactccatccgtcctaaaatataaggcacttccgatcaaactccaacgtgatgggtaagaacagagatgcatgctagctattagccaacctgccttctccagccagtaggcaagatactagcctattttacttcagtgcgaaatgtaaatcacaattcacaacagctaattgagttacacgctgcaggttgtagcatcagctaccaacacaaattgcaactgcgtactaatacatcaactgaccagagatatattgccctgactagcctgacattattgaaaagcaacaaaacacacatcgatactaacatgtacagctatgaatgatacacaacttaaattgtagaaacaagcagctaacagcaatactttgaatggttttcagaagctagtggtcgtaagagtggtcaccatcaccatgcaatctgtaatagtaaaggctccctttaaacttctaactttttggtcacatcaaatgctcacacatgcatgaagtattaaatatggacgaaaaaaaccaattgcacagttttcatataaattgcgagacgaatcttttgagcctaattataccatgatttgacaatgtggtgctacagtaaacatttgctaatgacggattaattaggcttaataaacatctgctttaatttgggtttagtctatgttattagtctacgtttaatattttaaatgtgtgtccgtatacgtaaaacaaattttggaaaggaactaaacacggcctaatacttattgccaagttttcatctcttggctgttcttgtctgctgttataagctgatgcagtgacagctcccctcctcattttctctttgctgcaacatgctaggatggaatttgtcaacaaaaagggtgcaaatattttcgaaaaaaaaaggggtgcaaatagcaataggcaacattatattgctaggaacaagcagtaattactgattaccttaggagctatatttagatctcgatttcaacttcaatttccactgttccaaaaaaaaacttcaatttccactatctcgctttcgatctatgcctattattcctctgttcctctcacctctcttcgatctccacgggcagcggctggcgggcacaggcgagcagtgcgcaggcgggcacaggcggcgggcgacgggcggcaggggggaggagctgtgcaggcggtgggcggcggaacggtgcacgggcgggcaccggcggcgggggaagcagcggcacgggcggcgccgctccactgccttctctatcctcctcgagctcatcctctctcgcccctgcccctgccaccgccgacagggagaacagctcactgccgctggcgagatcgaggacaaagtgagccattgctctatcaccgacttcctccctatccgctggccgtcctgcccagacaagagtgagagagagagaggaggaagggagagaaccggcggggcggagcggcggaaatccaccgacggcgcccccaactccctgcgccattatcatagcgcctcctccaccgagctccactctcgtccgcctttttttccacgactgattctgtcacgccccgaactagtcctgagcggaactagcccgtgacgctccaaattaacctgttaatcgataccagtcccaggaaacagtgctggtatcacaggaagacagaatatcatagcaacagaggtctctttattatagagtaggagtacggtcatgttgggctgcggacagatcccgagctcacaactacattacaaaagggaagcggaagccaagacttggaccaaacatcacaggcgcgacttgggaactaggccgaaaccctaaaactcatcgtagccggcttgctcctggaggaactcctcgtcaacgggttccgcttcatcttcttctacaacttgggggggaattatttatataaagcaagggtgagtacgggagtactcagcaagccatgggaaataagtgtttaatgcaggcttcaaggaaaggctgttgtttttacaattgattttatttgaactcctttctgaaacaactaagtgagtgcttctcaaacgacacggatgagacagtgcgtctcgtctggtcggagtaagtgcaatgtatcagtcttttgaattgatcaagattggcacccggccaacagctttcaaacggccacccgggcctggctgatcccatcagccgcagattttccaaatatcaaacctattccacaacagcaaatttcacaaggcagtagtcaagcaaaactacgctaggaatcacctcacatccgcccatgactgtgggcacggctgttcgaacagtttaataacctctgcagagggggttcactttacccacacgatattactaacccggatcatccagcccgtgcagaacagccacgactagagaccttaaggctttcatgacaaggcatttcgaaagccgacacaggttcaccatatgccaacaagaggggtcccagaccaacaccagattaggtcccagaccatactatgccaggaagcccaggggtcctccccgacaccaccccggcgaatccacatgtctcttggcatcatggctcccccgattagctagttactcagtcaggggtgtcccattccacccatgtggtcgtacttgtcttatgttcggatgaaattccaaggaaacggtccttaagtgcaagagcgggaaaccgtacacccggtacgttcctcggtccgcgattttggaaattcatttaggttcgcaagcaccgacccaggagtcgggttttccaagtgttttgtaaaacccaagttttacccaagatgtttctcagattttaagtttgaaggcgaccgtcgatactcgtgctgagtgcacggtttccgaggtgcaactaggtggttactagggaacatggtataacaattacaatggaagggtcaaatgcaacaaattaggtaggtccgccaatctgccttgcagacgggacaagcagattaagtacgatcctatcaatgcataatattttccaagcaacataattaagttcaaatataggctcaagatgttcaaaggtggcttgccttgctcgagatcttgagcttgatcgtcgaaatcctcgcactgcgggtcttcgggctccgaaactatacgcgaaatgggacaactcagcaaacggcgaaaataaagccctattattgacctctaagcgtgccattatatagatctcgagatttgaagaattttgaaagttgaatggagtcaaacggtcttacggttgggaagatattaaatttctaagattattgtatttttggtctaaaggaaaaggatttatttaaatcctttttgaaaaagaaaagaaaagaaaagaaggagggagggaaattagacttcccttgggcggctagggcgcggcccgagagaaaggggcggctcggccgagcttaatgggccggccggcccgagaaggcggcccaaggcgcgcgcgcgggcggggaggggagagagagagccggtgggctggatccatcccgcgtggtcccgggtgggacccgcttgtcggtgactcggttcaccgtgagcgaggtgcacgcggggcgtgctagggtttggggaggggaggcccggcgcatgcgcgcggtttgcggaggacgcggtgcggtgggcccacgcgcagcctcacggctcgcggtggaccgcgcgcgcgagggagggggaaacgaagggagcggctggccgggtcacccgatccggtcgcggccgaggtggcgccgacgtggcgcctacgtggctgccacgcgggccgtcggaaggtacaccataacgctggccggaacggacgacggacgacaccagcgagcggcggagcgaaccacggcgatacaggcgaaggcgagcacaccgggatgttgcacaggacgaggggagacgagccaacggctcggattcgccgaggaatgctcgacggtggcggattgcggtggcggcaaccggcgacgagagaagggggaaacggcgacggcgcgacgagagaccgattcgggagagctagagcatctacgcgactccgggagtccgttgctagcgtcggattgggcggagctaccccgagcgaggccggcgacgagcgggtgctacggagcacgggcggcgacggcggcgagcacacagcgggcggcggcaatggtcggggcggcgccagctagctacggggaggctactcgtgctactacccgagtataaggggaggagatggaacgaggagggagaacggagggaggcactaccgtgcgggggtgatggggcgcagtgacgagaggccgacggcacgggagtgatctctccggcctcgggccggggaagaggaagaagacgagcgcccggagtccccttccgcgtcctagcgcgcaccggctcctctggcacacgtgacggcggcggttggcgagagggacggcaatggcgcgggcgagaaacggggaagattgggaggggaaagaggaagggagggcgcctgggattaaagggcggcaatgtcggtttggaaaccgaccttgggcggtcaaggcgcgagctggcgctcggcgctcgcggccaaaacggcaacagaggcagatgacgccggcggggaagagaaaaggaaaaagggggggagagaaagggggcttgcctccttgctactttggggaaaaggaggagggagagggggcgatgcggtagagggaggaggagctcagcctccgtcccttggaggcatgcgcggggagaggcggggccgagtcgatgacgacggcgatgacggcggaccggtttggagtggagcggcgacacgggcggcaggcgcgggcaggcgctgacggcggcggcgactggctggtcggccaccacggcgcgcgcgcgcgggcggcgtggcgatttgggcggcaggcgcgggaacgacagcgagagcggagagggagggctcggcgcggctcacggtagagcggagagagagagagagagagagagagccggggagggagagggagatgggccgagagggattcggcccatcgaactcgagggaggcgaaatagacttttgcggagggatttggatttgggattgaacttgatgatagatcggggatttgaaatctgagatggcacggacactagacaacaagcaaagaaacaggtttcgcaatttagggtttttttagagatagttttcccgctaggcgccacgacggaacgggcgctacagattcgtccgccttcttgaggtcgtcgtccccggtgccgtggtcgacgctgaggaccttgtagtagtcagcccctatctccctctgagc

SEQ ID NO: 75971 - DNA, 604 bp, Oryza sativa
aatctctctcgctcgctgtattggagcgccgatcgatcaatcgattctatgtgtacgggataaactaacccaaaatatatattcaggcgatcgatcgattaaactactggttgtgcaatccgaatcagattctgagaccggctcgatgatctcgggtgcttagctgctgcccagcagcccagcttgtggcagcgaatcagacggcggcgccggcggatagttgcacggctgcagtcggcattggatctcgccactcgccatcgatcaaccctgccgtccgctacctttgcttcctctcttggaactaaagatcatcgagttccagacacgagattccacgtgcaacaacgaactacaataccttaattatatacttactttgttttatattatacaatgtttgaattttttttccatcaaactgtgttgaattcaaacaaatttataaaaataaaggcatgtagtaacatttctatagatggcggacttagaaaattaatttggcgttatattagatgttgctacgctttcctataaaatcaattaaattttaaaagtttaaaaaaatcaaaacatcttatactataaaatgcaagaaaaccat

SEQ ID NO: 75972 - DNA, 1883 bp, Oryza sativa
ttttttgtggcacataggtaagcaggaacttttttaatggcataagggtaaaagactctgattatgttggtcctatttcgtaactgatatgggattttgtcagttgacagtttagaaaaatagcagaacactttctagaagagatatttcagtattttttcacatagtcaacagtagaaagaatgagatgcctacacgcattgtcttcaaagaaacatatattgtacccattggaaaattgatcagttactgaccagcgaattagaaactataaaatcatgctcaatcaccttgagctctctattggagaactatgtctctgcttcctcttctttttaaggattaactgaaagtaaatataaactttgggctgcgaagatgacaagaacctctattttctgtaatgctttagttttgccctgaacaatgaacaaattagcacaatggagtatattgttaatgaaactcgataaagaaaataatcagcttatcccttgtagcaaggttgggttcaccatcctgattgtgcagcagtaagtgtaatcagatcattaacaggcattgttaattcaaaatcaatatctacccttaaatcttgaaatgttcctgagccacaaaatcataattagcttcaatttggatagcatatcaacgcatcagtgctgaagggtacatagttttaccttaaaactggagagggaatgaagttcataactatctcctacaacacacatttttatttagtggtaattcatggttcttttagttcataagttgactagttgataattattaggatttactgattcatgaaatacgaacacatgaatccataaaaaacattcctaattactacccactttggtcagaaacttgtggaactttaagtatcaaaatctttttcaatatttagattggaaaataaaaaaaacatatatgtagaatactagagttttcttggtaagtttcaaccaaaatactgtatttctgcgggactctataaatattttaaaatagaatcagttgttaaggttctgtgtgggaactgtgtcaatgtccaagacaatgtttttgtctaaccatgtaatgtatttatgatcacaattttgttacatattccttataccaatcctttaatttatggctaaatatttcctgctctaacaggaacttggagggacaaccaccatgatggaaagagagaaggcttccgttcaagagttaatgactgttgtgaatgaaatgatgcgaaacacagaatttgctattaggtcatatatgatgctgagaccaagatttatccgtccaggtgctggagcaaatggtggtggctcaaatccttctggtcctgctggagctcagtccaatcagccagtagcattggctccaaccattgatttctatagtggtatcccaaagcggccttcccattttatgcaacagactatcaacaggtttgagaaatatcttggagaatgctgcaagtggatcgcggagctagagcagcttgttcaaatggagaacaataaaaggcaatcagcctcattagaatctctaccgaaggttatgtcgaatgtgcatgattatttcatctatgttgcttctaaggtaaatctcctttttcatacacacactgcagttgaactgttaaaatgcatttattttgaggttctcccccatgatataaatcatttattatgtaatatagtcataaaaataaatgtaaatctgtaagtcaaccaaattttttttgtaacagctgtatctcgtgaaaaaaataagagagattgcttacttttaggcttgctgcactgccttggtgcgatacccagtattttctaatgtttgtattttttttaggtggaaaatcttcatcaatatgt

SEQ ID NO: 75973 - DNA, 5084 bp, Oryza sativa
agatctcagggtgagatggaggaaagtgggacccaatgacatgtgtctcactatttttattttctttgtttaactgacatttgggtcccgcatatttgtttaatcttttagttttcaattttttttccagatcaaactgccacgtgagcaccacatcaatgtcacatgagatgaagacctagttaaaagatccatgtaggcgccacatcagccaaaaccggggacaatactaccgagggacgttgtttgcatggttttataagttgagggatgagtggtatccggttttgcagtctagggatgtatttcgaactcggtgacaaattgagggatctagagtgaacttattccaatgaagaaccgcccaagcccagtgcgtcggccatctgaaagaatgaaggcccgtgtacgggacgacgggtccgatgccgcctccccaagcaaagcgaggcgaagacgagaggtcaaaaggccggcgtcccgtccacgggggtccacgtcgcatcgcaggcggtggggcccatggcgtcgtcgtcgccgccgtggctgctgctcccctccttcccctggcctcccccgccccctcccggctcctcctccggccgcggcggcggaggaggcggcggcggggaccccggcgactggaagccgaacgtcgtcgcggcgttcgccggcgcccaactcggccgcgccctccgccgtcgcctcgccggcctcctccgctcgccggtgctgcttcttacccctgcccgctgtttcactccgattttgggatgtagactcttgggtttccaccgttgcgatatccagcccatccgcagctattaaccgatttcagactcttggtgatatgctagttttattagctgtgatattatcatgatgtgttagtggtttgttaccgtagagcatttccactacttccgtttattaaatggatcgataaattgcgtgcttaatcacacaatttattctgaactgaattgcacgatgtgtaggaggcgcgacatcttggtgccttgccgagaataggtgacatttggtttgaaggatcagactcattcgccacacactcgattcttggagtgttggagaatgcgctctccgcaccatatgcttgcagctctgttttgttcaatggaaatggatcggacaggaggtacatcggtagggggaagttgccatccagaaggccaagtggaatcaattcgaagaagaggctttggactaatattcttcttgctgttaatattctgtaagtcattgctcaattcatgttattggttcctcctttgttgatagtaagcttccttctacatttgtggattaacattgttctactttcaccgaagggcttatgtcgctcagataactacacaaggacgattacttatatggggggctaaggttggtctgttggttttaattttcatttcattttattctgataacttttagtctaactcaattacaaaccatgattttagatcaacagtatgattgatagaggagaactctggcgtctggctacatcatctcttcttcatgcaaatcttgctcatcttgctgtatgtatttgtgtcagtttgtgtttataatctaagaaataacattgctaattttccttctgatcataataatgatgcagttcaactgtttttctttaaattcaattggacctatggtggaaatgcttactggtcctagaagatatcttgccgtgtatttcacttcggctctggcaggtattttgttattacctatgtttgagaacatatatatggtggtgataggtgaacattgcctgtcttcctttagttttgtcataatgaattcttcaaattttgccaggttcattaatgagttatcgctattgtgcgtctcctgcggttggtgcgtcaggggccatttttggattggtatggttacccttagcttttgatttcagtcatagaaataagtctaatcatattgttggcaacccaaaggaccataagagtttaaaactagtttcaagaaatccctggtatggtttcttatgtcacaccatttgcatgaactttatctgcacatgtccaggttggtgcctatgctgtttatacgtggaggcataggagatttttggggcatggaaaggaaagtttagagcatattggacgcgttgttatcttgaatatggtattgttctacttatctacctgactttgttcttgttaccagctttctatcgttttcattttagcacttcttttgtggttatcatctttaacaaattgcttaaactttgctgtgtaaatagggtatgggtctccttacaaggggcattgataactggggccatgtaagcctcctaatcttagttcaatgtatgaaatatttacgtaatgacctcacttgacacttgaataatggcagttgggaggcttgctcggaggcatggctatggcatggttcctcggtccagcttggcaatatcaatatgtgtcaaaggacggaagagcggtgttcaaagacaatgcccctattctccaactaagcaacgggaaatggttgaggtagaattttgtatttaaaacggattcctaacttgtgtgggacacagaaattgaagactgaagagaggtggggtttgacactgccattctgccaaggtgatggagtggacgcctagtttggactttggaaagctatttccagggaaactccagctccaaatcttacgcaagggcgacatttgagttcacctgagtcattatttttggatataagttgcaattgtctactgtgacagattatagctaatcaatactcaaatagtcaccacagcaattgtatttaacatgcttatcagtgttactggagcccaactggcacggtgtacatgaatccatatttctggagcccaactggcacggtgtacatgaatccatatttgatacagctaactataggctcaagtgtatcaatctatttatttttggggtgagatggtgtaagtatctgctttggatattgatgattgttatcactactcttttcttctgattttgtgcccaagatgtcacaagacgtaatgactcacgacaaacaacaatctgttcaggcagcacatatttagcaccagctaaatttcagaacttgtttacgggatggcctttgacttgtttccgcaggctatcagcacaacaaatggacaaacgacaaatgtcgcagaaagacgggtgtaaatgtatcgtattatgctcagtatatgatgatgttacaggaaacgaacagtcgtatcgcaagatacaacatcaattcgactatggtaagtcattacattctcctctaccataagcacccaacccttcggtgagaaacttgatatttggtagaggcgtagggcagtcaccttcgtgacataaaaaccctggtaaattagcataatacagacctatatctacagttatactccaactctgaagtgcgagaaaccaccatacagttagaagtaaccgataagcaaaacctgcctttttgcagtatgattgctcatgattgcattcataaacctgcctttgcagtacgatcgctcacgattgcaactccatgcttcaggagatttcaagaagcaaactttgcaaccacaaccaccttgtgcactggtaactctgtaggcaaacagtccagggcaccagccaagtctcacttcaggaatggagagctgcaaattttgacaatggatgtcaaatgaaatatttatgttcaatgaactgctgaagaatagcgaactaaaaaaaagagcaaagcggcacagatatataaagaaaacgtacataaactggtaccttttgtaagtattttaaaaggttgaattaaattattaggatggcatgacgttaatatacaaagaaatcaaaatgcccggttcacctaattcacctaacagcatattgattcacaggttagtaccacaccactagtacacctacctgattcattgtaaaattctagatgaagcgaaaaaaatatctcactctatcacttcaggaatataatgccaaactaacaaagtgtaatgtaaatttattattattactaagttggtagttgccatggaaatcaaacagtgcagttcattattgggttagtgtagtcaagtcgatcaatgctaaatcttattcaggagttaccatatcaaaccaaccattcaaaagtcttaatcatgaaatattgaagcaaataataaagtaaacacttcatagaatagggtacttacaatatggggaaggggcaattgaagggggggacttggtttttcgtcgcttcttccatggagccattgaaggtcgaaacacaggcaatgagggtgaaggtattgacatcatttgataagttggtccagggactgcaccaggtaaatgattgggaggatctacatgaccaggaattggtggaaaagctggagaaagatatggggaaggagcaacagatggctgcggggagtgtataaatggaggtagcttagggtctctgcgaaaacaaggtggtttgcctgttgggctaccagcggaagaaaagcggtcacaattgaaacatggaaagcaaggatttgtgtcaggcaaagggggtgaagcttgaggaggaagacttgggttcatatatgttggaggtgcagggtaatggatgctcccagatggtgagaaagatggtggtacacttgaagaagggaatggagatggagatggagatggggatggggatggagatggtgaaggagatggactcggagataaatctgagatcgaatgctgtaggtatgatgacagttgaacaccttttactttaccaaatacagagtgattaagcccaaggttccttgcattgggttctttgattagctgagctagttgtttcaatctatatggtaaaagaatgctgctcccatctagaacagatgcctcaatagttgccggggcatcaactgaagatccaatctcattcctgaactgcaaatatactttctgcacatatatgacagagggtgtaaattttaaacacaaacacatacaaatttgtaaccaatcaggaggaaattaaat

SEQ ID NO: 75974 - DNA, 2194 bp, Oryza sativa
agaaggggcgccacccgccgtcctggaagaagcggcagcccgccgccgtggaggcggaggagcagcgcaggccgagcgacgcggcgaggctctgcgccacgtagccggagtaggacaccgtgattcggatcgccatggcgagcaagcagaggagccgtagcgggatcgagaggagacgaatcgagtagcccccggaagcaggcggagaccaaaggcgccggccgatcagatgacgggagaacgccgccgcgaagacaaggtgggaggcgggggggtttccggcgagggagacctcgccggcggggaggtcaacggtggcggtcaacggaggaggcggggaagaggagctgcgaaagcgagtacagaagagagaaggtgggaggcggaggagacaagtgttttttatagacgcgtggttgttcacctcaccgtttcggcgtttggtgaggtggaggccagaggcccttgaactttggagaaatgattttggagttcttttacatattcgagaaaattggaaatggatttaccggataatttttgaaaataaaaaaaacagaataaagataaattagttgagtggtgatggcactgtggttggcttgtaaaaaaacgaagtgaatacgataaggtgcttctgttagtttcatgtgtcatgaagtaatttggatgatagattggagtaccatcaatgccctacgaaaacggggttacggttaagaggggcgtatgagaagggagacgttgagtatgcacaataaatttaggtgaaatgtagaatattgacgcaagccgaagagtgtggtgcatagctacatcctttttaccaaaattttatttaaaaatgagttgcgcttaaaggtaaagagtgggacaataaatatttaccaacgacaataagatatctttacataataattctattgaatactatcaaatttttacccatacgttttcggtcaacaggtcagaataaccgcaataaacacgtggctatcattagtactgtaaactgatatttaccacacatattaagatattttaccatttttaatactatcaattttttgtttatacgttcataactcgaaataaccgcaacaactaagcagttatcatcaatattgtaaaccctgcggtggactggagcctagagactgaattcagaatgcaattaggttaaaaacaccgccgctggcctgatagggattttatttgatctatcgattgagaaaacaagaccgtactccaaagcaatcaaaaaagtcaaaatggacgagctgtgtccctgcctgctgttgccatcgaacgacgccgtggaaccgtctccgttcatcccctgtggtttgcgacagcacaagcagcttaacgccactgaaataatcgcctcctgcacctaaaagaatatggctaatgctgacctatttctacatgtggttagcttggatgcttctctgaaacttccactgtcacggtcgaaggagttgggggtttcagtgattgggcaggacacctcatagctcggtatggaaagcaaatccagtagtttattaattttcagatggaacagcgagtgagtttcttccttgcagtaacatgatttggaataaagggatctgtattcatatgactgaaagaatccatcctctccgtccaaaaaaaaataattcaaacccgggtttgaatctgaacacttgggtttggttctttatgaaacagagtagtatatatgagatttggaataaagagcagtgtgttcatatggctgaaagaatctatatattatatatagtaagaactaatagctcaacatcattgatctacatcactcaaacaaggatcattgttagagagccataagaaggccccaattgatgtgaaactgatgctaaaatcctttaattcttttctatatacatgttatttatctttgtaattatgatgcatttatgcagttttaacttttagtagaaagaatctcccaagtgattgaagagttcatgttcttcaattttcttttgttcgtactctttttttctttaacttgcatgtatttttaaagccatttatccatatataatcatcctgtagcgacgcggggagtgctcttttaacttggataagagttccattcaaagatctggatcagcgcgttcacataactattgccgggagatcttgacttttttaaaaa

SEQ ID NO: 75975 - DNA, 734 bp, Oryza sativa
tcgatgattggcttactaacgagaattcactttgaacagaatgagttgtggtagtgactagagagaatagtcaattttgtccctctaagtttcacttaagggctattttgacagttggttataagactttctagcattatccatatttatataaatgttaatgaatctaggcacatatatatctagattcattaacatttatatgaatatggacaatgatagaaagtcttataatatgaaatggagtaagtaacgctttattttgtacagttcagtgcttaaagcttgcattttgggtcaacgtggtaattggatgaacctaatatgctacaatacgaacataactcaagaaaagtttagccttgtgtatcgtgtgtcttgccggcgagcatctttccacatacagagagagcttgagatcgcaccctaagcccccggccgaaccggcaaaggggggcctgcgcggtctcccggtgaggagccacgagctccgtcaatatgtaataaacactagcccaagatgcaattcactctttaaatagtttcataaaaaaaatcaaaacatcgttatataatataatatgaaaagagaaatatatgtattaacaaggtaaatctttcgtctacttcctttcataaaaagagtcgatctacgtagtgatggcaactcacctagaacaacgagtcttaacaatgaagtagatctttagactccaagagaggaagcaaactta

SEQ ID NO: 75976 - DNA, 17244 bp, Oryza sativa
  unsure (1)..(17244): unsure at all n locations
agcttcatggagtaggtgccgtgtgagcttcagataaatcatgcagatttcttcagattatgtgggaaaacaagactggttcggtccgctagctcacggttgaacgttgttcatgtcaagatgatgatgctgcaggtcagcttaattcataactgcttgtattgatctttttgcctaattttcagcttcttggtggtgcatttgttcagcttaattttgcagatcggggtgagtagttggggtggtgctggtgggtagtggatcatggaaccaggtaacacggactcgctttggtgagttaaataaatgaattggagattagtctgacctgcaagccaattggactagttatgcatttcaaatcttgagactttttgactgttgacatgtacagatggataaagagggggctgaatttgagctattctgttggtgtggtttgacatccaggcttccagatgaactggttgagtagccttaattccttgaagaggtgcttgcagactacattgaattctggagttggacaaagggaattttcaatccttccctattactagcactatattcaaaggagtagaatatactctctctctctctctcttttggcgaggaaaggagtgaaatatactgggaaccatgtaaacaaatgtgtatctttttttttgacataagcccttagttgtcagtttgtaattgcttttaagcagaggctatggacatgacatgagtaccagattagtagtttgagctaattttctttgcttaattatgatagctgtagaacagtaggagtacagtactaagtactgtagttaatataagcagcatcactccagcccgtacaaactcaagactcaagagggccaatcaggaggcctgatcattgcatcaggatgcggactcttgggaacggcacttgtcatgggagaaaaatatggtcttggagactgaaaccgtacgtacaatacaatactcacctgtgccattcttttatatgcaaggtcggcaaccaacgcttcaatcataatacaatttcggcagacaaggttagcatggtacaaccttgtccatatgcaaaccatgcagcgacagccaattttttttccaaaacgcaaatcttgtctactagtagtactgaactactgatagattttgatcaattcaccatttattaaagatttaatcagacgatgccaaaacaaagacagcgtgagttcaccgtaccggtctctttctgagacaaagaaaaatgaaagaaaaggataaaaaaatgagtaaaacatgcatggagccatggagggagggtgtgaagtgtgaactaggaaaaagattggcatcaagagaatatgggcacatttaagcgtgcactgcctcgtgtgaatgtgtgattgagccattgggtgagttggttcttttgtcgtgctacgtttctttgatctcatcatctttttttcctaactgttttagttgccccggtctgcaggatggtcaggtgaatggtgctagatgttaacagcagcttcagaattgcgtgcaccgttgaatgtaacaagtgatgtttgtttcacctgcagaaccagtggctcaaggaggattgcctgagcctgacgatttctgaatagcccctcatgtctctttcagaaatccaaaagaaaaaaaaaaacttctggtgagaagaaaaattacccgaaggatcgtgaattatctcagagatagcatgtgatgactagtagtccagactccagacatcacatgtcaatgcacatgacaccagagaaaacagttaggtaaaagaaagtgggttagtgaaatcacagattcacagtaacagtcgtacctccagcaaaactgtaatgatataattcatttttttgaccacttgcaggaagttagaggcatgaattttctgctgttataaatgctttgctttaatcactacagttttggtggattagtgaaatggtaggtatagaaaacaacttgagcaaataggggccgcagattgctacttaggctacaaaagtgtaatggcagcaaatcctgaaccatcatattcgcttgcacagccaaatacaaacgacaatagagatgaagtcactgacaggataacactatcgctagaacagtacatgcattttgaatgcaattctgatcaggcaaattattcaaaattcaatagccacatgtgattgctggcatcattttttcctgagctttgtcttcatcctctcaaccgcggctctcagcgtctcatcatccttgcaaaaggtgaacctcaccaagttcttcccatcctcagggttgagataaaatacactaggtggtatggcgacaacaccgacttcgcgaatcaaatactcgcagaactcaatatcattgtcgaaaccaaatggggtgtggtcgaccatgacgaagtatgttccacttgaaggatagacaatgaaacctgcatccttgagtccgttgactagcaatgccttcttagctccataatccctcctcagttcctcatagtagctatctggtgctctcagagctgcagctgcagctgcttgcattggtgtgcaggtcgcaaacgtgaggaatgagtgtgcctgccttacaccccatgtcaggtgtggcggtgcgattgcccaaccgatcttccatcctgtaagagagaatgtcttcccaagagagttcatggtcacggtcctctcatacatgccaggaatagaagccattgatatatgatctgcctcaaaagctaacttgtcgtagacctcatcagcaaaaagcagcacatcattttccttgcagagagtggcaataaactcaagttcttcccttgtaaacattttcccagtaggattgtgcggggtgtttatcataatagctctggtgttcttcgagactgcagcctttagctcttcaagagggactgaaaaatctggaggacggagagtaatggcttttacgttggcaccagccattgacagggtagcctcatatgaatcatagaatggagcaaacaatatcacttcatcgcctggattaattagacctaaaattgttgcagctatagcttctgtgcatccagatgtgacagtaacttccttctccggatcgacttgcagtccgctgtccttcaggaatctttcagcaatagctgagttcagttcaggcacaccatatcctcttgcgtactgattcttcccagcattgatagcttgaatagcagcctcttttacaaagtcagggccatcgaaattcggaaaaccctggccaaggtttattgctccatgcttgatggcaagcatactcatctgtgtgaaaatggtcgtcttaaacttttccaaccgctttgcaacctgcaatagagaggaatcaacataaacctcaagggtatgtattctttgactataattatactgattaaacaatgcatataataaattctgtgttactcaaaaccatacaacaatacgtacagacaattccctatttgtttggtatattaggactgaatttctaaaagaaaaatattcgattcttgtcaggcaggtttcaatgtattgggcactggacatgaaattgatatagtgtgttatacagtggatattggttgaccatagaaatcaccaagccaacatggaatctttatcttagattaacaaaaacatattatccaacctcaggatttgagtcactggtctaactactcttttgtgtataagttggtgagtatacctaggaccactgtctggcagctttagctcaaaacccttactcagaggtttgggataaaggattggtttcagattgaatctccttctcttcagctgtcccatgtcatagcactgcttgattcttatctcagtgcacctgtttttgtaatctcttttgaggtggtgaatcaaacacgttcacaaacatggcatggaaatatggttcaaatgttgttctcaaggcgggtttcctaaggctgcgaacccagaacaaaaaaaaaatcaggtgtccaatacatactaataagctaattattgagtaatattgtgattaaggtagcgtaacacagtgagaaatggccaagctacccggtgtccggtgcaccagggtagctgaacataggactgcccctgataaggcatcatactgtagtgctagtgtgccatatgcctttggtagaatctcacaggagttttcaccctaccttccaaaaaggaaaaaacaacaggctgacaaaaagttacaacgatagctctaacttcgaagtggattttaagagaaacatacatagttctcactggaataatagaatatggcatgtatagggaaatcaatgagctgatttagtcagatattcagatgagtaaaaggtagcacaagaatagccaggttattgaacaatgtgaatggattgtgaggactaacatgggacctcagtatacagcagaagtagatcatacaagcatatttggacagaagaaatgaggaatactgtagcaatggcatgtaatatgggtgcaaccatcaagaatttgatatcttgaagggaacatgccaccccaataaaaccattcagtcacaaccagctaaatcaaaacttaaaaaagtgtattacactattatgcctaaaccgtatccctttcttatgttaaattctgcaaaaataatccaaatcatgattcatgacctctttcaaaaaatagaaatatagggatggtgctaatcagctgcaattttttccacaggaatatacaaataattggaacattaaactatgtaaatttagtttaacacattcttttgactaatgaatgagagagaaactacactcaaccataatcaccaaggtgttcttgatgttgtaggtttctgcattttctttccccaacaaatgtaggagtacattgttttctttctagatttctgcaacatatttttttgagatcacaaggtcgatggctagacccatgttcatccacactcctggaatcatggaggctgcggataaattacgacctcacggagtgtgactacaaatctacaacagagtgttagtgtacgtttccccagggaactcttactgtaaccccagggcccagggtgctctgatgagaatacaacactaaatgtagtattatcaacacatacaaatgtaatactacaacacatattaatgagcaatgactacccttaagcagttatgcttactacgttagcaacaacaaaatctgtgataaatttctcccaatagttatgctaagtcctaaatctgcaggatacgcccgaggcaatgcatagcattagtaatcagttaatcaccgaacctaacttcaactatcatctcaactacaccgaggttatcctgatcaacacttccaggaagcactgccagccacaaagctacacatccaagagtacgcaagcgtaaccacacacgacactcccagtaaaatctcagccacagaaatctcagaaccacagagggagacagagagagagatagcaatcaagctaccagtgggggggggggggggatcgcgaattcacctgcacaggctgctgctgctgcttctccgccgccgccttggcggcgccgttctcggcggcgacggtggacgcggaggccatgggggagagcgccgcggccgccgccggcgaggccttccggagcgacgcgacgagcgagcggcggagcgaggagaggaggaaggaggcggaggaggagggatttaacggcatctcatgccgcgtcgcggtcgcggtcgcgggcgtggcgagaaagccggccagattcatgaggggggccgagcagcagcagcgggtcgagtcgcgccgccacgggtgggcgccggaggaggcgtcgcgaacttggcgagacacgcgagaccgcacgcgtggcgtgggtactagtacagagtcagtgacgagtgggccatggaaatcatggagcccgcatgtctgtgagttaaagggtggggtttcgcgtggaaagtgtgcgttcgaatatgcccggttttttggaagtgaggggagatggcactgcaaagtgtgtgtgtggcatcggcgtgcgtgttgtcatgtgccattgaacctggacatgtttttttagtggaccggagcgacttccggcccaatcaatttgctctcttcatgggccggaaagcccagaacaaatcgcctaaccaaaaaccctcacctaaacctccaccaccacaagccgctctcccaaccggcggcgactccggcgacccccgcgccgccggcgaccgcgaccatgcgccaccaggtaggccttctctcccgcctcctcctccggcgccacgtacaccgccgctccaagccggccaccgcgccacccccgcccccgcccccgaccccgccgcggccgccgcagaagcccgagccggtctccatccacggggagacgtggcacgacagctacgcgtggatgggcgccctctccgacgccgccgccatgcgccacatggacgtgcacatggaggccgaggagaagtacgccgaggcctgcctcgccgcggcgggcgccgaccgcctcgcgcggaagctccagctcgagatggcctcccgcctcgcctccgacgcctgcacgccgcccgtccgctggggaccctggctgtactaccgccgcgcggacgagggcaagcagtaccctgtgctctgccgccgctccgcggcgctacacagcgagttcatctcgtatagcgacccctctgccggattcgacttcaccgccgggaagcgcatcgagcagaaattggtggattacaacaaggaggccgagcggttcggaggtaaccaccgaaataaaattgggattgacataattccatttcgtcttaccccgtacataataatctgattactagcgctctaaagttagcagctgtttatttaagtttttttttcagtgaatctccttttttataagtatatgtaattcctctacttggctatttaccttgcaatggacaatacctaagcagcgtgttccacaatattttgctactgcaatttaattctgagaagtaattaattggttttccattgctatttttcattgaagttatagtatttattcagtttaccttcaaagagtagggttttttttttttagtaatttgtaagcttcgataacatgctatgcttgttagatattctttacctgcctattcttgttaccttctcatctttgatagttcaccctgcggactatgtaggcacttaaagtttagggccttgtaaagtttgaaagttgttactgcttagtattaactatttttggaagattataattgcataattcttctttagttgatgtgtcacatattgttgtttcctaaccatgaccacaatacttgattttgtcctgactttgaaatttctagtgctattatgttgtcatattactctactattctggtaccagcttatgacctacgagtgtaccaatatttacggttattaagcaccgagtgaaggctgggatattttaaaaaacaggttgctccccagcttttcaattgaaagttaaattaagaaggctgagatttttttttgggatatacaatcttttatgggagatcgtgtaagcatattttggtgcatcagcatcattccaatgttccaatttgcctgtatgggatgttttgcaaaatagatggagacctgtatggaagttttaaaatttggtttacatactcttttggaacacatcactgcataatggagatatgcaatactacagttttggaagtagacaattgttcaatctttttagtcctaaagtgggtgctcagagtcagttaatcattttttcttggttatgtagttctaaaaagctatatcctatgcttcatatgcaggatactcatacgaggaactgtctgaagtgtccccagatcaccggttcattgcatacactatgtatgataaagataaggattccttcactttaatggtcagggacctagtgacaggaactctttgtgataaacctcgtgctgaccgggtctcaaacatatcctgggctatggatgggaaagcactggtttacattgttacaaatgaggataggaggccatatcggttggtggatctgttctctttttgctatgcatttttctctttgctgcactcaactatatctttaaattttgtctgtgtaggctgttttgcagcattattggatccagcaaggatgatgttctcatgttggaagaacctgatgagaatatttatttaaatatcagacataccaaggattttcggttcataacgttaaatgttttttcagacactcactcaaaggcactttttcttgtgcactatacctgtaatattgttagttgttcttctcttcactttctcatgctcgattaaccttttccaggtatatttgataaatgcttctgatcccctgtccagaatgagattggtttgggaaggtgaatcccaagttcattgtattgttgaacaccatcatggacgcctatatttatttactgatgcttcaagagaaggcacccctgttgattctcattatctaatgctgtctgatgtggaatctcctgggccgaagagctggaaggtgtgaagtttgccatattaaattagtctactctgaatgcacacatcagctcaggattagttcgcattagtgactttgtttaatctatttgaaccattttaatgtttgcatcaggatgtttttcttgaagaaccaggcgttattcttgaagatgttgacttctgtgatactcacatggtgcttgttctgagacaaggcagaaagctgaagctctgttcagtaaagttacctttccctgaacacatcagagtaagtcaattgttgttccttatctatatacaattcaagctgagaaaatttactccttagttcttggtggaattctatacaccctcacagtctgctgctctggtgttcgatgataacattggaaatcttttctgcttatttaattaatgaaatccacagttattttgcctattggatgcttgatactgtttttatctttggatacttgttttccatgtatcaggtacctgctcgtctgtcagatttccatccatttgacttgtctcttccaaatcatgtgtgtcagattttacctggcccaaattacgattatcgttcctcaacaatgcgtttcacaatatcatcacctgtggtatggacatgtgttatttatttatctcatcctctctagttcacttatgcaccttttgtggcttttattcacaaagccataaaaagtcctgttgattagaaaatgctgagttgctttacttgcactttttgtgtgaataacatcctttcttctccaactttccaatctataagcgcatcccttcttttttgttgagatgacttcttatctacttccatggcttattacatttttttttctttgctatgttgctcaatcatttgcatgaatggtaatatgaattagctctggttattctggaatatgttcttgaagattctttttggttataaagcaacattatatgtggataatgttatgacagaggaaatttatccttgaaacataaattgtttggttcagcctagtgctttttccttacgcacttgtaacattctcaatatcccctctgttttttgtgcttccctctttatgtcagccttatcatgttacattttcaactgcattattgtgtttttatttggaatttagtgccatgcctttataggattgttaagtgataacagtttggtatttctcatgatgttacagcaatctgcttgcaatgtgcattattaggatatttagttgtgcttgcaatgatgtcatttttttttgtatcatagcactatattttattagacattggctgtggctcctttacttatcatgctctagagaactctaatgaattaggattatattcatgcttgttgatgcattcttttttggacaactttatgatcatgtcattttagatgcctgatgcagttgttgactacaacttaccgaatggtaagtggcgaatagtgcaacagcaaaacatgcttcatgaaagaacgaaagcactatatgggaatgcttttgctgctagtatggttaagccatcttcaaaaggaggtgatttgtcaagtgaggactttggagattgtgattggaatgaactctctgaatactatgcttgtgagtactatgatgttccatcaaaggatggagttttggttccacttacattagtatattcgcaaaagcacaagcaagagggaaatccagggttacttcatggacatggtgcttatggtgagattctggataagcgctggcgcagtgagttaaagagcctacttgatcgtggctgggtgattgcatttgctgatgtcaggtatgcctattatattttgttaaattgaacataaccatctcaacctcttgaaataactgacaaatgctagctcaaagctgtacaagtacgagaaattgtttatacatttgttgcatcaaggaatgtatcagcttttgtcttctgaattttgacgcacaaataattgtgtcaacataacagcacatcttttttcaggggtggtggaggttatgggaagaagtggcaccaagatggtgcacgtacaaaaaagatgaattctatatatgattttatctcttgtggtgagtttcttcttgagaagggtatcataaaaagaaaataacttgctggatggggatatagtgctgggagacttctggtggcttcagcattaatactcggcccgatttgtttcgtgctgtcgttttgaaggtatttatgattaactgattggcttgtgtagaaatcattagctgattttcaagattactttcttattttctagtctatggtgttattcatcaatgcacgtgggaactaggaaggattttcaagtcattttgtcattatatatgtttgccccaaatcaaaattgttctaaattttagaacattacaattggtttaaattgctgcagattggcatcacaaatagttcacatagtccacacatcacgaactcttcttttatgttgtttctttgtcattaaaagatgtgacagatgaaatcagttaatgaagcattttaagtaacagattatccatagggaactttgtgttatcaaattcttcatcaagtttgggattgctgtattagttatcctttccctgtaatcttcagtttgtactattaccactgatcttgttatttataccaatggcccatcatgattcatgacttacattttgtcccccaggtccctttcttggatgtttgcaatactcttctccaccctattctacctcttacagctattgattacgaagagtttggatttcctgtggaccatgaagagttcctttcaatcaggaagtattctccttatgataacatccagaaggatgttccttacccagcagtgtttgtgacatcatcatttaatacaaggtacacttttctttgtgggtacttactacccccatccccttctgaaacctctgcagcataatgcacaatagctcaacaacttgatatttttttattttatgtatgacttactactttctacttctncgttcnnacaatgtaagtcattctagcatttctcatattcatattgatgctaatgaatctatatagatatatatgtctagattcattaacaacaatatgaatgtgggaaatgttagaatggcttacattgtgaaacggagggagtagcattgaagcttgtaatatttacaacataaccttagactagataaatagaaaagataactggctaatggctattgcaagtttgcttctgtagttctgttgtcctggacatgaatatgttttgtggttgaaaatggtaggtttggtgtatgggaagcagctaaatgggtcgcaaaagtccgagaagttactcgctatgatccagagcggcctgtaattctcaacttgacaacagatgttgtagaagagagcaagtatttgcaaaccaaggaattagcattggagactgctttcctaattaaaatgattcatgatacatgaacatcttgtttatctctttgaatttaaactcattgcccaaagatggggagcacatgttacaatgtcaggcctctcttttcagcaatagtctggaatcaactgattggagattatctgaggtaccacacttctatttcgtacttttttttttctcagaatgtcctgggggaaaatcatatgtgcatatccctacagtttatgagatagttgcacgctcacaattcatcagtctcagttatatggtctgatgatttggaagccaaaattcctgtctactggagatcgtctgactctgatcaagtctgtcctgtttgccttgccggtgcactacctctcggtgcttgagctgccacagtgttcgatcaaagagattaatagaaagtgtcgggggttcctgtggaaggggcaggaggaggtgagtggcggacattgtttggtggcttggaaagcggtttgtatgccgtttgaaaagggagggttgggtataaaaagcctggacttctttggcaaagcgcttcggctcaagtgattggctaagaagggtgagcagcaagaccggccttggacaacagttgcgactgtggagccgaaagatctgagagacctctactactcagcatcacggcaagaggtaggagatggaaaaaacacgaagtttcggcttgcggactggttgccaatgggaagcataaaatcgaggttccagttgattttcagccatgtggaacgcaccggcttgacagtggctcaggggttgaggaaccacaggtgggtgtgtgacatcaaaggtgcgccatctaatcgagccatcggggagtattttcagatttgggatgcagtccaggaggtgcaggtgcaagggggagaggaggatgtgactgtttggaagagggctgcaaatgggaagttcacccctgcttcggcttacgaactgttcttcatggcaaatacagaagcgagatgtggcagtctgatttggcacactagagaaccttccaaagtgaaattttttatgtggttggccgagagggaggtgtctcacggccgacaatctcaccaagcgaggatggccacaccaacaatcctgccccctctgcatgagcaatgacgaagattgcgagcacctctttgtctcctgtccttacacttcaaatgtctggagaaagatcaagggttggatcggtgccgggttccagctgccggcagagctcggattggaccttggagattggtggttggagtggtggcaggtctttcaaaccagccagaggagcgcatttgacactttagtgctgctggtctgttggatgatttggaaggaaagaaacgctcagagccgaacagcggggttcctgtttggcgcaattaaagatgaagcggcaatctagaaagaagctggggttttcaatgttttaggagagtaacaaccttctgtaacttgtttttcttttaggaagttgctgcgatggcaacatcctttcacttcgacagcctcttgtcgaagtctgaaacttgtatatgtgtaaataccccttttcttaagtaaatttggtccgcctatcttaggccggcctggctaaaatatggtctgatgatctgatctgctatcacgagggcagttctgacgtccaacaagtccacaacgcatggtatctgctaccaagtgctgcccatgattccttgttggtaaaatttatctttgttatgctgctaccattggatcattttcaattctcagtagctcatctacacaatgaaattgatgtttttttaccttcgtttttcaatcatggaattgatatttaatatctcatgtgctagatgatgcctcatgccctcacctgctcatgctcgtttccatgtcaagttaatagtactaccaaaatttacttatgctatgtcatatatgaaagctgatttgatataactggttgctagggggaacaaagctcttgcacacttggcttggagcattaaggcaattgcaccataacagaagcggaccaaaatataccttatctagttatctggctgcttgcaccacactattgttttatccttctgttcttaaaatctgcatcttatgactgcccaagtgatagctatgaccttgtgggtcaggtgaatttagcgtcatgaagtggatggaacagttggacactacttgaatgaccatatgtccctgctgatatgaaggctgtaacaaagcacaggttggaaatctgctgcaggttgtgacagcactgcgtattggaaattcagttgttagactttgctctaggatcacctaggttagatctagtcgggtggttctatttgggattgatgtttgaactatagagattgaaaacgggagagggtttagatagaccgaccggttgaggagttcgtggaggaagaggcgccggacatcgtcgttgtcgtcgcggcttgacgtggatgcgacgccggtgaggtcgacggcgatgacggctgcggcagtggtggtcgtagacgtcccggcgatgaggcgtggcgcggcggtggcgtttcccgtcactggctgcgccccctctcgatcggattagggttttgtggggtggagttgncgncgncggtgaacttcgtaccttgtgccgtgccggcctcccaccccctctttaatggcgcagtgtgacgggggcccaccagccattgggctgggcgccccccgatcagggcgcggtcaaggccctcttgagccgttgggctcaaggggagggagatctatctaacatcagttactgcgagatttcatcagatggaacttagagcttcgtttttgtcttctggttttcattcttcagttaatctgtgataaattgaacttctacgcatctcaatttatattagttatgagtatcaatatggtcctccagatactcttttgacgtcttcaatgtggatccgtgaccaaaccttcgtttttttttccataatggtaatctttttttttgaggacattcataatggtaatcagagtataatttttccttgtgaaaaggtattgctggtggtatattaaggatttgtagcataattgtcaccatgatttttaaatgtttcgagctacgtttttgttgttttggataatttgaaatagaaaaaggtgagtacaaaggagctttgattccaacctttccaaagtgaaatttaagcaaaatttgttgtttgggtattgcgttttagcttcatggttttagctgtagagatttttgtagaattggatctttggagaaatacacttataaattgcagcgtttttgccactacacaccgttaccaatattttattatattggcatggtgaggagtgaggagacgcgtgaaggtttgaaatacccttgagttattccaattaggccaagtgaaatgttattggagtatactcttggtacccgtctttgcgaggtgagcgtaacgctaaaataaatgttgggtcaagcatgtttagttgtagtcaggatgatatcattgctcacccaacgaagtgtaatggctcagtacgctcgatgagacaagcggtggcaaacaggtgtaggagcatgccatggcacacattgagcacctttgggaaatgacgcatgatctcggtagggaggtccgaatctagctctaccactgcgtggaccatcttaccatcgcgtggagcaaaagctgacaatgtgtgataaggactttacctcacttaaccacatttcaagtgactggcttttgctgcgccaactacatgtaaacctataaagtcagagtatgcattggtaaaaaatatctaaaatgtaatgttccttgcaaaataaaacggcaaaaacttacagtatgtagaaatttccttagtaagaaaacaatggaaaggacaaacgtgaaattcaattttgaaattcttccgacccgttttgcctccaggggtaaagccgtcatcttaacactgccctctcaaaccttttcggttttttagggtttaataactcttcgagcccaccgtgtccggcccagagcccactagcccccctcgatcccaccggcgacctcccgccgcctccgccggggacaagcccccctgcgcgccgcgctgcaatggcgttctccttcgcctcaccggcgccgcagaatccgttccagacgccggcgcaggccccgtccctgtctccttcgccgtttcagttcaacctgcagcagccgcagcagcagcagcagcagccgccgccacagcaacaggcggcgccggccgcgcaaccgcagcagcagcagctgatgctatatacgacggacgggaagcccgcggggtacaacacgaagtgggaggagcttcacgccgagtcgcagaaggcgctgctccagatcgagtatggtttccctccccggtttcccctattttgtggcaaatgagagtgcttgttcgtgattgaacttagtgtttaagcgtctttgcactgcaatttttttcttgatctgtagtcaactaaaattgctccatctgacttggtaaacgcaatccttgttggtatgctattattatttttttgttatatgggtatactagtcagcttaggccctagtggaatttgctgctgctgggttggtgataaggtggaaaagtagtttcttttttctgtctgtggtttagatttaacgctttatgcgataagcttgtgcctttacagtctctcagagatcagtttgctttaaacaaatatgttcttctagcaatatatactatggagggctactgtttctgatggtttagcagatcattgtttacttgggtttcaggggaaggggaaacacgttttgtgctctatgatctatgccatttgctacggattacttaagctactgcctcattttgcattgatgtggtcaatacatgggttttagggttagagagttcagtttctctgtttttgttacctgtttgggacttggcatgctattggtgtaatttttcactttgaattttgtagggataaaataagggagtacagggacgagagcgagaggttggatcagtgttctcgccttcatgactcttcaatctcaactgtcaattttgagaatgatgcaagtgaaattgctcaggttggacttgcttttcttgcttttgtcagtcgtacatgagacgcttgattatgtgagtcttttacccct

SEQ ID NO: 75977 - DNA, 9583 bp, Oryza sativa
ttggacatcgatgtctaacgacatgctttgatcaggacggaacagttaaaaccatccaggatgcatcatatgtacgccatgcattttcaatttaattaccaccacgcatgaataaatgattgtgactagccggctttgctacaagattaaacctaagcttgtttttttaataatgacctaagcttatatatgaaagctcctaatatctgatgtgacggtggccgtggaaagagaggcttcatgaatgattgcgtttaattttttttgtccacgaccgaaagtattgacgctgtgttgaacggtgtggatcatcacccatctctgatggagatggcacattggagatcatcagagagtgatcactagtcaagagctagcagcaggaacagaagaatacacacacgacattagtggtaccagccatctattttctatataaaagggggaagagaaggagtctcggagacgcgtgcatggatagatgagttcttagctaactgtaagacacgtagctttctccctgattttgacatgcatatgtgtagtttacgtggtttgttcacattttttggtcgtcatggttttttgtttgttgacgatgtcaaactgttctattaaccactagattggctttgagatcggcggtatggtctaaaggtttgctttgagattcgttattaattatatggtttattttctgggagctaagtaaatggaactgatcatggtggatagtgactgcatatacatgtttccttctacatgacacaacatgagatgattagtagccgatcacttcaaactttaccttccaagctttaacgaagaatacttagggagtgcatgcatcgagacaatatttgtgcatgtctacgggaagataatctagtctggattaacatgtgttatatattaacttattttgacccatagcaagttttcttaccctagctagtagctatctattttgacacatgtccttgatcgatcctagatgaatgaagcaccggtcaagatgtactacatacacacgcacatgcacaccaaaacaaaatgaaatgtttctaatcaataggaaaaaaaagttttccattggtcaacctctttagctctagtttgggtttgatttacaccctataatgtaatacccagtggttaattaaatccgttgcaaattatgtccatataactgttcaagcgagcatttcttttggggcgccactccatctatcaattcttttacacatgccatcctcatgattaaattaattaattgtagaattctcgcatgcatgcatgatttcctttcatgcatcgatcatcaaatcgcattggcccacacaccatgtgaaatgccaaatcactcaataggctcacaaccatccttggacatgatttgcatttttttatagtaaagacattttctaaattaaacaatatcaaataaattaaacctgaactaggattgatagactaaaattagactttccttacatctaattaaacaagttaaactattcatatccccacaatcaaaagattaaataccttcttggaacgggttcgtatcctctaccataatggtactaccattataaacactaacatgtggggtaatagaatagtgtgacccatgtaacagtgattttggaattttgcatatggatttttttttgctggattttaatcaattgatttaattaaaaaccctgcaaaattctaagaggtctaaacttaaactactcattcaagcattaactgtaattaaccatgcacatatagtaacagcttctagctgcgtcaattgcgtccctctccttctctcttttcagattccatttcaatatatatatatacactatggcacatgtgggaaataaggctggcaaactctcttgcaagtggcaagcccttattagcagggaagcaacagcagccaatccaaaggccctcgtcgcaaagagactggttccgttcagttcatcgccgtagaaaagcaacagcgaaagcgtcacccccttcttccccgtttgagtggctgccaatagacctccggttcgtgtcaatggcggaaacccccccctaaaggttgcaatcttcatgcatgcggtgatctgctggagctagcaccaccggcgccagccgcctgtcggtgtcacgcgcagctagcgaatagcgataacacatatataccgacggggttgtggctgtacttgttgatatatctttttctccgcagcaatgtgcggggtgttttaaaagtaacccttggcacgtcgcccgttgtggacggtcgttagaacggtttccccatcgtggcaatggtgttgtcactaggacatctctccaaggattgttcttaattggcgcgtgagcttttacttcgtgtagagaagtttagggtgctggctcgaaacggggtttgctgcacattgtgtgatgtgaaaggtggctttgttagggtgtggctgcgcatcgagggtgttgcctaactagaaaggttttgcttaggtttgcaattttttttaggctgaccaagataggtgtcgtggcttgttttagtggtagggttacttagtttagcacatgagaagattgataaccaactttaccctactcatttacatgcagcatgtacgtgtgtgtatgcatatagctgcatgtgcatatatatctaattttttgaatcaattaattagttattttgttgataccaaagttatcttaacttttaaaggaagctaaaatatatttaacctgacttgctgaatgtcgtgctttgcaacggatgaaagaaaatatactataatattatataaaataaataaatatatgttttccacaaaatatggtgttcctatccttttgctctacgaaatatttatcttaatttgattttacatgtaattatccatttagatttgattgtcttttaatattatgaagttggaatagtaatttgcaaaaattacaaataaagtaggtgaggtggcagattaacaaccaccacgactactttttttttaaatactaatatagattatccactaacaatgctttccaggtggtaataattagttcacgccctccctctaaataattaagcgtcccaactgggatttcaatagaaatttagtgagatcaacgatgtatcattggtgtttcattggtgtttctatctctttcaatgcgggttgattaggggacacatttatatatgtgagcgcgttgaggactgaacacaagttctctacttaacttggttatcaaataattagaaaaaagcttgagcgtgttgagaattgaacacaagattatattgaggtcaaaatcataaactcatcaccactacactatcaagttcatttcttctctactgtgtaattaaacttttgttatagtgtgccaataaaaaggaatagggttaaagctggccttctaccaaatattctcatatttgtttcatcgtataattgtttaacattgtgtaacgtactaaaatcaatagataattcggaatgatatatatgctgtctacctcaggttgatccaggaagataatcataattagacgaccacaacgtgagatatcttcaaaacctttggagacgcgtgagtacgcgttagacaaaatgaaaacttaattaccatgtgctcgtaaacgttagcatcacgaggactaagattcaattacgctcatgtactctccctttgaccatttcaacttaaaattgatgttttctctaacttagtacttaattaactagtaatttaatatcattaacatatactccctctatccaactgaataaggcgtgatcagatttaactcggtctccttaaattttttatatactataatgtttatagcaacaatataataatcatatgagagcaaattcaaatgttaatataataatattatttttatcaaataaaatttaatttataataaattattttttgttcaaatgcttaaagagctaaatcttattccgtgggatgaagggagtaatagtttatctaaataaagatcagttgaagtttctcactttatacataatgcatcatgtacgtaattaaaccgagctctgtgatgaaaattgtgcagtagaatttaattcctttaatttcatttggcctctcctttttggagttcgaggtaaatgtacgcaaggcaaaatcatccatggtacaagtagcagaggaacaaaaacggcaggcagtacagagtacactgtcaaattctaccctttttgggaatgaaaccccatcaaatttccatcgtggagaaaagggctctgtgcctctggtgcctgtcccttttgcctatcacaggataaaaaaggcaaggaccacacagcaactactagtgtaaggttggcatacaaagctgcaaattcaattgccccaatttactactactagcattgaagtatctaattaaaaccccacattaatgtgggtaaactctttgcgcacataaacgcaaattattctcgagaggaagaaccaacaaaataaacgttggaaaaacaaacccgcttaataaaaagaaccggttacgtaaaaaattcaaaaaggacgtacgtgcggagattggttatgtggaattagcgattgaagatgtgcgtcgtggttattccaatgcaacctttttggagttaatgttaatatctttacctgtcagttgattgaacttaacaaagattgactaggaaaaatatcaaataacctataatatgaaacggagaagtattttgcaatggatcacattatactagtgtatagtgttggggttggggaggagttgcatggtacacctagcctgagaaccaaatatgatggtgagacactgagtcagtacttctgtactgccttttgctccatccaaaatgttttggctcgagagaagtgtacacaatttacgagagtaacaccagctatcaaagtagtcctaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagtattcacttgcatcatgtatgagctaagcttcaccatcgctttcaactaacgaggggtaaagtggttagtttcatcggttaatcaaacaacattggagaagctgtaactctcgtagatatatttgttctattggcaaagcctgatacacactcaaatgagttgtgttgaacctctcttctctctgtaaaaaacaaacaatttctagattttaatttttctctcaaaatagttgttttttctctcttttacctatcctctatttgtaaaatgagaagttttatccctttaatactccttacctactcaaccaccaactacttttctattaatgattttggtcatttttcctcctactaaagttgtcttggaataagagttgcttttattttggaatatacacagggactacatgtgtctaggagaagctgatgacattgtccattactagtacagtagtacttaagcttttcctcttgttcattataaaatactttctaaaattattgaaaacgaaatattattttagcctttcttactagcatactttgtataaattctgaaaaaaaaggcttgaatatatgaaatatatagacaagcttggatttattctatatttcttgatggcttaaaaatgaagaaaaaaagaggggagaaatcttcatccagtctcttatgggtgactgctaccgattcaataagagtttggcctaggaaccattgtttaagtcggtgttaatcatatctttttcattggaatatatcgcgtaaggttcctattgcatgattaaaaatacatcttcccactgccacaattgataatgtaaatattccattatggcttgacgaactgttaattgtgactattaatactatgcatatgttgtatgttgtcgtgtagctctttgaacttctatttaacgccttctatccctttgcgacttttcaatcgcaagactgggatagagggttttccttttgctcccatgtaaccctccttcgtaggtaatgttattcattcctatcttctataccacttattttcataagtatttctcatggaattcaatctccccctctgatctcctttcattttctttgctttcaatactctggaaaatctcttttaatatcccatggaaagtctcatctagaccaatgttgtatatttaaatttgtgtcactagcatgttgtttgtgcgttacatgagattttaattaaagaaaattatcattaatcagttattaccatcttttctgtatatatcatttcttaattgctgcatatatttgttactgacatgtgaatcctttgaccttacaatatactttttcctccccacagaaagtaaagagttgttaggggtggttgacatgtgtgagccctctagccccacctatcttttatgttttatgctctcaaaaaagtagggagttggtggtgccaccaccacttcctccttttcagagagtatagatatgaaaaacatggtctagtatgtatgatattttgccatgttggagatcgatcgatctataagatgatttaagatagttttaagcttcttactcatatttatatttttcttctactaaagtttgacaatttacatttaaccataatatcatagcatagccatctcgatgttttcattgaaacatttttagacacacacatgccgtttccttcccaatcaaaataaaattctaccaaagtattttgttgatacttatgcagggaaaaacaaaacatcaattgttagatcaaacatatgtttcgattcattgatgtaagatatccagccacaaaaatatcaattaattcaccagctttcattctcttgtaaaaaaatattaactctttgatgggagatatgaagttgaacagtaaaaactgcaataaataaatgcaaaccttatgcatataaattctaacatttaatttaacaaatacctaccaattatatatatccctaacattaatacataaacaccatgtatatgtgtttaatgttagagatacaggtggtgatgtgtaattttgtctataactattaatgttagggatacgtctagtttgtattttgtttgatagcatctttaaccgtacattcatgagatgcaggtaaattaaatgtttgagttatatcttgtttgtatttttaagatatgtagatttttagtgttggagatacaattgttatatatttaaattcattcatgactagagatacgattaaccagatatattcatccatagagattagtgggtatatttggttgatcacatctgcagccatcaaagaatttaaagatataacagttatatcaccaacattaaaagcctacatcttcttaagcatatctttaaagatacacaatccagcaaaaaaaaaaatacaaacaagacgtatctccaacatttaatttacctacatcttttaaacgtatcgttaaagatatcctctgacaaaattacataccagacgtgtatctccaacattaatagttgcacacgaaatccaaaaatatacacatcacccccctcccctacatctccaacattaatagatgaatttccctcacatctcccatgtgtgcatgcatctttttttgttgtttgctggttgtatggttttttggtattaggctaaaactgtggttaaatcagtggtataaaaaggggtagagggagggtggcctccatcagtcaccacaaccccccccccccctctctctctctctctcctctcctccatatttttctttctcatctcatcacacttggagtttgccaatagaatacaaaaacagcaggtgaggagagaggagagaaaaaaaaacagagctttctctctctccctccctctctctctctcttcttccaatctgcggcgcgaggcggaggtggtggtggtggtggtgggccccgccggcgagatgggcccgtaggcgccggtgtgggcggcatcctgtcctcgccgaccacccgcccccgccggtgcggcctcgccggcaagaagtctttgtttttcttttctttttttttttcatctttgaaggtgcgtcgccgactacctccttgtgcttcaatctcggttcgaatcgaatggaagattttgtttttcgtgagaaatttcggggcttgagatgaacacatgggcgctcgagccaccccggtgcttgtggggagcagacagatttttctttcttttttttttgggttgttgttgttgggtctatttgatgcagggattaggttgtgtagatcttgtttctgaaacgcttgcagtttttttttgcggtttttttttctgtattggttctgatcgttttgtgtgctgtcgttgcagattggatccttaatttaggggcgaaaagaggggagtttgcaagaggaatcatccctattgggttgtttcttgctgctgggtaagatccaatccagcctctaggttaggtttgtttgctgttggtgaggagattgaagggttggctggtcatgttgggggaccagcgcaggaaattcctgctagagtcagcgagctcatcatctgaagaggttgtttcaagaagccggaaccttgcggttgagagctcggcggtggcggtgacggcggcgggggtgaggaagggagaagaggtggaggaggaggagctcttgaaccgtagaagcaagaagaataaggttgccagtgattcggggaattccggtaccggagtttgggactcagaaatgcaggatgctgatcagaatggtgaagccaacacaagcgagctcataggcgcgatcgggcgggagctggccattacatgcctgctccataccccccggtcttattatggtatgatagcatgcctcaaccggtccttctgctcccttatgaggtccgggcagctgtatagattgcggcgggaggctcgcattgttgagcacatgatctactgctcctgcaatgtgcttgagtgggatggctttgatccgtgccgccagcgctggttcaacatcccttccatgcctcccatagagtgcttcacgcttgctgataaggagtcccttgctgtgggaaccaatatccttgttttcgggaagaaggtggaggcccatgttgtgctgaggtatagcctcctaagtaactcttggacaacaggagatatgatgaactcgcccaggtgcttgtttggctcgg

SEQ ID NO: 75978 - DNA, 11384 bp, Oryza sativa
agggggggaggcgaagggaggagcggaggagcttggaggagaggagctccatgggtggcgccgccatggatggagctcctcgcgcgcgagaggttgggttgggggaagaggggtttgggtggaggagggagtggccacaccacacaaaaataaaagcccaaatgggagggagggaaggggagtgtatgggtgagagaaataaagagattgatggagttttttaatagttttttcttttgaaaaagttttatcaaaaacaatttttgggcgatttttttagaggagggaaagacttaacagtctcattattttgcttatgcttatacttataagctaaaatttaggtgagagaggaagagatcatggatggagttttagcagtttatgaaaaaaaaagaaaaagttttatcaaaaacaaaattttgggtgggtttttctgttgggaggggaggtgagagaagggttatttttttttcaccttagaaaagaacctttttactttcttttatgttgattttattcacatatgccacttttgttttgtagtgggaagtcatattcttatttgtggtagataggagaaaattggagaaatggtttatattttttgcggtttgtttcgtgtctgaatattatatgacgcatagaaaagttctccaaaccaattgatctttttttacgtgggctggacacccaacgtgtaattgttacttatcgatttttttttctcccattttattgttcgagcacttgtgctattgaaataacgtacgacaagagggatttctccacgtaattttgtacatgctagttaaactggatgggttatacaactcatagcttctatttcttatatatatgcaattatgcatacaagtgttgatatcaatcaataatgttataatttggtccaaccacaccctaatggtatggaaatggttttttattaatatggtaatttctatgtcatcggacagaacgtgatgtcatgtttttaagctatctttatctttacaatataatacagagtaataaaatagattgtacatctattccctgtttctatttttcatggatcaatgttatttctaagctatttgtgatgaagttcttaatatcatacaaaagaatagtagcacgattttttaaaggataagttggtgttacatttaatcttaaaagggcattgtagatatacacatatctgtatgctttggtcccaatagagatgatttgatgtttaacacaagttaaagtaacgctttgcatcatgtcgatgtctatgtgtatgtttcagtgctaatcaaataaaaactttgttatcctaaaaggaagctgaagaaaaatatctcaataaaaccaccatatcaagttgaattccactcctaccttctaaactcattgtcaacatttcatcgtgtcaaaacctaaaaccacataaaccactgtacgcaagccaacacactaccacaaatctccgaccaatttttctaccgattttcatttgatcacgacactactctctagaacaaaaaatgagccgttttttcttgcctcaaaagaaagaaaaactaattttccaatcatgaacaaaaaattggacgtggaagtgtggaaccataaggaaaattttcttgtggcctaggctcaacgggaggaagacgacgacgccaattgccatcgtcagttcgtcaccaaccaagccgttgctggaccgagcgtgtggccctccacggaatcgtgcgagctcacgcggccacacacgtgtcacgcggggataaagcacgcagctttgccatccattgctacaggctacagcccttgctccctgaaatgttcagaaaaccatgagcttacccgcacaaagagagagagagagagagccagtggtggagtcaggaatttaaacctgtgagaaagagccagtggttaagaaatactgttcccagtaataaacctgaaaaaaggaaggagatattaagttttgatttgtggtgtggcaatgaaaagttgaaaacaccagggcaaaagcacaaacattttcattgcctgagaacatgcatagacaggattgaggacaaatcagagagactatatgggctcaaaaggaaaaaaaatgatgcaaaaggaccgagttgtaaggaggtatgggtatatctgcaaggaaaaactggacgcagggaccagaacgtgaattctaaaatgatgatcatttgtgggtatatccgcaaaggtagagactgagggtgcaattgacaaggaaatgtataaaaaggaccgagttgtaagagttggaatagcggaaggggcgtatctgcaagaaaaactatgggctccagggacctggttggaaatctcaaaaaatttggaccatttctcgatttgtgcgtgtcatccttgcgcaggggccatgctaatcttctctgtatcgttccaattttatcggatgtctccgaagagacaacacaagcggcagcgcgcggggttataaggtgggttcttcattgttcggtaggcgaggtggtactaaacctgtctcccctcaacgctcccgcgacccaccgatccccatccaacggcccccgcagcgcccagcggcatcccgcgcggtagtacacgctcgtcggccgtatcctccgttacggcccaaacaagcagagagcacactaggcttctctcgcctgcggcctcgtagctcaagtctgagccccatcatccatcgtgaccattcatgaataaaaccggtttgtatatgtgctcctttttttttttgtccggcttagttcgttcttgcataacaactgaggttctaagtggcacgaaaaagggataaaacaattaacacatgatgaattaattattaactattataaacttgaaaaatatgttcatttgaatttttaaagaaaattataccgtttaacaagtgtcctaatgaaaaacaagcaagttaagtttaggattgaagtaaactgtaaactatatgtctgaccgcttgcagaactactgattgaccagcttgattgcgtccaaaatcaaatggtagagcgagagccgaaggcaagcccagctggtttaattagcaatcgcctatataatcagctagcgcaacaactgttagttagttggttgttgatgttgtgcttcaagaaatcaattaattaattagtctgttcttattgcttagtgtactacacactcttagctggagccctagccatgggaagaaattaattaaatccccagataaacacatgaccacgaaactgcattgctgtactaaagctctgaactagctagcaacgcgtcttagatatattccaccaagcaaaagccacatcatgctgtgctgtgccgtgccaaattaaaaccacatcgtggccttcaagtttctgctagcttcgtccttcgttgctaatcccagccagttaatcaattaattcgtcagatagatagatatatatacgcgttcatcagcgtacgttcttatagctagaactcatcctgctgtgcaaaacctgcatcactagctagctagctagctctgaatcctctagttgtctgatctcgatcgatcgatcgacaactatctcgtccacatcaagaaagcaaagttttcttgagctacgaatcaatcgatcgatcgatcgccatgggcaacagaaacgaggtgagtgagaaaatctgaattgatcatgcaatttcagagccaaattgaggtagtagcttagctacatgtgtgtgtggttgcattccagcagcaggaggaggagcaccggcgggcgagggtgccggcgttcggcgagtgggacaagatgaaggccgccggcgtgctgccggactactccctcgacttctccaagatccgcgccgtccgcatgcagcgcaaggagggtgggcccctcaccacctggtcctccaccgccgccggcggcgtagaggtcggcggcgagacggagcggcgctcatcgtcggccgccggcgtcgtcgtcgacggccgtgatcgccgccgccgccgccaccgccaccgccgacacagcagcgacggcggcgccgacctccgccggccgctccggcacgaccgtgctgcagctcccaaggtcagctaattaattaaactgctaattttcatgcgttttggtgttcttctgatggtttactaaaaagtgaagattccaaggtctgtgttactactaccatgttaatcattttaagctgcacggttataaccatatgaacttatccgcgattaagtgaaattaataagcatgattcgttcaacacactggtcaatttgttttctcaacacaaacgtacactgtaaatgtcaacatgctgcccgttagttaaaaattcagaatgttcttggggcaaactgacgtatgttaatcccgcgtttaagatatttttatgtatatttgttttttgaggaaatgtttatgtatatattttactctgctgaaactgctgcaaattgattaaatgcgacatgctgcgcacttcatcgctccttttaatatttctgtctgaatgttctttgggacatctgattgaacaatgtactatacttaaaaaattcagaacacacaagtcgtcgcgccagattgtcatgcttaatttgttgaactattatttgtttaattttgattctgaccattgtttagttttgatcctagcaggagaggagcaagctgggctacctgttctgttgcattgctggatgaagggcattggcagaaaaaaaaaattcaaatgcaagaaggcaattcaagaaaaaacttagtgctcatacatgtttaatttctccctcgtatttctgccatctctcaccgatcgatctgttggtgatttggtggatgttggtgttccatatataacagctcgttgcatctgtaatgttaggctgtctaggaattctttgctgtaaaaaaagaaaataaattcttggttaattttgattttgcctgggatgaaagccattgatttgtagcctgtacattgcacatgttgtaaatagtgaagtcgagagttattttcgcaatttttaaaattaaaatggtttcttccgatctctttgataccacaggcgggctaaaaattagtagtcgtttggattctgaagaattcatcggtgcagtgaacaacaagcatactgatcttataggattcgtaaaggaaaaggtgaaatgatttcagaagagacgaacaaaatgaaacggaaagttaaaaaaatgtcaaattaggggtaataccagggacgatattgaataatgtaggtagccaaaagctatctgtaatggaggaaaaacgagagactgcaaagtggcaaaaggacccacctgtagaaaaggggaataggcaagggcgtgatgagaagatcccgggggcatatatgtaaggaaaaccatggtcgtcagggactaactcgtgaattcacaaaattgaccatttgtgggtctgtctgcaaagggagagattgagggtgcaactgaaaagaaaacgtggaaaaaggaccgaattgtaagattcgtaataggcggaggggcatatctgcaacgaaaatacttgtaactcagggacctggatggaaatctcaaaaaaatttggaccatttctcgatttgtgcgtgtcatccttgcgcaggggccatgctaatcttctctgtatcgttccaattttatcggatgtctccgaagagacaacacaagcgacagcgcgcgggtttataagttggtcgcgttcgagttagctgggcaatgtggtactaaactgttcctcccgcctctcgcgctcacactcgccctgtgggccgctcaccgtgcacgtacttgggcctcccgctcccccgcatgcatccagcccatcacagcgaagagaatcgggcttttcttctccccatctccctacacaaccaccaaatacagccaggccgttggttcatgatccggcggcagatcgacatctacctcttcacggtctcacgatgcaagcgcatcatcgaaacgtgtaaagcacccataataatactgataaattattcgcagtttcacacccagattactccataaaaatgatcaataacacatgaattatgatttatgcttgcttataattacatagtagatgacaaggcttactctgagtaactctctttttttttttggtttcatttgctgaattaatctgtgctactacagatgaagaagctagagaacattttaggccgacagcatatatattgatgcattacatgagtaggctacggatgaggtcgggcacatctgcgccgttgatggcgagatcggacggctggaggaggaggagctcggcgagcctctcgctgagggcgtccgcctcccggtgaagcctccggatgtagcggcacgcctcctgcagcacctcggcacttgacgcctgctttgattaatcaatcaaattttagcgaggaatatatattaatccctacattataatgggatatataaattgtacttgcagatggggaaagggaaaaaccaataaaatgatgtgattataaacatgcgcatattacacgtcatgcgtgtgtgtttacaataacaatttagtgggatcagtgagacatggaattgtggtctccagctctttcagcggaatggtaacacggggatatgctagtggggctggcgataagcattgtgtgcgtgtgcattttccgtacaactgacgaagggaaaaaaaaatataaacacatatatctacatgtggattatcacgtcctaaaaattcaatatccactagccacgtaatgattaacctagtagctcaagcgagtgagttagtgacaggcacaattaatgacggatataaacccaaaagggaggatattatatattaattgccaatgcaatgcatgcatgtatatgcatgcttggtttgtaactgatcctttcgcaattccgaccttatggatcatcgattgcatcgtctagctatggagtaattaaactagggatggagatcgaactcatgttaatattttcccttttctaacgtaaaatattcccgcaatcccaaatagataaaccagtacatataatatgataatatattctaatctacgaatcaaaaccggtttaatttgatcgagatcgatcaaagatcaccgtcttaccttggcattggcctcgccgccgcgggtggggaggacggcctgcagcttcgagatgagctccgccatctgctcatccgtcggcggcggcgccgccgccaatctcgacgatgtacggctccgccggctcgacgacattgctaatcgagagagagagagagcttgagcttgtgagcctagctaggcaaagctacagtcaaaggagaggatcgatcgatgagcagtactagtacatgggcagtccagtccatatataagaagagcacgtacgttgtgcatgcgtacacgttgcgttggggacaagctcacatacggtgatagagacatgcatggggacatgcatgcatgttggtagctagcaacaataaataataatattagccatgtcagtctcacacggttaaagtgttagtcaggacatgtttagtataactccagcttctaaatttagcttcaggagttgggtctagagtagaattgtggagcggcctaaatcagctccacctctctagttcattttgtaagagcgctccacccagctccggggctgaaactgtttggctgaactccggctccagaagaggtggagctggagctatgccaaacagtctcttatagtatagtttaaggataaagatatcttgtggttgtagcccgttgtaattaaaatgatcgatatccgttatcatgtctttttttttcttttctaatatttgtatgatgtgtaaattcagctatatttgcagacgtccaaaatagccttggattaattgtaccattttagttcaacggtatgagatcaataaagtttcttttatcaaaaaaggtgttagtctctaagagattgagctagccatgttacatgcctaactgggagctgctacaataagtacacgtagctagccagtgcatatatgcatatacatgtgtgtcgttatgtacataaagttgtgagaagtgaagaaagcaatgccagcttcagcttcagttggcactgtactgatccagtggaccagtggacggacaactggtgcacttatgatgttggatcgatcaatcggcaattgtgtggggccaaaggcagaatgtgtcataagttctttaatttatttttaattatttccccaagtttaacaaaataattaattctcagttgaatgatatatgaagatactccatttttttcccatatggaaaatggcatgtttaaacgatgtcatttgatttgcatgtatatataggtatatatgatgctcatgcaaagaacaaaaggccagtttggttagtttgttcttgcatggatgatcatatatatatcttatttgctctcgacgatcctttcacgtgctgccatgcataaataaatagtttatcagatattagggcactcaacaccaacaagatgtcgatcgggtaagagtggaagatcatatgaaaataatcaaaagtatgaactgcattgtaacaccctccaatatgcagttaagatcgagctgacacgctgcattatgcatgtgctgatcagatcatccggagatttgatctgtgattgcgtatcatggtcacagaattaagcatttttgctttgtcaggtggactcacacgctcacacacaaactttaaccaacagattaaattaaatttcagcttgttggtcaagacagcccggagatgggccctcccaaaaaaatagtaactgagaaaatcacatggtatcagtacgaagttttagaggattttattgccgattaaaaatttaaaataacctcgtctatatattcttattcatgtaagttgagtattgccctctctcgtaaattaggattgacatacattatttttctattacaggaagaacgcatattcgtaaccgcactaacgcctccacgaatgcaccccttaacaatatatgctcaaagagaagagatagaaacctctctagccttactagaaatcccattgtgaaacgggatggacctgtggcaactcattctcgctaaaaatattatggtttgtgagactgcatcccataacatagtactttaggcatcacgatttaaaactctggcggtggagctatacatacaccacaactctactcgaatctggtgcttccactaatatgtgaatcttttttttattgctcaaaaaccgcatcatgtatgcactcaccaaatttacacatctatgaatcatgaaagtgtctcttaacacatgcttaaagaaatgaaaactagtgacaattccctagcctcttactgattaaaatcctattgaaagtgtacatctaggctagtcataacccaaccttactaaaattatattaaaaccgcacctgcatgtatgtagtatttctaataaccggtggtggagctatgtaccacgacgatgcttccactgacacgtgaaatttcaagattagttagacgcggaattatctcttccttatattctgcaggtgcttccactgacatgtgaaatttcaagatgaatgagacgcgaagttatcccttcctcataatttgcatgactctatcctatgactcctgtcacatcctcaaacatggctaacttcaaagggattaaccattcacatgcatagcataacttgttggctacatgcatgcatgaaagcatgaagcaccataattggacagcgcatatgaacaaatcaagaaaagaaaaccatcaatccattgtattgcgaccattcaacagggatggaggaagtgaattaattcccaaagttgattgattgattgggccgtctttccaaacctgtgggtaggttgcaaccatattcttgatttactttttctgaagattatgttagataaataaacatgcatgtgccagacgtccaaggttatccatttttaatttccttttaacttctatatgtagtttctttatggagaaggttatgctccaattgtatatgttgacttcattccttacatcaaattggatgcttgatcgtgaaggttatttggttgggagaggagggtgcatctgcatttttaatatatgtccttgaattagcatatgtgttttgtgccatttaattaacataaacatatatgtttttcctccgcaaacacactacattacacatggcttttcctcggtgtcagagacaatattgctacagtatttaattcccaaaagggttttgattaagtggttgttaatttggtcgacagaccaaggatgcacaaaatgcataatcttgtcaaactttctgtggggtacgtatgtgcatgctcgttacccacgtaaaaactcatttttatagtttatcttttacttgctagtacaaaatttgaaacaagaaattaagtagaattaggataggcaaaaagaaaaaactcgtttgtctgtccacttgcatccctacttttctaccactcttatcttaagatatgattagcgaaatgatggcacatattgtattagctaggaaaaaatgtcactttttttagtgaatgactttagggtaaagataaaagagaaaatacttttataggtgtggttgtgaagtacaaatgagttgtctggttaaacttgtttaacatgaagtgtggcaaggaaaggcaatgttttgccattaccaattatactctgatagacctaagcgccatttaggataaacacatctaaaggcccctttgaatcgcaggattgagaaaacgtaggaataggaaaacgtaggattttgatagaaatgtaagtgtaaacagaggataccaaaacgcaggaaaaacacaggaatgaccgtttgattgaaccacaggaaaaacacaagaattggatgagagagatagactcaaaggaaagttagcaagaggttgaagctcttgctaaatttcctccaaaatctctataggattgtccattccataggaatttcaaaggattggataggattcaatcctttgtttcaaagggcttcataggaaattttcctataggattgaaatcctctaaaattcctatgtttttcccccaaataaaaggggccctaagtgtatacgacatcgctagctagttaatcactaggcacttgaaaataacttgttagagcatcattaagagtatcccaataatcaattcccaaaacaatgttttttggatctcataaactgaatataggaagtgagaaaacctatctctccaacagaaagcttcattgatttcctataatgaaaagtaggccatccctttaactaccaat

SEQ ID NO: 75979 - DNA, 12496 bp, Oryza sativa
aaaagtcttttagaagattgaattcctccaaaatttctccgagaaccgaagggagatgggggtttgttccgtcacctctttaatttgctttatccttacgtacacgatactcgttaactatgtgcatcgatgatacagaggccagacctaacgaacaatgggcggaactaagattccatggtttcgttggatatatatatttaatggtggagaaataaatcagaatcatgtctggtcctccatgataattgctgcctgacatgggacgacatgcctcaacttgggggcttggttttcagctgctagctgctagcaaacgatgtactctctctgtccaaaaaaaactaacttacgtgagaatataatttcacctaagataataaattggataaaaggttgtccagattcgtcacctagattgttttttaagacggggaaagtaatattagtagtactccctccataaatgcttatattttaggacgaagtattatcccgcaaatgcatcagtagtataaactctcacaaagtcacatggatgggatggtgattgtgacaagtacagttatcagtgcaggcaagtgaagatatatatacaggaagaaatgggattaagacaagaatcaatgtatgtagatgctgttatattagtagttaatttcatgtcaggaatggtttctgcaatgtgcccacatgttgtgaaaatacttggaggatatctctgatgaatcaactgtgtcaatcagcaattgtatcatatatatgctctccaagtttccttcgttttgaaatttgaaggatttgtctagttggcgatttgtgatatgtaagaatcacaaattcagagtgtattcaggccaacagacaatctaaaaggcacatgatcaaattttgagatgttaggtgcagaaatggagatggtaatatacaatattttcgtaaaataagatactagtacaatgtattttttgtaaaagcaatgacaaattcagtatgatgtgtagttgtgtacagatccaagtgtgctggaaagattaccagaaaaaaagaagagagaattatccacacttctattgaactgttacagcattttgctaggataaatgcacacaacatacaaattccattccaggggttccctcgccatgctttcaatattcaggcctcagcaatcaagtcagggagaagcttgaacctgttctgctgcataacagagaaaactgaatacacatggacaggcaagtatgtgcaaagaatgaagaaattcaactacaaatttaactatgcattctttctctttctgtaaggactgaaattttatgattttatccttgtagccaattgatcagcagatcaagtcaattttatgattttatccttgtagcccttactacttgccaatgaagtactgtgctaaaaggtccgcgatagagtttttttgggaatacgcaagcggcgcatctttgtattaagaggaataaagtttataaacaacggatccgaaaactgaaaaaaagaaggggacaggttacaggacacagaatggagctaaaggcctaatctccgactagattttgcgaccggggaaccaagctaggaagaggcaattctggcaccgctgcatttactaagtgccatagttccgcctcggcagccataaccttcgccacttcgacccaaggcttctgttgttggttgaagaccctgttattcctctccttccatattgatggagaatgaagacttattgatggaagaaataagagatcaagaaataactactttcatttgcattatctgctaacaacgtcgaatctaacagttgagagaagccattatcattcagtaaagactgagttatattacttatatagttctagcgagattaatctctacagggttgatgagaatagagaaccaacagcctgctatccgatggtgactcccggattatcattaaaacaagacagtactgtactaacacctattagtctataacaagcattagcatggcactaactttgttgaaggtagcagaagtaattaatcaatgaggatactagctcacaagctcagtggtgagatcaatcattaaggaaatactacagagatacaagatgaaactacatgttcacttatatgttatatttttggcggacagccgaaagattggccgacaaaatttcattaagatttagggaagattattacatggttttgtcatgacattaaatgtcgagttgatggtggttaaatgaaatttagacaagctaattgtttaagcgctaccgaagcttttacatgaacaagatcacttttgattaaccaaaattaaagaaagatatgctctcctgtctaaaaattggcaaactgataatcttctgacaaacaggacaaaactgaaggcaagaaagaatcaatattatttggatatcattttcattctaagtttctaactaacaagttgccattttgtaaatcatattctaataaaaatcataaacaagaaaatcacctaacataactccagcatcatgcaaagcactttcttctctgcaaaaacaaacataagttaacttagttgatcacatgagctatttctttggaatctgcattgaagtcatagcgtaagaagttttccccttaacatttctagcataagattctcacccatctctcaacttctgatgctgattcagaaagtctcctcctaagaatggacttttctgcttcacagctctctaaatcaacatctgcataagataacaaaatgtccagaaatgtgaacacttcaaatccgaattacaaacatctacatataaaactctgtttatgccggctctacacatatgcactataaaatatatggataaaatatactgcatatggatgtgttgatataaaaatatagagaaacattggaaaatgtaacatagaacaggtcaaaaaatatatatatcagaggccttaatcaggacatgcgtaataaacatggcatgataaaagcgctagacaacttgcaagtacggtatcagaaatccgaatatggtaagacattttggtgattgggcagagatcagaataattgaactaagaatatggcatgaattaatactacttcattattacgtaaaggtcagaactttagatgctaacattatagtttcttatcacatgacagggttgctttatcagcgtggtacacacctatctaatctctatacatacccaatgccaacaatattcaaatttccacctgcctgttccactactagagcaaattcaacatttgaatggtacaaactaaaagcttgaaatctaaaaacatatactatttattaaaaataaattctaaaacgttgtaaagatgatctcatctcaaggacatgcattctaaggaaacacataacactgtatgtcaaacattatgtgttacataatgctaaattgcatttggtttgcattataagattttagaagcaccaaaagagataaataggagataaaacaagaaacgtttaattcttttcaattccttaccataatagtatgttgacagaatgctgatacgctcaataggctgaaaataaccaaaaaaaaaatgttaatgtttcatttcatcatttgtcatgtatgtaatacactttgacacgaagttcaagaatataatagaagtgataagattgcgtaagggttcaagtatttctaaagccatgcgtgttcagtgagcctgcttggacaaaacacacactaatgaggcaaaaaaaaaaggaatatctatctgaccaaaaacttgaatacattattttaactacaaaccttttacagaggatttgcagcagagaaatcattatgtgatttaaggaaaaactaaaggatgttttatgcctacataaaagaaaatgctgtacattgcaggtggacgtatacataccattacaaatatgccttctctacgagttggaagttgctcaagttttcttaatgtatcatcaccttttgtgagccttccaaatacagcatactgaaattattatgaatcaatgtttaatcatttaagcacctggtatttaatcatgaaccactgaagaaattgttgaacacctgtccatcaaggtgtggtgcatctccaagaaggatggaaaaggaagaaccaccactgtttggatcagagtgccttggagaagggggggaaaaggtgataggtgatgttatatcattgcaggcatatgaaaataagtgatttcataaaaaaatcaagataaacgccaaggaaattagttcatgatattttctaggactactttgcccaataactatcgcattcattttgatttagacaaatagacaaattaactatggaatatataaaggatcttcttcaatacctatccttttatcaacctggtaatcattgataaacttttgagggattacagaaggtactacatgctcatgttgttttggctataaccagaaggtagcaaaagtgatctgttaaaacatcaacaatgtattcacaaattgacaaaggaaataccttcccatggacagaatccccctgacatgcttgacagtactaaattcaccaacaaccgatttctctgcttcctcttgctgctcatcattcatgggggcagttctaccacccacaacagaagcaacttgtgcaacaaaacccttgtcaacctgaacccagtcatcgaccctttacataatgaaactgacaaagtcgtttagcaaaaatgaaaggttagcactaagaggtaattacccggaaaaagtgatttgtgttgtagcacccaagcctcacaagtttgtaaatgtgttcaactgtcttaggagcaacatgaggaaagaagccaaactcaatgtcaccatgagttgtctgcagatcaaattgcctaatcagaaataagaacagatactaccaactttggatgctatagaaccaattttgcctagtgtgtattagctgcaccaggacattagccaaggcatttcataacaaattgaaaaataaaatgatgtgatattataacaccaatacgagatatagaatctgaaatggaagaacatatccaaaatattaagatatcctgttattttaaatcctgattaacgagataattagcttcagccctgtcaccggcttaaataataaagatgcatacttcctcttcctcgtaagtgttcttgttcatttttaggaaatcagaagtttgtagcaacgaatgccacatgagactggttgcctgatcggcgtcctggcattctcccaattgcacactaggtggcatacatctaaattttaacctaatcctagtaaaatctcgcaataagcataggaacggacagttcaacactgcctgcgcatgaggattgacaccttgtaccccttgttttgcaacatctaattgcaacacaactcttaaatttccaacacagcactaaaccgattctccaacagtcggacgaatctggcgaacagcaagagcaacggcgtcggaattcagcgtagatcttcactcacaactcacaattccgaaatctttgatgagcctacgaatctgaccgtgccaaaatccgacttttggccccgttttctccatgaaccccggtaaaaaccgctcctttcctccctgatttagaacagcaactcgggaaaatgagggagatcgtggcgaacctggaagacgacgcgggcggatccgaggtttgggtccgaggcgtagaagctggtggcgccgtcggtggaggcggccgccgcgatgaggaggaccacggccgccgccgccgccgcggcgtggcggagcaaagccgccatttttttcttcccagttcccacctcctctctctctctcctctggtttagctgcaattgtgtatactgcagaactgaggagagacacaaagacaagtgattttttttaaaaaaaaatggttatccacaatttcacaatttttggcaatctttttacatctcagttccctttcttcccatcacaacccaaacctccaggacagccgccaataggtagggagaatagtgttggctgacggggaaaagctcgacggcggaggccgctggccgacgtggctcccaacaatctggagcgcgtgcgcggtgcggcctggtcctacctgtaatggcaatgtcatctttacctacgcgcatgagggctggggcttccgccttgtcaccttgggcaagctcctatcccggcccccaagctcaaagccacccccgccgagctgctcaaaaaccgatgtgttcagatatccctgagctctgcctctccttcatggaggagcactggtggctctaccgcatcgtctttaaggtcaattccatcttcgcgccgccttccactatcaagcttctcgacagctgcaagccttctccccgcccatcgctagttgtcgtcgtcagggttctacctaccgccgctgcccaacggccgctgcccttctccctatcggtcgccagccaccgcacacctcttccgtgactcaacatccaatgtcctcttcatgcgcacggacgctcatggagccagtggtgctcgggatcgtgctcaggcatcacaatgtactccatctcctgtctcttggagatcttctcgccaatcccaatggtgtggctgacacgcgaccctgaccgagagagggaagagcgcgtgcgctacgtggatccggtctgcggcggcgtgcggaggaagagatgcgacatgagccattggatctcatgatcgtacgatttagtattgcgtgtatatgtcagggttggagtcaccgtcaccactatgcttttttttaattatattagtaagtatatattattccttccgtcccattttaagtacagttgtggttttttttccaacgtttgaccgtctgtattatttaatttttttatgattagtatttttattattttagatgataaaacatgaatacttattttcttaagtttttcataaaattttcaaataaaacagatggtcaaacgttgaacacttcaacgtaaactcacaaaataggatggaggaagtatgtgctaatttaccgttctgatttacttgtcgagggaaaaggttcccaacacccttagcttcaaactcacccgagttcttctccctccatccaagctcaagctaattagccaaacattgaattcaacatgaactcgggttccaataacaagttggaaaactgtcctaaaattccaactgatgtttttgcaaggcattcttccatgggcccttggagcccaacgggccgagccggcccaaatccttctctcttaaagccgaacctgatctcgtcactcattgaaactagcagctcttcaccgtcagcaacaacagcatatcattcattatttttgtcttatttttctcctctttttttgcagtgaaattaaagcttctcgatttcgtcttctttttggccatctctcctttggccttttggcaacctaggtagcctctcgatcgatcgtcatggcgtagaaatcatttccatgtgttgtacacggtgcatcatttgtctgcactcgcggtagagtacacacgtacatacgtatacatgtattttatgtttgtatgtatgtattgtgtatacctccttttggtttttggtcaaaattaaatgatttgtttgtacgtccttgcacaaaaaataaagccattcacgtacctgacatgcatattcttcctagtatgatgatgtgtgtacgtgtatatatgctttaactttggagaagaaatatttgtaacgaattttagttttaaaaaaactatgggtttgtttagtttggaggtaatttttaccctactaaaatttggttacttagtaagtcttgacactatcaaatttgattgtagcatataatttgaactagtatgaacaaacattggtagcaaaccaaatatttgtttgattttagataatggaatagaatatccccgtctttgctcaacgacagcaagcatatcattttgcttaatattcgtttgatactactgaagttgccgaaattttattcatgcagaaattggctccaaaaccaaacatgccttacatatcttgcggattttcaagcgtaacttggcgtgcagataatttttataattaagttcaattagatttgatatacactcttgcttgtgtgttctctacaagtacattttattttgtaatataataactatatacataattaatcatcatcgttcagcgtcaaataagttgattctttgtgtgcctttctgtatgtttttatcagcctcatctttttattatgcttatacttattagctaaaatttaaatttttaatctaaaatttaaagttgattttagggtttttcatcgtagtttattttttagcatttgtttttagatcgttaagaaaatgaatataaaaattttattcacaaattatttttcatttttcatttacagatatgttgttttgctttttttttctccaatatgccaaacaatgggactatatacagatatgtaagcgggccgacccacaaatctacttatttgtcaataagtggtaatccgcgggttttcacgtcatagtctggcttgccgcacctagagatataagtgggtcgatccataaactcatttatagatcaaattagtaggtaacccacgggctatccactaattttgcctataagcagcttagcctgcttacagcctgtatatttttattgattgattttgcatgtatatatgaatgcatggtatatgatgcatgagcacaaatgtatatggttgcaatgcatggtcagataatctatgtcatgtagcatgatgatgtacacgtatgtacttttggggctaccctctgtggtccacggtatgacgaatgcagaagtccagaaaacgaaaaatggacgcttaaattagtacgttacacaagtatataccaaaaaatgcatgtttgcattgtgtgaaggaatttcagacttttttcagggtgaaatgatatatcaatatatgtgttcagtcatatgcctggtcccaaaattggaaaactaaatattttaccatgcctagctaggcttcttcacttgttaatttgtttgtttgtgcaagtgcactccaatcatcagcagtgcatgccttcataattaatttacagtctagattgcatgcattgctagctactttctggtttcagattgatatgtaaagctgcattatataatcctgttatgtgaatacatcatctgtggtgtgcatgtttacatttggggccacttcatataaagtccatgatgatgtgaccaaatggaacactccaaataggggaaaagggtggttataggctatacggccagcaattttggaaggaaataaatgtaaaccataattgtttaacaaaggcctcttagaggaaaacacttttgctacatcctcacacatgtcgacgttgaaagaacatcctaaattttcattaaatgtccaagaacttcgatgtgacaacgcgcataagaaaaggaaaaggggaaaggtaatctagttcctccgcgtcgtcgatcaaatttttcgtgagtacatgatgcagtgtaaacctatagccctttataaatggacaaattattccttctctcaccctctctcaccatatgaattgagcatccataataatgcaacaaaaaagctactgaccaactgtttttggaatttcttggacactggagggataggatcaatttggccactttttccccagaggcatttgtgcccttgcttgtgtgggcccccagctgcttgcacaccttgcatcatgcatcctttcaccatttgaaacccatgagcattttggcatgctttgaggtgttcttggtctctaagcaatctccctttttttttcctctttacttgccttgccaaactacaaggcctactcttcttctctcttagttacatggaaaagacaggccagggggtgcctaggctattaggtgtgtgccttgtgcactctatggtccttagttgtcatgaccccaagaatgggctcaaaagactttagggagaaaaaaggtgccatggagtgtagtactagctacttgtacgttgtttttagtgggatcaagcctctttaattttatttttttccgaaatggagtggcagcatgctgcgtgtatcaacaaatttgaaagcaaaaataatgtccttatttgtgaaacttaattttcacttaagagtagtacatacgtaagacatgttcaagatatatataggaataataaaattaaaaatcttgtaaatataatggcacacaacgttatcttaaaaaaaatgctccaacacttgaataagaaagagaaaaaaaatatgtttaaaacttatctagaaaagcaaagaaagggtgagtcagatcaaatgcgggtataactcacgaaattgtaaaaatctgtgtgtgtgtgtgtgtgtgagagagagagaggcagatacaaagagagagatatagatttggaactatccatgaaaattttcatgatctcacctcattttcgatttccaccaaaccatatataggggaaaataaccaaaagagaatgaggaaacatttctccattttcttttactgaaagtattataggggaggctctcatcgtcaaatttattaaaagatgttatatgtgtgtgcatgtattctagtgacggttagttaaaaaaaattatgtacaaagattacaacaatattcctccatttcgaatattaaagaaaatattttgtttggattaatacatgcaattctcccttttcttttctcatttttcctttgatccaaactggttctaatgaagtattacttaataatatttttaggagagtactagctacttaatattagccattttttaggaattgtttttttaaaaaaataccttatgaatcacttgaagtttgacatttcaccctataaatcattttgttgcaaatatttaccccatacttgttgttgttattgtttttgttgttgtcagtccacacatgtttaactcaatcaacatgttttttttaccaaaactaaacatttataggagtacacttttcttggagattccactaatagaattgttgctgagagcttaaacattatcgtaccgagttttgctatatgtataaaaagtttaatgaaacatgaagaataagtctaatgcaagcacttggataaaattgattcggctaacttaacctgtggttactctacatgagcgataaaatgtctgattcggttaaataggtgcgcaattgggtggtttttataataaaaccgaggaggtgggggtggatatttgtaacaaaaataacttaattatggaatgaaatattaaattttaaatgatttatgggtggttttccttttattttaggaaatattagcgtggttaatatgcgtagacatatttggtcaataaccagcagtgaatttgtgttcatgaattgaaaggcaagctgggtaagacactcagctcgtgtcatcatcattaccagtcaaagtgacttaagactgcacttacgtgcgtactctttaactgcggcacacctaattaattcgcattaaccagtcaaagaaaattgagaatatctctttaagtggttgattagctaatattttttttaccctgctgtcaagtgtgcatatatatatgcacgctgacacgcagtcaaaacataccaacaattaaaatgttgtatatttgcctctgtcaatactcaagctagtcactgtcattaaccggtcaaaagtgaattaagagtgacactcacgcactagttaatgctcctatagcccgccaagccgccggcaagatattaatataatgttgaacttttttcataattgtcggtctttccaaggctgacacttgtcatgatctatcatgatgctcagtaagaatggattattggcacaaaattattttctaattatttatgccgcacttcggaaagtgcattttttcaaaaaaaaaaaagtcaacatctgcatttttctagactttgttttaagctatatgttagatttatctttttttaacggaaagatttcattaaaaaattaaattacaaccgatctctgcaactatttgttagatttatgatatattatatttaattctttcatatataaaaggaagataattcatcgaccttctgccttcatccacatttctctagtattataaaaattgaagatattttttgtcggtacttcgataagttatccgtgtttgagtcagtttttaagttcgttcgtttttgaaatacagttccgtatttgagtcggtttctaagttcgttcgcttttgaaaatacagaaggagttgtacaagaaatctgtttaaaaaaacccgcatgctagcttgagacaattggacactcaattgcagctcatgatttatatatatatatatatatatatatatatatatatatatatatatatatatatata

SEQ ID NO: 75980 - DNA, 2576 bp, Oryza sativa
agctaggcaatcttaatcctcttaatttacttgactaattcagccagcagcatcagtacaaaatttagcagaggacacaccagtatcttttccggctgcactttaactctgcggatttgcggtgggccgtaagcttgatctgattctttccggcaagagcacggaagcctgtctgtactcccgtagatcgccgccacgtggtgctgttgctcgcggtcggatcgtgggcgagcaggccagggtcatttatagaggtaccgaacgccaaccgaccaactgaggccgttgaccgtgttgagagctgatggcgacttgcctgtctcagaaacccgtgtgtgcatgctttgcttgttgtcggtccattgtgtttctactacccacctttgactgaatcaaaggtgtatatataactagtgcagtaaaacagatggcaagaaattagttgttttaatttagaggcttggattttctttcgttaaacaagatcgattgtattaaaaaaaggagaatgaaaatctttgtctaagaagaaagacaaagatgaggtggatttgctagatatcattcgacggaaaattgaggatgagaacttagtgattttgaaatgttgaggctgacttgatgacttgtgcactaggcttctactcccactctggtgacccctgtaactttaatgatctctccaatagtaaggatgtggtaacgagtagcgaccaccttgttagtttctaggctcaggcttgggctgtgaaagaggggagggcatcaagaaggtagtagttaagtggatgtgtattattgcaaacaatgacgaaactagaacaaaaattattagggtcctatagtcgataattatgtaattatcgacaagtatactaattaacatgatataaattagctagaattgaataatatacctagtgtgctgagacctcgagagagtgtatgtaggaacgggttgcaaataaagaaggacgatataggcccggattaaagaaaatgatagggctggtagtaatggagatagaggactaaagggatgaggttagcagtattagagctagccggttgggcttgatgccagtgaggtgaagtgggatagcgcaacgagaatggtaggaagtggcataggattaagttggcgagttgcactagtcgggatgaaggctagctagtggagattagtacactactagataactgatttttcgacgtggtacccaaaatcacaaatatcttggttagattaaaaaccggtactaaagatactttagtaccggttctaaaagtccaagtccctagaaacatactaaagatggaggatcaactggtattaaagatagtggttctttagtccgagttggtgttatcaaccggtactaaaaatgcattttttgtaccttttggtaataccaaccgtgactaaggatatttttagtactggttggtgcctctagggttagttcaaaaggaaagcatctctatttaagtcagatgtgtgtagttggtggaatggtttcgcgcgtgagggttgagtgagagatcttaagtttgaatcctacattccacatatttttttcacttgctatgcatctttagtaccagttctctcaaccgatactagtaaagggggttgtaaaccgggactaaaaatcttttcccctataatgtattgagaggagggtagctctcatgtgttggactctaatttgatggtataaaagtcgtaagattttgagggaattattacaaatgcagtagtttcattgagaggggaatatttgcagtatgctaacctggtttcaatcgagctcgctaccactctctctttctcttgttgtgccttcaccctttgtttttcaggcaagcttcacctcctcgctctactttgctttctctttcttacttaccacaactctgacatctcctttttcccatgcaacgatcaacatttggaggtgaggatgaacaacgtcaccaggtaaggaggagggagtgtatgtagtggaggcttgatcatactacattaccatggttgattgctaattaggcttaaaatatttgattattagcatgggtcctccaaagaatggaggggtttagatgtactacctttaggttcaatgtgttggttgatctcgggagtcttgtgatgatgttgtccaccctgctcacctatgcatgtacattgccaaccacccgtgccacaataggaggcgtaccgatttctatttggaacatgtccctgagtccacatcgctatataaaaccaggaagtccggtcttgtgcaaaaggtatagccctcccccgataaaccataatggtcccgacgctaagaagtgttggaaggacctaaaggagcattcctggcctgagtaggtgactcctggagggacgctgacatcaacaaaatgatcactggcaacaatgactgtgccatcaaactgacctcgtacatatgactactgctatcactgcattgacataacaaaaggagaaattttgattgggcatcaaggacattcatggcttcttcctgatcctatcaatttatcacctcattccacattataat

SEQ ID NO: 75981 - DNA, 5068 bp, Oryza sativa
tgcagctgctgtgctgaattctgcattggcatccactacagctgcgctgaagccgaacccagcagctgcatcatccataaatccggctgctgttgttgcccgcagtagtccggtggctgcacctgcaatgaagccattggcacctcggagtccagcagctgctgcagcagcggtggtgccatctccggtgaagattgctgctggaataagcggcggtgcaggattgcttgggccatacaagccaccgtcctcgccaatgttggcttcctccattggacaaagggatcagtgctgagcctgtgaacctcgcttctgggtgttcaacatggtaccaaatcggtttgcttgcccaagccctatggcttgagtcatttttgtgctgatgatagtggaatgctgcatacatagcttagttcaacttaggaattttgacctcttaaaccctagattgaaccattgacatggtgggatatcttcctttccaaaaatgatgcctttttgtaataatcatactagtaggtggtagctacattgggtcagttacatggttggatattttcgtaatgcttaacgatgctatagccaacttaggaaaaaatattcatgtggtccatatttgcttagattttagctattcttggtattcaacactgttttacacttccctggctaatatgttgaagtaataagaatgtgtttttcatgtgagacctaaattggttaattttccaaatcatcttttgttgatacaagaatagattacttgtttttttttccagatacacctgtcttgtttagccaagtaactctacactactgttaatacatatcctcaagcttagctgaagttctgaattctgaccagatcaagctagcaaagtagagtagtagagtacggagtacctttaattctgtcatagtgcagatcattaaaaactttcttgcacatcttgattaacctccaaaactacagctttggttagaacttgaatatgggtgttgatatctgattttggatggcagtaagatgacatttgttaggatgtgtttgcccatgttatgggaatgaaaaacaaaatgcattaggcactgtggcctggaacatcagatatatagcaaagatctagtttcaagtcttatattaatcagattggaatcatgatgaaccttctactgagataattcactattcagcttagtgttggttgtatttatagttggtttaccttatgctcaatgacacttgaatttgctgcttgatgtgatttatgtccgagaaccattccagaccacagatttatgcaagcttgactgaatcctgtatttggatactgatgtgcaggtatggaccaatggagtatgggagcagcaaatctacgtcacactcagaggcttaagttgttgcatttatgcctcaaaccctctaggatgcttgtcagtagatgcctctgtctttggctctttgctaacctgaaccatagatgcaaatacagttcatgaagcatccatgtgatcctctgatcctctcttcaactttcggaattttgtacagtgttccgtactatcttgacgaaacacattctaaggaggttatgttcttattcattagattttagcagttctgttcttcagggttacttgtaaccattttgtgttaacatgttctccgctccaactgaatctaacctactttgtgcagctgtcttggtttctcatttgtttagctattgctggatgttatcttgagaaaacacaccctaaatcaatgaacatgcttttttaaaatgttaataagcaatcaagagatgatatagactgcagttagtgttcaattcccaagtagccatctgagtagaggatctaacaggagatcatccttggacctgaactattttttcccgttggaaattcaatcccagtttattggcttgtattcacctgacctgttagcactccaaatatgttttgggatatttgggcatttgcatttgccgtgctcttattgcgatgtatagctacaccttgccatgaaagggtacaaattttagctcctttttcagggaaaaaaggaaaatctttgttgtgccaatcttccttgccatgtaacaggagtaatcgttaattcacagggttttctgtgtttctgattttcggttgtatatgacaatatgtagctgcacggtagttcatcattgaaaacttctccaacagcataaatagggcttcctgtagttcattcatgtgattcttaggatagacaaaaacagagcattttgatctgcttcctttatcttcagtataaccaatcagtataggttttacaccatgatataattgcccagctgcagtaactttttacaatgtgtggttcctccgtatgggtgaaagctggaagaacatgaattggtattgctacttgatacaaaataaagcatgcctccatcagaaactgcctgcattatgtacaaggtcatgtatcatttcctgctttagttacagcatttggtcctcctatgatgctactgctaggattacttcctttctgatgtatgtacaccagttgctagtgatatatggagtataatagcattacagcaggccatgcgcctgccttgtcactggtgtcgcaaatgaggtgtatggcaccgtggatgataccatgaatcaggattctcacttccacctcttcgcgtttttcagcgatttcgatttttgcttgctttgctggaatgcctgcatcttctgcttctttctggcaattttctctgcctgtattacagttagaaaaaagaactgtcagttatagaagctaaacccaattaattgtagttcgcatccaaattcacatcgtgaaaagacagtagagatattcacctttgacatttttgacttggcctttactttgggggctttctcctcgagctcttcctcacgtgcaagttccctctctctggcctcaagattcctttcaaggtaatactgcaaacacaaagaagaaaataacatcatttctgggtgttccagtatttttcagtgttccggcaccctaatatgaaaaattcagactcccctctgttttttgtgatgcctctggccctctgtaggatttatatcttgatttctaccattagtattgctgaagttactgggataattatgatctatatcttggtggcctgaatctatatcttttactgagcactagtttggcacgtgatgaggtaagagtttttatataagatgaagcatttaattcggattatgtggagaaaactatagattatgttgctgcactatgggaaactattataatcaagaagagttaaccatatttcactcgaatacagcaaatacaggttgcaaagtaatattgagtaacttatatcacaggataactcacattgtaatctccttgatagtcctgaatagtctgatctttcacttcaataactctgttaacaatttgctttacgaaataccggtcatgagaaactgttataacagtgcctgtgtattctgaaattgcctcctgccatgcacacacaagcatttactgtaagtacatgctaaacaaggaactgatggatcataagaaaaaagttttgctatgcaggagaactgcattacaatttttttaacatacgagaattgcatctaacctcaagcatttctttcgatggaatatcaaggtgatttgttggttcatccaatatcaataaagtagatggagtcaccaagaacttgcagaaggcaagcctcgcctggggaaataacagataaattgtgagtaaatatacagtaacactacatcatacaaataaaagaaattcactggcaaacgtatattaccttctctccaccacttaagaattgaacctttctatccaacatatcatccctaaaattgcaacgaccaaggagacctttgatatcatcaattttccaatcctctgctgcttctgctacagtatccagcacagttttctccaaatcaagtgcttcagcctggtaaagatcatgtacatgaatctagtcaggaaaaaaatatttttttactactgaaataatgaaaggttgatgatgcgctgcaattaatcaataggcttacaaccacttgacctgatagcttaatcaaacagtgaaaatcaaatatatactactgtacagtattactgtcatgatgaaaccatagtgaaagaaaggatatccatttcagggatttggtgtacctgattttgctcgaaataattaggcaatacattatgctccccaagaagtacttcgcctccttgtgtcttctccatccccaaaataagcttaagtaaagtgcttttcccacatccattggggccaattatggctatcttttcacctctctcaactattagatttgcattattgaacaatttctggagatgataccaaaggaggaattaagagcattaatacaaatagttggggtacggttaatcaaaaagaaattgactctgaaacagtttccaatagaatgaacctaacctcttccccaaatccaaattcgagattccttattgtcaatacagttctaccgctttgcccacgctctggaaatctgatcttcaactgcttcctttggaaaggcttctcaatcaatccttccttttcaagcttttccaatttctagtgtttgaaattagacaaaagttattagtaagtaatgacagatggctgaaataagagatagattgtattgatctgaagcatgccgcaatcatgcaattgtagtggttaccttctgctcactcgatgcacgccctgcgttaactccagccccaagtctgtttatcagttcctttgtctgctcaatctccttctgctgcttctcccatgcggcatattgagtctccacccaaatcgccttcgccaaaacgtattccgaatagtttcccttgtacgttttggacacgccgaattcagtttccactatcttggtacacaactgatccaggaaagccctgtcatgagaaatgatgaccatcggcacttcctgcgtcttgaggtaactctccagccactcaatggtgtccaa

SEQ ID NO: 75982 - DNA, 2509 bp, Oryza sativa
tctggtgcaggcgctgccgctagctcccccccatctcttcgatctcctagctgagctgatcagatcagctgatactgctagcttcctcgccatgattgtgcagtgctgcttacacgtgaggcctccacagggcaccggcgctgattggaggcccgaaagcaagcatgagagatgagagacgtactgtatatgattacggtaccgagtctccgggcagccggtatataaagactcatttttgagtttgggttactttacgtttttaagcagtgagttatagttcaaaatatcttgaccgtttttagacgtgttaggattttaacgctttacaaagcacttgtattttcatgtacgtatgtatgggcttgttagggtatagtaccaaagtcttggtaaattatggtactacttcctccgtttcacaatgtaaatcattctagtatttcccacattcatattgatgttaatgaatctagacatatatatctatttagattcattaacatcaatatgaatgtgagaaatactaaaatgacttacattatgaaacggaggaagtaccaatttttgggtaaggtagagttcataccatatacgatttgctaccaatataggagtatttgctatattgaagaacgtcctagagtggcattaccaatgctttagctctatgtcccctatccaaatcaatcactgaatcacactactatttaagttaccaaatagttagtagggtatattttggcaccaatccaaaatgatcctatatgaactagaataaggatgagcccgaaattcatctgcgttagcagggcccctatattgggcacattgctattgtgatagcctaaatccttaacatcttctgaattctagggcttatttgatttggagtcatttttgccctaccaaaatcttggtagtgtcaaaaccattgccaaattttggcactaccaaattgggtaagtattcaatttaaactattgtgggtaaaatttagtagcaaaccaaatatgcacttgctactattgaagttaccaaaattttggtagggtaataaattggtaccaaactaaacaagcccctagctatctttttgtgggccttttttttttctcgacgagtgatcgaaactgcacaggctatgttttatatgggccttatcaaacaattgacccagaaggactcagagagaggaggcccacctagggtaagaagagaactacagccccaggcctcacacatggatggccctcaataacagcccatccaattcatacaggtggatggcccgggattgaggtccaaacaaggccctctatagatttcgttgtaaagactgtcaagcacacgcacaaagcatacacgcatcacatcgaaatgggactatctatatctatacatttaacgacaaaattatgtaactacaatacaatacaactcatatgtaacttctaaaaatcacacggtaacatactatttccgcgatcagcaagcatctcgagatggaaacccctcatctgtacacatgttgtgattttttttccttacccgcttgctcgaatcttaaaacaattctagcagttcaaaattatgtgaaagttacatacaatataacctcaattatatataagttactatgtaattacactataattatgttgtattatttgataagttttttgaagaaaaaaatattaacaatgtatagcaaaaccatattgaaactttgcataggctaaggaaaagattggctagttgctaacaaatagttactacttaggactagtttggtttgagatctaaattaggcttatcaatatttggcaatttcaatagtgtttagtgtctatttggtttgaagccaaattttggcatgcctaagaaaatagatcatttcaatagtgaacttaggctattttggtttcaatccaaacacaactttgccttaccaaaattagtcatgccaaaacttgccaaaatttggcactgacaaaatttagtaaggcctatttatgccacaaaccaaaccaacccttactcaaaccttatcggttgatctaatatttgactgtaagccatacagtttattaaaaaaataatttcagagtaaaagtttatatatgtgttcttaacaatttaaaaaataataaaaaaagtaaactttcatgaaaaagaaatcaaaatcaagcacttcaaaattaaaattttggtagcaagctgtagtgcaaaagatgggagcctcaataggagaactccggcttgacacatggccagggtaaaaagtcattattaggtcatataatacattcattttttatatgacccaaacgaatatatgtccatatttattttaggttcgttttttatgtgtttgagggagttgtttctaacatactagctataacatataatgcagtctatgatcattaattgtttagcaagatagtgctagcatctcgatctggacaccgtccatttgtacactatagaccagtcccgcattaaa

SEQ ID NO: 75983 - DNA, 5473 bp, Oryza sativa
accttttcttcgccactttctcctcttttcacccggaacgtttttacggactcgtagtaacagcgtgagaaacggtgaagtgaaggggatcgatctttaccggtccacgccccggctcctcgtgcaattcaggaaaggtccctgccggacaagccctgctacagttttggaagcatctcaaatccgatttcttttttccgttacagagaaacgagagggaagccgtgccagccatccctattggccggtcaatgcatcttacactgttctgcagttcaaaaagaataatacggagatactacaccgtgactagaattagatcaagtttaagtttaatagtatagccagctactaacttcaattcatttataactaatttaatagccaattcatataatagttgcttactatactattaatatgtggtcccacctatcatacacacattgcgtcttggagtttgtgctgcaggtggctatagatctgtagcccgttgctcttctctcttatcgtttatattattaaaatatgtttatagctgactaatagtctactattgtacctgctcttattctgtgacgcgtgacctcaacttgcattgagatgatagaaatcatcgttcgagaggagatatttggagcggttaatcaagatcactcatcgtgaggtatgaaaggcacatcgagagtgaattttaaactctcgaggggatgtcctatagccgacgcttttaaccgaagaaagagacaatctttcaacagacaaaaataatataatgttgattactaggagtaaagatgaaaaaaatatgcaatatgcatgctttactgctatatctttactaggagtgtaagggcatgtttaatttgatgccaaaaaaaacttatcaaattttggcaacttgccaaaattttggtaggatttcttatatagttaccaaaatttggcagcaaactaaatgtagccactttttttggcaactttaccaaaatttggtaaggttgaaaatggcatcaaagtgaacaggccctaagttttcatccatcaataaagcaccagttaattaatttagattattacaaagattattaatttagttataaggataaattaaatatgttaataaataaatttaacaaatgatttaaaacaattggtcttagcaaagcagtagcaaaagaaagaattttgagaaaacattttttttttcaaaccatggaataaataatatttattcattctcaacttattcactggtttactgaaacgatttttttttaaatctagataataacaccctcaactcaatagcgagtttgtacatgttttctcatttgaaaaaagtagtaatagtacttcctaagccaattatcaaaaataatttggacattataggatggagggatattaaaaacaagaaacacatatccaggtaaaatgagtaaagtagcgcacaataaaaaaacatactactattgaattctctcgtgtgctactttagtcagtcgtctaaatttttataatgttatctattcataggcaacatattacgtacttgccaaacacagaaatgatagccacatgcacaatacgtctacccacactactataaactcaatcaccggaagtccttttcgctgttgttgttgctgagcccttttcacagctcctctggttgctaccgcccctctcccttcactgtcatagatgagctcggagctcaccttgggtggggtaaggaaggaagggagggagggagggcagaggcaggtaataccgtcggtccatgaccctccacgacgatgggtggtagccttcacgaagggattgaggagggagagagagaggatctaggagggacttagtggccgccaaatggggaaggtttttttgggcgattgaattttcacgggcggcgcactttagctaatttttacaggcaaaccatttttacgggataattttaatttttaattgacctgcttaaaaaattaaaaccacagtgcttgaaagaaatcgtttgtagtggggtgccaacagcctcactcaagaatggccacctgaaatgagaggtggctccccacaatagccatgcgttattcctatccattgacgaaaatacaacgtttcgcgtcgcataccgtaagaacgagctgatctaagctagagacatagatatactccatctcactagcgctggtttctttttgtttagcaacaaacatcgtataatgatcgagcccaagacaaaaccagatgtcttctacgatcccgtttctacacatatgtatagcgtgcctccggtgcatatatatcgatcgatccatcatcctggatgcatcttattggtcacagctagctgtcgcgcccagggctcggtgagcctcgagtgtacgcatgacgcatctcgcgcatgcatcacccgatctctcgccgcgcgcgtatgggattcattaacgcgaaacggcacgggcaagtgcaacgccagcgtgcgcaggctgcagccaaggcaaagcccgcggcactaagacgcacctggcgcacgccataaatacgtgtttccgtttgtgggggtctgggcacgctcctttcagtttcagccgtgacgaaccgcgcgagcgcaccggccggccggcctgcgctctcgcacgcgactggatatgtgggtgtatatcgcacactactacgatcttaggcatgcgcgggtggcagcagaacgcagctagctggccgtgggccgtgggcgcgcgagcgtttatggtcggcccctgccgtgttctcgtgccgggattcagcaggggcgcgggcgccgcagcgggtgtctttttcgttgttcgctctgctggctttggccacgtagcgcgccgggcgtaatccgcaggcgatatatggacgcctcacgcctcctttccctgttcacactggtcaggatccttatttggatatttgtgggacgtacatattcaaatgttgcaaaaacgattatcctattgtttgctaattcgttatttggctctacaaaatatcacataatcttttatttgccaccactcttggtccacgtattagtaagacaatgatcgtaccctggtatttcatctatctttttaatattgacgcatagcgtgatgtttgattatttattttatttaaaagtcataaatattatttattttgttgtaacttgtttaattatcgaataaactctaatattaccttataattttttttgcatatttacactaattaaatgttcgaataagacgaacatttatacgaaaaatcaaaggtgttatatataaaaccacgaggaacgaaaattccattaatttctatatgtgaacgttcacccaaggaacgaaaatttcattaattgagcgctcgtcaatgggtgcgcctagtgcacaaccaatctcacgcgtctgagtccacgcgagtacgcgacagtgccttgcctctcgctgagtatatagtccatctattgtttgccagttggtttcaatcgaattttaaataaataatttcaaaaaagaaaaaataactaaataaaaaattattgtacatagaaatattgtatatgtataaactttatacataaatatatgcattgaaaatttatttatataaagtttattatgtatatgaacttttaatccaaatccaaatctaatttagttgtataaactattaacttatcaaaaaatggaaaaaatgtggcgcaaaaaaaggaaatgtgattcaacacgtgagggataggcatgcgaataagtctttttgcttgacaataagcccaaatggccatccaaggtcatatatgatacatggatccacaagcgtcaaaagtctaagaatactcttataggcgaagaattgaaattgatacctatcgggtcatatatttttctccctctgcatgtccacaattttactacaacaaatcgagtctaaagaaagaagcacccaagccgagagctatgcgtgtaacagttgtgcatgtgaccaaaagtgaaacaaaaatatttaagagtaggactcaactcgcttatgtataccttgaatgctacaattcatgcatacctcatccgttccaaaacataacatattataatctagaatcggatgggaatttagagatggcagtcggcacgggtagtgactacccatacccgtgcccgtgaggtaattcatgcccgcgggcatacccgttactacatgagtacatgacgggcaaggaacactacccatgcccgttgctcgtgggcgccatgtacccgtgggtatgcccgtttacccgtcacaaactcatagttcaacatttcaaccataaatctccacaagcaaagagacattatcatagtttaaagaaagtgtacagttgtactaagttcaacaatacaagcgttacaagtacatcaatacttgatggtggcatttatactaatttgattgagggaccacattgtcagttgatttttgcgggtaaacaggcgaagcgggcatatgtagtgactacccatgcccgagcccgtatgcccgttgggtataggttttgacccaataaaaactcatggggtactaaatagagaacaaacccaactctattagagtttttacccatgggtaaacgggcaaatgggttaaattgccatccctagatgggatatatcctaaaattatgaatctgaatagcaagtctatccacattaatgggtgtgtttgcaagagcaagttctcaacacttctctctcttttttttcgtgcgcacgcttttcaaactgctaaacggtagattttttacaaaaagtttctatacaaaagttgtttaaaaaaatcatattgatccatttttgaaaaaaaaagctaatactcaattaattatacgctaatggaccgctccgtttttcgtgcataggagatgggttcccaacacccaccttcaaacacagagtactaggataagtcacaatcaggttttaaattgttatattatattagatggggcgattaaaatttatgagacatttatcaactcgataaatatgaattttcaactctaaatttagagttgatttttagtttttttttccacaaaatttattattcagactttgtttttatagatcattaaaaacatgtatataacattaaaatttttatatgaaaattatttctcgttcgtgaataaacgaaacgatgggtcgtacgaatgacaactccacctcctgtcatccagcttttccaaacgtactagtacgtcggttacaggccacagcaaattcactgaggagactgacatcagacattaacatctgaaacgattttataagcatggcgacacgtctagaacttcgcgttccactgcagcccctgcaaactgtttttctccgtgaatgtgctgaatggcgtcaatgtcgatcagatagccaaatgaccttgttggacatcacgtacactttgcattaaaaacactaat

SEQ ID NO: 75984 - DNA, 4893 bp, Oryza sativa
tctagtgaactgttgtttcgtattcatgtattagttgtagatctccatgtattgattccacaatgcagacggacgttttaaaaccttactgcattgtgtcatcccgagtagggactagggacctcgtcaatctcctacccaaaaggactaatttgcaactttgctttactttccactacactttgattgacttttaggttttatagcaaccttctggagtaacttttcgcctttaaacccttttgtgttttctccatgtcctctctagctcatccccacagtgtcacagagacaagctcaaaaagactcaaaagcttgggcccgggctagcagctgtgtgcgtagtgtgggaaaggcacgcaggcagcaatgcacgaggagggggactgacactcccactcctcttgccactgccagtcaaaccctaatcaatattcccctgctttgctttttaacccccccatgaatccaagtgtgcaatcaggtaaagagttttttggccactggtgatgggatttggcaaaagatactgtcccttgcatgtcaaagtaaacctccattttgtattgtgccatttgccaaggacattccattatgctacacaagaaagtatttacagatgaatttcgtcagaggttgaacataaactccaaaaatgtaagctttgttcttcacttatgaatgcacatttatttgtacatagaagcatgagaggcaaattaaccaaacaggatttggaatcacatgtactcatgggattaactgtcagcatgggagtagtcactagtcagacagtaaaatgtttggaattttcccgggggactgctctgtgttgagtctgcggcaagaaaggaaatttgcagcagcccgggtccagtcgtgaactgacaatgatcggtccaaggacatggatttaaaattctgtcaaggaaatctcgtcgttttgcttattcgtgaaataagtcaaacggtatatttgcaaatgataagtaatttatgaataaaacttttataatgtattcttagcgatctaaaagcaaagattgaaaaataaacttcgatgataaaacccaaaatcagctataaatttaaggttgaaaattcaaatttaggctgataaatataagcataagcgaaaagatgagacccgatccgttcgtcctataaatactgaatatgacgtaacatccagatttattgtactatgttacatcacatccaattttagattaggttttttgagatggaaggagtagacatctacgttaatagcgcatgtttggaattgttatgtgatgtagagtagtacgagtactcgctttgtcctaaaatataaagaattttaaatggttgagatatattctagaattatgaatatggataaactcgttgttcaattttattttatattttgagatagagggattagtataggagtacatgccgtacgcatcagtattcttcatgacagtgatcatatattcagaccactactagcttacagcatggctgcattacctcacactctcaaagcgtaccaacacaacaaatcaactccattccaacttccataaatgttaatcagatccatggtacaacaaattactactacgggcttaatgaccttcgtcagaaaaggaagtctatactctatagatatcagcatatatacccggtccatacatcaaacgactacgggctgcgtcggcagctttacaatggcctgatctgatcatacttgtccagaaagcctgccccgatcatccatcccatggactgcaccaggggagctacagtacactgcactgtgcatatgcattcagctgcaagcagagcacatcatcatgtacactcagattgggcggtcaaacatcgtttagccctgtgaggctgtgacctagcccatcgaccgtactccgtaggagtaagcaaagccagaactcagaagacagtgcagtgcagcaacgaacaagaaacaaatgaaatgaatcgagaagctacggctgtgtttcctttaaacttcccagctttttcattgcattaaatatttaaacacatgcataaaacattaaatataaataaaaaaaccaattacacagtttacatgtaaattgcgagacgaatcttttaagcctaattacaccatgatttaacaatgtggtgttacagtaaacatttgctaatgatggattaattaggcttaataaattcatctcacagtttacatgtggaatctttaatttgttttgttattagtctatgccgaatacttcgaatgtatgttcgtatacttaaaaaaaattgccacacgaactagaacacggccaagactgacgctgctggctacatccatggattgaaaaattttgttgtgtcacatcgaatatacgaatacacatttgaagtattaaacgtagtagctaataacaaaacaaattacaaatttcatctttaaactgtgagacaaatttattaagcctaattaattcatcattagcaaatgttaatgttactgtagcaccatattgtcagatcataaagcaattaggtttacaagattcgtcttataatttacacgcaatctgtatattagttttttctctaattataatatttcatacatatataacattcgaacatatataacattcgatgcgatcgtgcgaaaaattttgccggcggatctaaacagcccctcgcaggaaaagaagggtcgacacaacctcggaagtcgtgcactcatatctttattattattcgctgctgcggcatggtcagattatgagatgtggttgctataccgcctattcggcggaagctttttcttcatctcctctcctctcctcgccggattcgagttgatggcaacggcattggaatcgcggccgttgattgttccgtcctcttgagcttctcagaaccagcccggtcccgccaccagctcactggaagatggcagggggcatcttctctgacgcaggctgactggtggggtcccggacaatgtagggccacaaggagatgatccagatttgtttaggtattaaatatttttgtcttggactgctgccaccggcagggcccgtggacgttgatgcacaaattggtacgtgcacttacgggtgaaacggtcgcggaaattcccgatcgacagagcgcagtttggtataagggtaccctttccgaccataccatttttaagttatctataattcttttttaataactttctacatcgaattaatattgacactgagtagtttgaatgaataatatggtctattaatgactgatcgagcgtcgttttcgaagatatgctaccaattccgatcgtttttcacgtctatgtacaccacaggcctagttacacacttagactatgttcggcacctgtgttgggaaaacatctattatgcacggagcagtctattagtacgtgattaattaagttttagcttttttaacaaatggatcaatatgaattttttaagcaactttcgtatagaaactttttgcaaaaaaaacgcacccgtagctgtttgaaaagtgtgcgtgcaaacacgagggagaggagttgggaactatggctgccgaacacaaccttacacttaccgtgaaatgaaaaagataaaagaataagggtttgttcactttgatgtcaaaaaatgagagagaatctactctataccaccgagtttgttcgagttcaatgatttactatcgatattgtatctttctataacatactggcgactttaaccattgttctacgagatgtcttgggctggaccttcttttcaaaaacacccaaaatatctttagagacatacaagataaacaatcgatttatctcattagaagttttaaaatagcatatgggtcaggatggcatatctgaaatttagcaaaattataatggcatggttacaattttccaaaaaaaatactatgaaaatttttatgtgccctccttacacaatatggaagtttgtatataggttttaattttttttccggtatatttagtttttctttacgtgtatataagtgagaattttcttatacaagagatgatagcataaaaatatcttatgtagtgtgtgaaagatgatttatattaaaaacaataataataaagtatttttatataccatatagtaaaaaagaatttgaaaacatgaggttaagactttatggtaaaaatcatctaaatatggaggaattttcattttcatatcatatgaattttcatttgcattcaatttctcccgattttttttccaaaaaatccttaaatccaaaggatccgttatcggggatcagcttccatacacgaattggttttcggtggtccatcgccttaatttgtatgcgtatatctatatatggtatgccatatttagtacattaaaaagctccttcctctaacttagaaaagatatcgcacggtagattcgtgacaagggaggatagcaatttatgaccaaatatcatagtagtatcatttattgttatctaaatattttggctaagaggtgcttttttttttattctcacacacaccatgatgttaatttgaatgcctcaatcgtttgtaaaacaactatatatttttttagaagcgcctccgatatatagcaaatcatgttcttttttcacataactttaaatttagaaaacagtaaagcatgtttaagcgtttatttctatgaaagaactagtcctcctcaacataaaaccacccataatagtttatcatgctttgatctactccatccgtctcaaaatatagctacttataatgttcaaaatttatttcaaatatatcaactttatgtacttacttactctctaaagtaattataattattttttaatctcaaacttagtttc

SEQ ID NO: 75985 - DNA, 17123 bp, Oryza sativa
cgccgccgccccttcccctgtcctcctcccctctctacaaatacccctcccctctctccattcttccccaccccatctcacccttcctcccctctcccctctccactgcgccgccgttcccgtgccgccgcgccgccgttcccgcgccgccgtgccgtcactcctgtgccaccgtgccgccgctgctgtgccaccgtacgccaccgtcgccaccgccgtcgtcgccactgccaccgtcggtgagccgccctccttccccccctctcgcgtccaccgccgccaccgctcgggtaggagggagagccgagagagagagaaagagagaaggagccgagagagagagaggaaaagagagccgagagggagaggaagagagaaaagaaagaaaaagaaaagaagagaaaagaaaaaaagggagaaaaagaaaaaggaaaaataaatagaaagatttggaagaaaattagggaggttaatagtttaggaaatttaaaataattagaatttaattacagaataatcatggtcctagaattgcaaaatttaattattcttggtaatttctaaaagaaatcagttcacagtagtaatttagatataattaacaattagatgaagttttatagactattatagatcatttctggataatctttataagtaatcgattcacggtagaaattcggatttaatcgctaggaattttagacgtatattatatttaatcgtttagtcatagactaaattaaaacgtataatattataagataattttaggattacgtcagatatttagctcgtaatagaaatttctagcctattatatggatataatgctcgggaagagtaaattaaaaacttatgacaacaaaataattatacccgcaaaatagtttaaatcgaaattgggtttgccgtagttcgcagatagtaaagttaataaaaaggaatcgactttcgcattcgactttcatttggatttatttggatttttatttgaattctaaccgaattcaaatcaaattttgcacgtaactatagagcccgagggagttgcggatccaagcgaaggccaagacccgcaagactttgagcaaggcaagtcatcactattccttgaacatgttgatcccaattgcgaaattgttttatttacaaataaaattgcatgcaataatgaacatcccacttgtgattatgccatgccttgattattgtttacccttaaatctttgtaaccatgtttacgtatgagtcccgagtcaactatgacaattgcttagaaatgctattctagaatcatgcatactcatatttatcaaatgctatatgcttgggcaattacctttgggaaggtaattgagatgcggcatgtggagatatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatggagttaagcatgaaacgacccccgtacagccgcacttcttgtatgggtatagacctagcggattagatagccgagtggaggcagtatccctgcatagatggttcacccttgagtgaggcaggtgcgctacggtgggacagccgttgaggtagggccgagaggcgtgccctacatcggtgtcgccattggtaggactgccatgagtgtgtgtgagagagaacttaacttgaaccataatttaatatgtgtgagacttctctttcccgggagcgccagaactcctctcactgctagaaacatggacgcctagagtgcatgaggattgaagttcatggagcgggtactgccaatgcgaggttatcgaaaagctttgccgtgacgcgtctcatgtgttgggacgaggctcatgtgttgggcagtcgcggagtgtgggtaaagtgtatatccactgcagtgtgagtaaaccaaatctattcgaatagccgtgctcgcggttattgagcaccgggacatgtattacacttggctagactctaaattcttaacttgtgggggatgggatactgcatgatgaattttatgctgatggagtcacatcccgaaaggagggaaggtggacatcctcagaaaaccgtgacgattcaatgacgggaagctatccttgggatcacaatggatggtggacagaaccgtcattgtttaatatgaacactggtattaaaacttgatcagtctatgctaggtcttaggcttgtgaaaagaattacaaaacttgctttgcgcaaaagaaccatagccatcctttgaattcctctgtcatgtgcaccattgctgtggtggcttgctaagtacggttggtactcacccttgcaaatataaaattaatcagaagcgggagatgaagcctcggaggatccctatgcctactaccaggagggagatgaagatgatggcgctcagtaggtcttagtacggtcgttgcctgtggcaatggcatgccgctacctgaattccgctgccttatctatttctgcttttggatgtattccggaccgcacagtccgatgatttaagactgtgcctgcgggcttatgatgtaataattcgtactagactctcgtgtatgtgcacttgatatttcagctatgagtttgtgtgtaccagactacttgatccagggaaatggtactgtttacacgattgattcctgttataaaaacgggggtccacagtctggaattccaaggactcctaaaatttttggtctacagactgtaccccaatttaccaacctacttcccggatttgttttgtctgggtcttctcccttccataagaaggatctgcggtaacgatctattctgctgattacccatttgggagcttgaagggcagttagatgaaaggtcggcaatgcactcaacactgattgcacaagaattcttctcccttctgacatgaagtagcgttctttccagccagggagacgcgatccaatcttttcaattagaggcaagaaatccactttcctaagctttcgaaaatgtaaaggtaagcctaggtagcggcaggggaaggatttcaaagttccagggaaaggagtaatgacatgtgtcaagtcggtggtgtcgcaacggataggatagatttcagtcttgttcaggtttgtgtggaggcctaaagcttgggcaaataaattaagaacccttttaactgcatcaatctcaatagggtcgggcttgacaaacaaagcgacgtcatcagcgtatagagagcatcgaaacctgctaaaacgccctccaattggagtgagcagggaggcctcttccgcaacttgaaagagtttgtgcaggggctccatagcgagatttcatagtgcacatttgacatactgagagttcctgtgtgtgccccaatgcttctgtacattcttcaggacagtgaattccaatgcacatgaataatacttgatgagtcatgttatcatcctcgaacgacatgttcaccaagcatatgccatacatgctcgtttcgtcttattagaaaaactagtacagatatgcaaaatacaagtcatgcttaatttacattttaattaataaaacaagtcacgataaaataaatgatgcttatggttttggttagaaaattttccttttaccactaatagcaaccatattctcattttcaccatccaaaactttgcactcctcttttatcattttttcattggggtgttgtttacacccaaatttggcacctagggataaaatagggaaaattgccaaagtttggaagtctgccggttttcctctatgagggctggtctgaccgctgtgtataggccggtcagaccggcggtgtgtggccggtctgaccggcagactccgagtccgggtctgttttcgtcgggtcgggtttccttgctcgggaaggcatgtttcgggtttcctttggattctatcccgagttgaacatggaggagggcctgtagagggcaagaccaacccctatataagggggtaaggccaagaccaacccctatataagggggtaaggccagttcattgtaacaaccaatctacaatcaatcaatcgaatcgtttttcatattgcttttagttttctcttattttgtccatctttatcgatttgcgccgtaaatcgtccgccgccgctgcgagagtgtgacacctctttgtaggtttgtcctgaaaaccttccgttttgcccacgagacaggtagttatctagaataggctccgctagccggtttagttatcaaaacccatattggtttagcttttgctagattgaggtggttggtgactctaggatcaccgcaaggcgtttaggtgctgcgatcgtgcttgtcaacttgtcacaaaaagttgccaacatgtgcattttaattttattgcaatgaaatcaatggcagttaacctctgatttgaatactaaaagaccattatgtcctttagatgttcctaaacaaaacaacacttaaaattctagcaaacaccataaaatatcagaaaaataaaccgtggatacttaaatatattaaacattcagaaaaatttaggcaggggaattaagtagttttatttttttcgataaaatgcaccatgggttctgaataatttggttcttaaaatgttcctcaaaataagtatatttgggaattatctggttttatttgttggaaaaatgcaccacggcctagaataatttggttcttaaaagttccacaacataagaataacatggaaattatgtacatgcccataaataatcttgaagaatattgggagcttacgattcttatatgcatggatttggaaatatttttcatctaaatatttcatttaagctactgtagaaaccttttgaaatttgcagtaagttttcaaggagtggcaaaagagtgtaaaatcttgatggtgagaaagggagaatattgtttcaaggaatgacaaaaataattttttcctatttttctaataaaatgaatggtcgaatgcatgtccaaaagttaaagcatcatatttttaaaaacagaggtagtctatatggttttagtcaataaacacatatattattccaattcacctcttcaatgcatagagtagagccatagagtacaacacaagtactagtggttcaatacttggggatgctcaattattattcggtcagagatcatatattagcaatgagcatggttgcatctcaccatttgcttctatcgttcctaggtatcagtttcatcatgctcagagactaactatttctcgcgccggtggatgtgctctctccttcatgtaaccccacaatatccaaaattgggctcgtggatacaaacagaaatgctgcgagacaaacactggacaagaaaatatctgtgtcttatgaacaatcacgaccaatttcacaaaataggagagcaactggagcaaagcacagcgaacagttacgtccatgctgtcgggtgaggaggcaatcatcttctcattgtgattggagtgtggtctacatcatttgatggctcaaaaacagcatacacttgattcaacaccttcttaagagtttgcttggaccttcttcctttgtacgtacttttaggcttatcatcattgaatttgtctctattgtcttatttcttggctctcccaagcttgggtcagtacgaatggatgtgatcaagctctctatactcaaagcaatgaactcaacctctgctttttctaaacctgacattgttcatagctcgagacaacttgttaatagccaaagccaagtcctcctccttgaattgctcaagttgatcatccgacatgatattaatagtagaaagagtagtagaatttgatggagtactaatatccaaagaagtcgaaggagaaaccaaaacactagatttagaattaactttacaagaaagaatattcaagtccagtgtccaaacccaccacctggtcaagtgaagcccagtctgttgcgtggaaccaccctgacgacacttttgcagagaggaccctatcttatatcgcagccattaatattgatcataacgttttgtactagagaggaccatgttttgatggaaatttagcagaaaaagacttactgtggatcgtaaaggactagggatgggaagcctagttcaattggaaatgttttgctctggagagaaaaacacgatgttgtttgcctgttgcattatcaaccagtgattgattggaaattggaaatgtttttgattttgttcaggagtatttggtctttaagtaagactgctttttctaatgacaaatcgattaactctaatccattttaaatatttttgttctatttaacgagtatatatcttaatggtgcacagtctagcactaccaatccacagtagtgctcatagcccaaattggtacacttgttttgtttggaaatttcgaaatgagacatgtagaactgtagagtacaagtactgagtggtgcaatacttgcagttgcaggtgcttaattacaacatagaatccttttggtcagagatcgtaaatgcatctatcatatatgaaaaattgatcatggtttatgcatctcactatttgcttctatcattcctaggttgatcacttccatataattcttggtgacaaactattatttgctccgatggatgtaaaaaacctgtaggcatcataagcattgggaggtcaatctgtgcgatgggtcactctgagggatgcctgccacaccaaaattgggcccatgtttacggttgagcaaaaatgctctcaaacagacactgtacaagcaatggcagaatcagcgaggaaaatcagcaaagattcaacaggatggaagagcacctggtgcaaagtgggatccacaactatatcatcaacctaggcttcttgatttagatcagcttggtgctctctaagaaactattagagtttgtgtcaaatatgtgtatgtagtcggttatagtttaggacttggagttgtactaggtataggattatagtaagagtcagactctatcctaggatctctcataaatagagaggcatgcctgctgtaaccgcatggcgacttagcatagcgagagggagcggctgccggcggcgaccggccgtgagtcgttgtaactctaatacactgtgtatgctggatcggggagaagcgcccgtaatcagtgccccggagatgtaggcctcggctgcactccgttatcaaatatcgtgcctcggtgtcgtcttcatgtttagatctcctatggtgtttcttccgcgttttgtttctaatgtgatttcggggccggttttataacagaaacttcctaatcatctgaagaaactttgatcagtgatctgctgtctatcatatataaaaagggatttatctcagtgaaaaaaattagtgtaaatttccctcagggaacaattttatatgacttttacaacacattattttagtcagtaagcttatgtcttcttttacaccgcaatttacagggaagaactatagagatagagtacaaaaagatgcagtggttcaatatttgcagcttctccattgctggtttgaatctttttagtaactcaattcttaggtttccatgtctaacgtttgactgttcatcttatttaaaaaaaatatgaaaaaaatttaaaaagataagtcatgcataaagtattattcatgttttatcatctaacaataatgaaaatactaatcataaaaaaatttcatataagacggacggtcaaacggtctttttgggatagagggagtacattctaaaccctgtggaagagaacatatatgagctatagtgagcatttttgtatatgttaacatagttttaagacattcagtaaagggacctatattgacattcagcttttttttatctttaaaatctgatggatgtaagaacctctgtagcaagtcacatttctagtaatggaaatggagtcatccttgcccttgctctaaaaaaaaaaagaggtgatcaagacacctaattacttgacatgcttccgtgaccgactatctgcgtcgtcagaaaagtgctatatcatgcaatttaatgtaacttgtaattgatgcagagaactatctcctatgacttccatgagagagagttccagacttccaatcaattagcttacgctttatgttccaattttttgtgaattctataatgaaattggggattcaacaactgattgatctacccctaaaatataaagggacccaaatataaatgtgtacaaaagagatgcaaaaatactaaactacccctaatatcttaacacccccactcaaatacaatgtgtatacaatcatattgcatttggagtgtaaactaaacatgagaacacaaactaaatattagcctatctccaaagtcttgatgatgtcgtcgaagtgtgccaattcttggatgataaagaagaaaagatgtatccccttctcaatgaagcgcaccttggagccttcacaaactgtttttcggccctcggtaccttgaagccttcacgaaccgttcttcggctcttcattgattcgaagatgttgttgatgatgatgatgacaatggaccttcacaaactgttcttcggaccttcacggattgatgatgatgccaactttgatgggaagctagtgatgtgatgaaccaactccgatggggagttggtgatgatgatgcgatgatgatgaggaccagctccgacagtgagctagagaagtgatagaataccatgacctcgatgaattgaaaatatgtaatggacttggatggaatgtagatgactaactaccaaaagacgctagcaaatgacataggatgtgatattagcagcagaatagatgctatagcactacaacactgtggcagatggcagcgacaagcaagcacaataactgaatgtctatgtgatggagcacaagctcgaagacatgaaaacaaatcatcaattttgacagattctgcaactaaaattaagtggtaatcaatggagctaacatagcaggagattagtactaaacgaactactcaagacgtacaaaaggttgtgacattgccacgaagaagttggcgactgtgattggaatgcagcagctgagcagcagattagcaacaaagagctatcggtgatgacggattgcacaaaaggggaaaggggaacaggaccaagataggaaaaattaaatgatccatagatgggtttctagctttctgctgctttgctcacgaaggactctcccgaagcctcatgcggctgggcgacaagcagacaaccccaacggccacgctgctgaggatgacgaccagcgtagttggggacgacgaaccgcgtgacggagaacgtccatgtggacaaccaacgacaagcttaccccagcaatggagatgagcagcgacgacctcggtgcaaggacgcccggccaaaactgcagccgttgcggacgacggcggcggcttgccgccgatggctaggacaagtcccgtgacctgaagaacggtggggacgagcggcgtggataagcgacgcgacgggcgtggcagcgagagtggatggtggagaagcgggcacggcgccgcgacggacggcggctgcgaccggcgaacgggaacgcggtgacggcgatgagccgcgcgcgggcttgctgctaggagacgaagatgacgactgactgctgctgctggatgaagacgccgagcgatggtggacgaggatgaatgacgacaacgatggctcgccggcgatttggcagctagggtttggggagaggctctgatatcatgtgaattctagaatgaaattggggattcaacaactcattgatctacccctaaaggggaaatataaatgtgtacaaaagagatgcgaaaatactaaactacccctaatatcttaactttttttttcttctcacactccatacacaaagatagtcatttctagttgatgcagagactaggggatatacttccattggctaaaaacgaattatacttagtttgcaacctagatattaaaggccagctagagccataacctagtccataaattggccatggcccaattatgccctttttggagcagatcaccttgaaacagcactcaggtgtactaccaaattataaatcttgagcaattagcagcactataaaaaggtgaacctacacttctcgatcaaaaggatcagacgaacactttgctccctcgaggcctcgattcttcagcattacagtttccaatgccaaggtatcatcctactttgtcctgtccatataattgaattggtcatggctcaattgtgcccatattattagttttgcacgtatctgctctcgagcacacaatgaaaggataaggaagagctatgaaggatcatcaatgaagctcttcacagatgaaccacatgtacatcaccaattcaccaatatattctatctgaaaccgtaggcttgggatgcatcagaaactactccatcagtttgaaagcaagggaaggtattcttggctcgttctgtcccagaagccaagctttggatgggagaagagcctgcatgaaaagttctgcaagatggaccaaatggaaaaactgtctgccagagtgatcgtatgtaaatagaatcgcttcaggtcatagtcgggtaacgcgcatcttcgatatcttctgtaccttgtcaccttgcgcatttctcacatttgggatcattgagtgtccattgtatgtatcgatcgatattccagtgatcttcagtacgcctgcgacaaagctaatcacagccatcattaggatgttcttctcgcaccattggacgtctagagagttcggggctgtgcttatctcttaattggcagggcacttacagggtttacaatttcgaaatggttttttttttgctagggcgtccgatatttcgggaattttggtattttttgccaaaattatttgaatatttgacaaattttgaatgaattttaataaactttgaccaaattcacaaaaaaatgggggaaaaacggatgttcagtaaacaatttaatttgcataatgaacaaatgcatgtagttaagtgcaaattgcagaacacaaccagctgctattacatacatcatcaattcttgatatccactccccacaaaaaaaaaattcttgatatccacaattaaagatggccatgcttatcattaattgttggtgcaatacatagaccaaatgatatactcccattatctaaaaataaatcacacttcatttgcacccttgtccattgtccataaatcaacaatggccagattgtgtccttcgtagtactagtagtagacaatttttacttcttggataattaaggacgattatatgactaaggaatcattgttgagctgtatgtgcctcaccaattcatcacaagtctgtctgaaatcgtaggcttgggaggccctgggaactcctgcatgagccagatcagtagtttgaggaattcttggctcctcctgtcctgactgaaccgactaccacgcacaagaatctacaagaaaatttccagaaaacaccatggatgcaaacagtggtttgtatgatgtgcaaaattaacccctgaaggcttcatcactcgatttctggatgactaggtagccatcggctcctgcccatttcagggatcaagagttcctgtgcgtccaatgtgcatgttagttggtcaggaaagcaagtgtccaatcctgttacagttgttcagtacatgtgatacactgataacatttttttaagataatgatacaccgataacatatgcttgtaaaagtgcaaaacacaacttggtgtagttacttacatcatgaacatgcaatttgtcaattaaaaccagatttgacattcaggaatgcaagtgtccaatcaagtaacaattaaccagatggatcaatcatggcatgcatataatgcaagccacagggctactaacacattacacatgtcaatcacacgaataggtgaaacaaatgtaatttattttcacaaaaaatgaaacatgcaaggaattaataatagctaataagacacacatataactttgtccaatattgtgtccctggctactagttgtatgtttacgctctggtgcacgcaatgggagtatgacgaagatcttctcatgaaaacgaccatagatgaaactcttcacacagataaactgcagccaattcatcggtcaaaatcgtagtcttggaaggcaccgggaactactgcttgggcctgaacaatgcatctggcattcttgcttccttctgtcctgtttagttctggatcaacgggataagaaccagaaggtctccagttgatgcactggatgtggaaacaggttgccacagtgggtgtggcgaaagcttctgcggttctgccccagttccgtgccaacctgcatatccaattctgcagttctcatcgtgcaaatttcacacattgagagttcctgccaatgctcctgtacgttcttcagggcagtgatccagttttgatgcacgtgatgagccgtgccatcttctctaatgacatgttcaccaagtatgcccaacgctctcatttcgtcttatgcaaaagcactagtatagatattaaaatacaagtcatgcttaattgacattctaattaatgataaaacaagtcacaataaaataaatgatggttatggttttgtatagtaatttttccttttgcattgccaataattgcaaccgtattcaccatccaaaatttgcatgcacttctctcttttaccacttttctgttaagttaggtgcattgttgttttgctattgtcatcaaagcagtggcagttgacctttaacatgaatactaaaagatcattatgccctttagatgttcctaagcaaagcgacacttaaaattttagcaaataccataaaatatctgaaaaaaataaactgcagatacttaaatatattaaacattcagaaaaaaaataggcaggggaattatgattaatagtttgttctttgattatcattttgcccacgcggtttggtctttaatcaagtttgcttcgaatattagtttacctaatagtacaactcatatgtttgggcattggataagaagacaaccgcacaatttgagatctttggtcttattaaggacaactaccactatttggtctatttggctttgcagaaatgatgtggtttttcaaaggaaaaacatatcttctcctttacaggttattttttttattacacattggctctgctcatgggctatccttcagaaggtcaatttgcggggtactatcattgcggcttgtcaacaattggagctagtggccatggagttttctaccccggcacatgggtggcgttctaggctacggttagagggctcctgaagttctttttgttccttctattttggatgatgagtttatcttttgtttcttttttgttggctgtgtgcactctttgcgtgcaaaagccggaggtgctctcagaataattgtatcacttgatgaaatttactgagatcaataatgcttccattatcttaaaaaaagaagaggacaagtactgagtggtgcaatacttgcagttgcaggtgtttaattacaacattgaatctttttggttagagattgtaaatgcatcgatcatatatgaacaattgatcatagtttatgcattctcactattggcttctatcattcctaggttgatcactttcatataatgcttggagacaaactatttttttgctctgatggatgtaaaaaccctgtaggcatggtaagcattgggaggtcagtctgtgcaactggatttttcatattttggtccttttaaaaaacttatttcgcaaatagacccctagaaaaacttatcccaaaaatagtccttttgggggcgccagagtggacggtgccagcctctctggcgccgtccccctgccgacgtggcggggcgatgctgaggtggctagggagtgcgccagagtggctggcgcctccccccccccccggaaatttttttatttttgttttatttgtttgatatttttttcacgcttagggacacacaagaaccaaccatagaaaaattgaactcaaatggacgtaatatgtgacctgtagaatttttcctctcctctcctctctctccgaactagtgcaaaggagagatgtgcaacttttttatttttatttaatttttttatatttttttcacacttaggaactcacaggaatcaaccatgtaaaaaataaactcaaacggacgaaatatgtggcatgtggaattttccaaagttctaccgaaaaacttctctcctcgaaaacacaatcttgcaagtggaatttggaggttttaatatttctgaacccggcagagcgggggagaattggatataactttttctgtagatgtccgtgcatatattatttgcctgattccaagtccgtatgagaaagttacgcctattttaatagatgacatattttgttcgtttgagtttattttttatacggttggttcctatgttctcctaagtgtgaaaaaaatatcaaaaaaatgaaataaaaataaaaaaaattgcatctctatatactgtttaacttatatatgtcatttcatgtggttatattttgaattatattaagtaatttcatatagtggtagagtgcattatgtttaacatgctgatcaaagggttttactaaaggaattatggtctaattttagtgaaggtgcaaagtagactaagtggtatgctagctattttcagacttagctaagtggtagttcgagtttaaattttttttgtggttggttgtatcgtgatcctaagtgtgaaaaaacatccgaaaaaataaaataaaaatgacaccgttgcaactccatatagagaaacaggaatggaggcggcggcgctagcatggctggcgccctcctcctgccacgtcggttcgcgtgcgccacagtggcagaaggacggcgccagcctctctggcgccgtcccgttggatgacggcgccagccactctggcgccaaaaaaggaccatttctgggataagttttttcaggggtctagttgtgaaataagtttttcaaaaggaccaaaatgtgaaaaatccaggtctgtgcaactggtcactctgagagatacctgtgacaccaaaattgggcgtgtggttcggattgagcagaaatgctctcaaacagatactgtacaagcaatctcagaatcagtaaggaaaatcagcaatgattcaactggatggaaaagcatctggcccaaagcgggatgcatgattaaattatcttggtgctctctaagaatttctaatcatctgaagaacttcgatcagtgatctgttgtctatcacatacaaaaagggatatcccagtgcaaaaaattagtgtaaatttccctcaaagagcaattttatgacttgtacaagacattattttagtcagtaagcttatgtcttcttttacactgcaatttacaaggaagagctatagagacagagtactgaaagatgcagtggttcaatatttgcagcttctcaattactggtttgaatcttttaagtattggattctaaatcctgcggaagagaacatatatgagctatattgagcatttttgtgtatgtcagcatactgttaagacattcagtataggggcctatgctgtcatgatcaatgggccttgtaagggacattgtgtgtgttgggccagctattgggccatctctataagaaccgagccaacagcacgggtgtgttataaaccctgtgtggttggtgaagtggggtatcgaagaagagaaatgataacaaactactaccaacctctctgctcctgaattctccttcttcctcctctgttcttccatgtttcctgtgacgattccccaaatctagagccacgaaccctaggatcgtcacattttggtatctttcgatctggcgcgcaagaaatcccagcccaccttgacggagaggatgtcgattgctgaaggagaagttgtcaatctgaaccagaaggtggtggatctcagcacgaacctcgaccgcatcctgggatcgctaaagggtgtggaggcttggattccaagcgtcgacgctggaatgcaaggcctccggcggtcggtggaaggaatcaaggcgcgggtcatcaagctggaggcccagtcgtcgacggcgacgcctccgccaaatgggcaccgcgtggacaacaagtaccagggtgaagcgactgcggcagagtctgcccaggagcgaaccctggtcaagagtaagatccaaatccctcaatctgcagttaatttcgaagttggggagagttcagagtgggggattgggaattctcaatttggaacacaggggcctagattacctaaaactgaattccctaagtttgatggagataaccctaagttgtggaagaaaaaatctgaaaaatactttgacatgtatcaagttccttatgcaacttgggcctcctttgctacccttcacttcgtaggaaatgctgctctgtggttacaaacttatgaggaattacatgctgtagaaagttggtcggagttgtgtgtagcagttaatgggaagtttggtagggataggtatcaacaattcttagagaaacttgataacttgaaacaagagggaactatagaggagtattacagtaggttcgaggagttgatgcataaggtactggtgtataataggggttatgatgagaccttctttgtgactaagttccttgggggtttaaaaactgagattaaggcagcaattaagctgcacaggcctggtactgttgatgctgcgttgtctcttgctaaaacgcaggaagagctattgatggaggtgaatttgaaggcatatcacaagaccactataaaggagtcgttcaagaataatttcaaggtgccaagtctagctaagggcatccttggccctccacctgatgagatcaagaaaactgaagaaaggcctaaatgggaagaacaatatgactcattgaatgcagctagaagagcta

SEQ ID NO: 75986 - DNA, 655 bp, Oryza sativa
cgtccggtcggagtatgtgcaatgtttcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaactacgctaggaatcacctcacatccgcccatgaccgtgggcacggctgttcgagcagtttaataacctctgcagagggggtacactttacccacacgacattactaacccggatcatccaacccgtgcagaacggccacgactagagaccttaaggctttcatgacaaggcatttcgaaagtcgacacaggttcaccatatgccaacgagaggggtcccagaccaacaccagattaggtcccagaccatactgtgccaggaagcccaggggtcctccccgacaccaccccggtgaatccacatgtctcttagcatcatggctcctccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttggaaattcat

SEQ ID NO: 75987 - DNA, 4983 bp, Oryza sativa
gttcccgctgcagtttagtcaaggcttagctccaggtatcttttgtttccgctgcatttttgtaagacttttatgatgtttgtaagacgtggatctgaatgtcaacattgtcgtttgtgtaccccggctggtcctggacggggattttaatgcacattctgcttggaattctattcgggaatttctgggcgtgacaggtgatggacactgggcttggacaaagggagtgtatgtggactttgtttgtcttacttatcaggccgaggaggagggtggctactgggccaagcccaagagcaagagagagggggcggctgctgactgggcgtcggctgacttggtcaagtggggccgacggctgaggtggcgccaacgtggacgtcacgtcggatggggaagggagaggaggccgggcggctcatcggacggctcacggcgtgcggcgggatccggcgaacggcggcaagccggaggggcggctagctctggcggcaggaagaggagaagggaaactcattccacggctcggatcgggaagacgacgcgcgacgacggccggcggcggcggccaatctcgccgacacgccaacgtggccgcacgcgagaagagcgaagggcacgcgggctcgggcttcgccgaaccggtatggggttgcgacgcgcacgcggtgacgcgggacccgatggtcaccggcgacgcacgcgcggtggcgttatgcggcggcggaaggggcgacacggcgcggaggcaaaggagaaggtcggcggcctagggacagtcagggggagctcaaggggatctccgggagcgtggcggcgagaggaatcggcacgagaggtgccgacgacggtcgattgcggcggcggcaatcaccggcgagcaaaaggggaaaacacaacgagacgacgaggattcgattcaaaggggtgggagcatctccggggttcaaggaatccgtttccggtgtcggatggggcggagaagcactgaggagggccggcgacgagcagcggcctccgggagcggacggtaatggcggtgaggccatgccgggcgacggcagtgctagggaatggtttggggaggtcctagggagctcaaggacagtgttggcgagggtggtcgacgagctggggcccgacgacggcgcgcgactgcgcgcggcggcggaaacagagcaacggcgaggcgcgcggcgcatcgtgcggcaggctatggcgtgcggcggcgggcgcggcatagcgagcggtaggaggaaagggttcggcggggagctcaccgacaagaagaagcggcgtcggcggatcggagggagtcatggtgaggtggtcgcgacggtgggacggaacggcaccgggtgggcgcggccggggaggaagagaggagaggtggcgcccggagctcctcgtcacgcgcccacgcacgcaccggttcctccggtgctcggcggtggacggcgacgacgagatcgagtcgagcggcaacagggcggcgacggttgttcggctacaatggcgcgggggggggcgaaaacgagagagatggaggggaggggctcggctgtggttttataggcgcgggatgtggagcttcgaggggaaggaaccgagcacgggcgatcaaggagaggcggtggcggactcgcggtcaagttgtgacagaggcggtcacgggtggcaaaggaggtgacggtgtggatgcgttgggtggcgaaggcggtggatcgagcggcggaaaatcgaaccgcgggagcgggaggattagcgcgggctggcgcggtcaaggtgggggtggcgagctggcgctggcgtctgcgtctctgcctccgagcgctagcggccaaggagtggaggcatggcgtcgttgcttgggagggaaaaagagagggaggatggtggaaagggggggctttaccatgccggtttgggaaaaaggaggtgggagagggagaggagagcgcgtgaggcagagagacgtgctgcctccacgtcttggacgcacgcgcgcacagggtgggggcgagcggcagggcggcatgggcggccgtgcggcgcaggcggccagggctgatgcggcggcgaccgggcggtctgccacgcgtgggcgagcgcgggaaagagcgaaggcggtggcgggttttgggcggcgacggcgggaatcggcgccgggaggggagagagcagagagagagagagcgaagacgagagagagaaagaacgagagagcgagagagctctctctcggctcacatgcgtgcaacgcacgtgcgaggggggttaagatgatgggctgtgaggggagatgggccgggggagaaaacggcccacaaaaatccgagggaggcaaaatagactttttcggaggggattgattcgaagagaatttgaacttggaatttgacttagattttggaattgggatctcgatgagaggaaggagtagacggaggattcaagatggggttttggatattttggatctggggaagtatttggcgatgattcaaagagagggatagaatttcagagtttgatttggagacttgagtcggaagaggaatttcgagggggcaaatttgtgatggtgacgagagggatcaaggacggatttgaattgagatcttggcacaacttagactcgcacacaaagaacgaaaattttcgcaattaggatttttgccgaattagtttttaacgcctcacgaaaagcggagcgttacaactttcaacttttccgtcacatcaaatgtttggatacatgtatggagcatcaaatgtggatgaaaaaaaacaattgcacagtccgactgtaaattgtgagacgaatcttttgagcctaattacactataatttaacaatgtgatactacagtaaacatttgctaatgaaaggttaattaggcttaataaatttgtctcgcagtttacaggcggaatatgtaatttgttttgttattagtttacgtttaatacttcaaatgtgtgtccatctacttaaaaaaaatttggcacatgaactaaacacagccctagaacaccaccgtaaaaacatagattttcatctatggttgattgttcggactacatataactgttatttctctcaataggttataagagttgtatgttgttcttatcttccttaaaccaggaaagtgggatagcgagatcttcgaaatcggtggctgatacttgttgattgaattttgctcccatcaccactaccgattgacgtcaaaccaaaggaaaggggaatattacatcaaagagtaaatgagttataaataagtcattcgtccagaacttgccaaaaccatgccagcaaacctgatacaataaacacactgccaaggaacctccaatcaatgtcttcaagaagatggctagaacgtcattgtcgctattccgaacatctgtaacaacattttcacttggagatttcacttgagacacggtaaagcgagggggcgtcgtgacattgcccccaataaggtaagtagcgtttaaaggtgtcaccgatttctatgcaaatgcacgtcaccaacagaatcaccaacgacctcttgcctcgcttgcccaccaccaccctagcgctctcctgcctcgccatgccaccacgcaccacctgccaagaggcacggtgacgagacaggacatgccacagccattacccattgctgcctttcgaggaacaccggaattcggcgaccctagtgcgacaacgcatcagtggtatatctggcatgcgataacgatgatgacgtatcaccggagcaccacacgtgtatgttgccatcattgaacaatgcacaaggaagcctgcacgctagccatgtcgttgtcaccgttttggacgctgaaaacagatcccaggtatcgccaggtgttggatcccgccaagaagacctcgctgctgcttttctcatggggcatctccgacacttccttccaacagcagagagaagagacccactacggtgctttctactggtagtataaagcaatcaaaatcattgatcttatttgatcaaagggttcagatctatttatactaccaccctagttagttagcggtagtagaaacgtggagggacattattgtcaaaaaaaaaaagtgcgggggtataatcgacatttagcagtggctaaactttgtcttcttctttatttttggctttttcgatgaaatatgaatgatgccagcacaatggatgactacatattgatctagccaaggataaacataaatgaaaaatttacctctaatcattgtattagtaaattactgatttacctttaataacgaactgtttggattattttctactggtagtatgaaagcactggcgtatcgcttcggagagaaagatctctcgactttatttcgcctctcactgaccttagagcaaggtgtccacgtcaaagtttcactagtgcagataacaaactgtaatgggagtaacagttcactttgttgcaaaacagcgtgcaaattcttctcgccaccttatcaatgcagaacatggatgctactccaccagggaaatgtgctaatggttcacttgatgaagtattgaaccaaagaaaaaacaatgaaaataaaaaagcaaaactagtttagacaagacgcaggaccaagatactttatgtttagtcttactggggcatcttttgttctctatatattttttaaaatatagccatatatagaatttcagtgttgtaaaaatcagaatatatgggttgtatgggtaaggcaccggcacacgattaatcttgatgcagacgacacataatccttcacaaccacaagccctcgcttgtctgattcatcttcaagaagcaaggtaaagggccgtctcagtttggtcctgtagaagattgagaattattatttttcgaacgaatgaaattgagaattaagcggcatatataaggaactacgatcgctaatcgatcgcttaatcagggcaggtgataaat

SEQ ID NO: 75988 - DNA, 5574 bp, Oryza sativa
atgcaaatatgttgttaaggtattcctagaaacataggtgaaactcaacccaatgtatgacacaatcagaagatccaatataaaaatttctaggaggatattatgggaattaaaggcacctctctaaaaatcaagatatttatatggttccttgaaaagaaagtgatcttagcaaatcctatcttcgtatagagttggtacctactaagaagcatttactcctataaaacaagacatgcaagaagccacatcatcaacaatttaagccattggatcgcattagtatagagttataagccgttggatcaagaagctagctactcatccatctaaattaatcattgattactcattcattcacctccttttagctcataatcacgcgtgacattgttatccattctgcacatccaaatcctcaaagatgataataatattttttttgttctaaatacaactccaattattacataagatgtgagctttattttgttataaacaattagataacatacaataattaggtatcattaatccaaactcatttttgaaacatgcttgagatgaaacagagaagtgctacactacctaattgtgacgatatccagattgtgcatgaaaataactttcatacatcataacaatacacaatgatgtttcaaaaaataaaacatgaattgtattgtaataacagaagctatatatgaagccacattatcatctattttgtatatacaaagagttacatctaatcatttaaaacattgattttattcgatgataaaactaacaaatcccgtggcaaggcgcggggtgccaactagtaataacaaaaactcatttaaaacattgattttattcgatgataaaactaacaaatcccgtggcaaggcgcggggtgacaactagtaataacaaaaactcgacctgtgggggtaagacagcccccccttacggtagtccatgtcccaacgagccttacagtagtccatgtcccaacgacggcgtgggacaaacgaggagatttttttaaccacagcccccgccttacggtagtccatgtcccaacgatccttacggtagtccatgtcccaacgacggtgtgggacaaacgaggagatttttttaaccacaacctaaattttgttccaagggggaattaaacacagaacctgagaagtgctactatagccacctaaccaactcagctagaggctccttgcatcttaacaaataataatcaaggtatttagcatccagcatgtcttatgaaagacataggttgctactgatacattacacacatgacaataaataggttcatatatacctttagcacgtggatgcagggcatagctggaatgaaatggagggcgtgccactcgcttaatttactatattttaaatcgagtttaactgatgcggttctctaagtttttatttaaaagggtacacatatagtgaaaataagtaatgtatagttaaaaaatttcttaatcgggttcctacttcctaggcacccctctcatatactctagttccacccttgcttggatgccattgaaacactgctagctaaaacataacttcgtccacaaattcatcgttgccctaagagtttgcagacttgtagtcatagactctggtgtgcaaactacagagaatacatgaagaatatttcctgaatgtcctttctattacctatctgtctcaagcaataggctttggaggtttcaggaaaccactgcatctgagctagagagatcaaagagtaatctggatttccttgcctgcaggtgttctcgatggcttccttgcctagtgatgccacctgcagcttgatgcaaagacggccattcacagtcagagccacgctatgccgtgcctcaagcaaccaattcaggtggtgtttacatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagatcatggatgagttttattaatagtctacgtttaatatttataattaattttcaaacatccgatgtgatagggacttaaaagttttagtcccatctaaacaggcctctatattttttctgttaagtgtagctgatcagtacaatggaattaaacgatgccagttgagagaaccaaaaactcttaatttgttccatagagttggtattcatgtttgtttatagctcactgcgggcagaaatcgcccgtcatttacgagatcttcaccaaggactgtcttgatctctcccttaacatcctgattctacaatgtaatgatgataattaagcttcagaacatctattgtctgcatagagaaggagtgctacatcctgcaatttaatgcaactattttcagaggactatttcacacacggctctcacactagacatgattcagactttcagtcaacaaggttaattatgccttgtcctgattttttcatgtcacactccagtatgcagagtagagatgtagagtcagccaagtacaagcggtccatggtccaatagttttatgtgttaatttgctagaatgaatcttttttgtttgtttatgatcataaaggcagcgagagatatatatacatagaacagatgtgtatctcacagtttacttcttttgttctaggttttaatttctccattctcacaaaccaaacatccggttctcttatattttttggactcatgctggatgttggtttgggaagcattgggagattggtgcgtgctgtcacggctcgactgatgccaacacttggcgacgacttctcctgctgataatgcttatgtcggaggcagtactgtattaagggaatgtcagttaatcagattagctgcattgagatgaagatcaggaacttaagaacacttgttctctgtatcatatacatctgtagtgcttcaactactttcatctaaatatatatgctgttactcattttgccttgtggtgcttaaccatcctgatatatagacagctagctcacaagccacttaatttggttctctgaagaacataaaattggtactaactggtaactgacgaagcactgaatctttctttcgccgattgtgcatgcagataacacgacataattttgggtaagatcatagtacaagtacttgcatagcacagtgaaatgttgagacttaacgccattaagttctctcaaatcaaaattaggaaaccactaatacttccctcacagtcacagacaattaaaaacactagctagctggaaaatggggaaaaggagagagtctgattggcaaagaatggaggcaggctgatggcccatgaagtcatttctctttgttttttcaatacattttccttttctttccaactttgtagtacaaccactacatggaaattcttttttttttacaaaaacatgacaataggttctataatatcttactgcctccattggaatataggctccaataattgtggtttatttatcttgtgttggtgtctattagtttgtgttggagttttgttaaatttggattgtgtcttgtgaactctgtggtgtgtgatcgcagttgagcaattttgtgtaataagtgattgtagctcttttgagcaaaggctaaatttatttacattatctatggaatatagaaggcacggtgttgaacatccaactttggctatcactttttcctaaagtatattatcattggcagtgagatcaaatatgaaagtacatttgaggcaaaattcaaatatacaacttttaacttttatgtcactagatttatatattgttaagccaattgctagttaaaatatttataatgaattgcatgcagtttgggtcaccttttattaccaacactttggaccatcctttattacctagtccaaagtgaaaatattgagtagattatggtttaaaatgaaattttggtaataaatggtggaccaaattgtggttcactctgagactttaatcttgaaattgcgtacaagtattatattttctagtggaaggagtagtattataggatttgtttttgccatttccaattttcttagttcaaatttgaattggatcgaaataattcggatttgctagcggaatatattcctaaaacagcctggaatcacggttttctgttgaaaccggtcggtttttactggaattaatggtgatccgtgactgtttatgcaaaccattgttcgtagttctgctgacacattgcacacatcctctcaagaaagaaaaatgacacattacacacatgacagtcagtgcataggttcatatgtacctccacatatgccacaatctaagtaatgaagaaaataatattggaacagagctagctataacataacgtggtcgagatattgatctttcccctagagctgtagctatgaagtctggtgcatgtgcagactacaaagaacgaagaagatagtaatactttctgaatgtcttgcctatcacccaattgtctgaagcaacaggctttggaggtatcaggaactactgcatctgagctagagtgatcacagagcattctttcctctccttcagttgtcgctgttcttaactctcatgcttctctcacatggccagaagaacgtacctacgtcttttggagctctgctcatccatagccatggagctgtgtttgagggctagcaaagcaataagcaactcagatggagttgtttagaacatagttcagattgctgactggatgtgggtatcctgaatccctcccgaaattgtttccaatcggttgaaaacttggatccattggattaaatttgttgaaatctgttatgaatttcgttcaaaattcgaaatttaattagtgagatatcaacacctcatatggacttgcatttaaaaactgagatagtacgaacgctagtatatatagtgttgattcagatggatatagcttaatgtgagagaagcatgagagaatctcttgtggatgatctctatgtctctctatttgtttgttactcatatatagaaaatggcctcaaataacttgggtgcactttatttctcctataaattgttatcacattttcttctactttcaataattaaaataaaatttctcgtctaagtttttctaatgatcaatcatggcatctttaatccgagccacagagctgccgacacattacacatgccaacaaatagtttcatccctctagaacatgtacatcttaggtggggtttgaatctcatgaaaatgaagataaagatgaagattaagtgttttacgtaaaacgaggtggtaataacatgtgattaatttagtatcttcacaagaaaatcatgtacataattaatgacaactacttaagagtctaagagcaagtttaatagtatagccaaccattagctccaactcacctatagtt

SEQ ID NO: 75989 - DNA, 1481 bp, Oryza sativa
atcacatggtattgtgttgttttaaccaatcaatcactttaagaggtgtgttacacaattagacatataaagaggggatgaaaattaacaatacatctctctacagattgacatcaaacataatcaggatatgattcattcatgacgtcctcatacaactgtccatgcaacgtatgcataattaaaaagagtggactttcctcatagagtggacttgatatatgtgcaatataaaaatattataagaaatagtttgtttgaagaatggaaatacatttgaattatgttcacctctataatgtgatgtggactagggttcccgatcttccgaaaggttcagtcgatttgggcggagtcacgacacaacttaatccggcttctgaatgaacacgctcttgagccccacaatcgtagcaccacgtctcctctggttagcacccgtgtcgaaacacggatgacctgccgagaaggctaatccctgtttgtgaatcgaagaacacaaacaagaacaaggaagaatacagccaaaattgcagatgaatgattaaactcacaagttggggtcttacaaaccgatctagcggcgaaactgttcttgacagaataatctaagcaaaaccccaaaccctaaaggtgacgggggggtataatatatagagtttatggtcgtgcaaaaaacccttgacttaaccctaatgagttccaacacgatacacggcccaaaggcccaaatacggtgacgcggcaccggaacagattttgaatgtcaaattgttagatcgattcccattgactcagaaagaatttggacgtggaaccataaccattggaaaggttatcttcttagctttacatccatataaagaactccccaatccgagcacgtatgcgacctgggcactcgttttagtgcagactggtcctgaactccgaatcgtactcgaagtcgacttgttttgggcctccaccttaacttggacgtccttgatgatcatccatgcctctaagtccctctccaagtgtctccttgtcatcttcattgttcctaatcacaatataatcattaggtagcaatctattctcaaaatcatataaaggagaatataggaacgagctcagctctaaattcaattgtcacgcacgaactcttgttattggtccttgaatgactgatggaggattgttgttgttgtgtgtattcgaaggagtgatgtccttatcataatgtgtccaaacaattacatgataaaatggggctagaaggatgcatggtgctttcatcatttctcattttctatgaaatgcttgatgaaaggtttttttttttgggagtactattaataaggaccattcattggacatcattctatccgaaaatggtacctagcatagctcctgctctatgaccaatcggtacacccctatgtatttttcccacacatcagtcgtgtgaaccctcccaatcaccatgtgcccatggt

SEQ ID NO: 75990 - DNA, 12274 bp, Oryza sativa
ctttgaggatttggatgtgcagaatggataacaatgtcacgcgtgattatgagctaaaaggaggtgaatgaatgagtaatcaatgattaatttagatggatgagtagctagcttcttgatccaacggcttataactctatactaatgcgatccaatggcttaaattgttgatgatgtggcttcttgcatgtcttgttttataggagtaaatgcttcttagtaggtaccaactctatacgaagataggatttgctaagatcactttcttttcaaggaaccatataaatatcttgatttttagagaggtgcctttaattcccataatatcctcctagaaatttttatattggatcttctgattgtgtcatacattgggttgagtttcacctatgtttctaggaataccttaacaacatatttgcattatactacctttgttttctaatatatgatgttattaattttttgacaaacgtttgaccattcgtcttattcaatttttttgtgcaactataaaaaatataagtcatgttaaagacatttgacgataaatcaagtcacaataaaataaataataattgcattaatcttttgaataaaacgaatgattaaatgtatataaaaaagttagcaacgtcacatattaaaaaacagagagagtacttcctccgtttcacaatgtaagactttctggcattgcccacattcatttagatgttaatgaatttagacatatgtatgtgtttaaattcattaatatctatatgtatgtgggcaatgctacaaagtcttacattgtgaaacggagggaatattctgtaaaggaatttaaattcaagacatgtggtaaggcctcgttgtgtgtggcgatgctggatagtcaaaattccttatccatcccaagccaagattgaacatagctatgtagcatgcattttacgagcgatgtttttggtcaggataattttatcatccttgagaatgtatctcccaatacaatattttatagtataaaatttggtacctttagatatgaagtacctctaagtacctcgaggtactttctaatcgtaaaatttctcttttggtcaatgatgcttgctctatcacactatcatgaccaacagagtatactaaatgttcttgcagcaaaggcatggtttcctctcattatgctggctctacagtttgcaaagaagttggtatctctatgcggacatgagatatttatataggaataaagtgattctactcagtaactgggagctacaaatttatgtttccctttaatacaagagccacaagacttcattgtgcaaatcatgaataatacacttgttgaagagagtgcactattcacatttgctagatgtttacagaagtttgcatgcatggaactaatagcatggacttagtaaggtattgacaattcaagtcttgaagatggaatgatttcaaatcaaacacaaccttttttaaaaagaaaaaaagcaatgcgctggcctaaccattcttaattagtactgtttttgagaattctttgtttgaaaaaatagaaaaaaaagcacaaaaaaaaggagatataatggcataactctcctgtgagttcttgaaataaacacaagaagtaattcagaaaaaactggcctccagaaccctaatgaactctaccatatctatcctcctatctctgttcatgtcatatttggcaatcatttgctcacactcatcaacccctacaccttctcttaatcctagattcctaaggactctatacaaatccaatgcatcaatgtacccatcattatcctcatcaaacaccaaaaatgcctgctttacttcgtccaagctcggttcatcgtcatcgaacaactctgacatgcagttagaaccaatctccttgtaaaccatagtttttccgtgatcaaaatcaggccccatctttgtcatcacagactcaacatcttcatgtgtcatctctatcccatcatctttatgcttacttagattctttgatatctttctgtcggcgagaaccggtgtcgaggtcaccttggtgacggcataattgcagtgttggcaagaactagggaggatcatctgaaccttcgagatgaaccaggtaaacatggtgaagaggatgaggaggcaaaccggttcttgggactccagttccaggaggaagtgcatggccggtgacttctccattgttgcctagttggcttcttgaactgaactcttgtttgttgcttcttcactttcttggtggttttggtgagaggaaaaatccatgtaggaaggttatataggaaaccttgttgatgtatgttgttttgtagcgtatggcttcaacagaatcaatctgaaataactatgcaagtgacgagatgtttcccagttagaacatttgtatggaaggaagactagaggacggctgcaagatggctgctttgtctgacagattcaagagtctactctggttggtcttgccttgcctccgtttggttcttgcaattttcttttacaaaattggaacttgcctggaaaggaggggagtcagagagtttgattctctctttcaattacaaacagtagtctacttgatgatgctctatgttatgatgcagtagttttcagaaactattggctccttaactgtgtacatgttggggaacagactgaaaatggtcagtggttaaatattcaaggttaatgtctgaatatctgacgaatattgaatgaaagaaataaattattcaaaagttgttgaatgaaatccacccaaaaggaaattgtatgaactgggtactaattcttgggccgggctgtaccggtccgaactgggtatttcaagttggaatgcacaaacttatcagatcaactctgactggagatgggttgtcagtggaggccattttgggtacttagggtgaaaacggtctgaaatttacatggactcatcatgggccaggcaaggctagcaatccatttcttttaggtcatgtagtatatgttaatctgaacttttattaagtcccaagtaggagaatcagtctctgaaaatttttcaggtagaataagcatggaggttgcaccgaaatttcagggaagcctataaatgctgtcggaaagaagaacaagactcaagaccttataagcattttcaatagagactcaagacttgagaggaagtgtagaaggatgcaaactaactcattcgtatctttggtttaaatgcttcttcctttaatttaatgtcaaccgtactactgtagatcgactggaagttcatacttatcaattttgattctggtttgataaagacttgttctttgctaaaatgttaggaattaataccatgcacatgtgcatctgttttttattgaatcatatgtgtctaattatcaaagaagccatatgtttcttgaagaacttgagaaggtaaaacctgccctgccaatgactgaacaagtcaagatcctataagctgacaaagtaaaatttgagtttttaccgtcatcttccgtttcattttttcttccctcttaaatttccgcgatgcatttgcgcatatatttcgtgtggtgtcatccagtatgcacctcttgtttacatgtcaatcacaatctttctcaatcagctcatccttttcaaagaaatgtcaagttcattgcatggacattgcctgaacaaaaaacgagaaagaattcatcggtgctttgcgataccaacgtgacatagtgcctgattgcctgtgactcaccgaggttcaggaattcagtgataacctatataccagtggcacagcacttatttcaagcctctcatatttttcacaaaaaaaaaattgtctacatgcaagtgtaatctaatgcttgctgtaacttttttcaccacaaacaaattttgatgtttggaagtctttcggacagctgtaaagtttctattggcgggaactaacttagatgagtagttaactactgtttacttcatcagataagatatattagcaatttagcatagtagaggctaacaaactatctaaccaaagtgccgaatccactatcatgcttaaagtgactagctttagtttacctgaagtttgaagcccacattgtctgcatcaggataagaaaagccggtacggttggtgaccatgctgctgatgcacagtcatctcaagcagcaaaaactgccagcatcatctgcactatgtcaccacccaatttgcaagcaattgtgtggcacatcctccttttaggtggtcttgatccattcctgctttatttctaaccttgtcatttctttgccaatttatatgtgcccttgattcctcgtttgctcatctgctcttttttcgatatgtatctatcttgttgtatcttcttttctcatgacgagcgattcggttttttgcggctttcgatctatgctaccctagatacctgccaagaaagggcacatacaggttgattgattagccaatactgaattcattacaagagcttttagcctctcattgcctatgaaaatgctcacctacttttgtagatataaaaataaacccatcatatgagctaatgaagcacttcaagaaaaagtcaatttttatagcagattagagattgggctacagctagcctaaacacatgattgtggaggatgtttcagagtcctctatgactccatgctccatgacaaatgagctataaaatagctcaattctgaagctccatatgaccccctcatggatgcagaagaatagtagaaaagtacttcaagatggagagagttcctgcagttcatctggcagtggtgctcctggccttctgctgcctcatccatgcatcatcaagtgctgaaactccactcccacctggtaatcttctcggttcctcgcctccgtatcttcttcgtggcatattgttttttcagaaattcatagtaaaacataatgagatctgaacattctgactgaatattgatgtttgagtcacaaccagccctcaaggtgatgcagcgttttgaagcaactccagtctctagcagaggagatgatcaggtgatccgggtccagctctcttttccatctcataactttgattaaatcaagttttttttttgaaaaaaaaagagagagatcagcttacactttttttagaacctatatattcagataagtaataactgttcatgttcaccatgttttcaagtagtactagtagctacttttcagaacatgttctgtttagctgcaattgcaaaactgtctgctcaatctcaaccatgatccataaggctgccgccgtcatcgccggagaaccggaggccggcgaggtcaacggcaggatggaactggagctcaccgattacccgggctccggcgccaacgatcggcactcgccatgggggcaggagaggagaaactgagcagcagcagcaaaaaatcttcagagaaaacttcatccatggtcactttcttcagagagaaaattcagactttgtacctgtaccatatcatgtatacttaattatctctactattttctacacaactgttacagtgtttctacaccctgtgtaacatgaaagagaggatttgggagttaattaacgactgataatcagtcgccggcaccataatattataacaattaattataacatttctagtaagttttttagtcaaagttgttatttgtttaattaactttctaggcgtgtttgttctactgtaatttttctgttctagtaatatctgaatctttgctttgatcgattcaattatatgttgcgtgtggtgaaggataaaagtattaatgcaatctgatgttctcatctagaacatttttgccagttcgttgatttcggtttgatttattggagacgactaggctgaagatttcgtgttaggcagcgtggagtgacctgtcacaaagctgaggctgacgaatggcgttacgatttccttctgatttgtgatctacactcttgattaactataagtagttgagaaatacaaggacctgatttttctttttttttaaaaaaaacatttgcttcaggtaaaatgcatctatttcaaatctaaattgtttagaatttttttttactttgaaaatagagtgcgtgtcacctaaacgatctcgtactttcatttctggtgatagaagtggaggagacttctctttttttaaaaaaaaaaatctcactaaatgatttacttacattacacgctagtgacatgaaacctttgtaaatcactaaatcttatgaaatccgataaaacctaaataatacctcgagaagcatcaccgatcattaaaaataactccctctataccataacatttaacgttggttagtttattttttaaccatcaccaacaaaaagaaccaaagaagtagtacaaggttaattttgacttcacgatattggatcaaacctagtgcaatgcaaaagcgaaggttctcgtcggtaaccctacagctttggctaatcagctaaattggccttttcaattcagcataatcagccataaaaaggtgtccacaaagatcaaatacactaccaatagctggtacttattcagcacaataagctaactgatgggcttgtgctaaatatcagcctcagccacagcaaaccgatgaggtccgaaaacatttaccagcataacataaattacttctcactcgaaatttagtcgaaaaagagaggaaattaaaatacaactcgagatttagtcgaaaagacaggaaattaaaaatacagtatacatttgattcgcttcgatccagcgtgtcacgcggaatccgcccgttgcctttgccggctgcgaaaaccacgagcgggtgtaacgccgtcaacccgagaccccgagaccatcgatcccgcgccgtccgatcctgatcgcgcggctcccgtgccgcacgacggcagacggccgccgtgctgtggccgttgcaccgcgtcggcttccgatttattgataataataatccagatttaatttaatattttattgtttaccacacagctgctcctcctcgggcttgactcgtctcgtctcgactccacgaacgaacgaaacacgccttcttccccaacgaccaaaccaaagtttgggtgaagaaaaaaaaatatcgccgcgtttttatcccccacgagacgagtcgagacgaccaaaagcctaactaatcgggggcaagacgaggaggagagcggattctcgtcggcttcggcgaccggaagaggagaggagaccgaccccgcgccgtgttccgccgccgccgccgccgccgacgacgacgacggcaagtaggtgcgtgcgatccccttccccttctctttgcgcggagcccgtcgccgagcggcgcggcggtggggagtccgttgatgtgtgtggtgccgcccgatttgggggtgatgtgatgtggtgtggtggctgctcttctacggtggaatcggggagagattcgcgttgttatggcgctgattcggtagggattgggtgggttgttcgtatgatccgcgctcagaaggggaattttgctgtggagagttgggggggggggggttggttgtagctagggtttcggtcggggacgggctctagtctctagagagttttagagtagtccaatacagtaaacggagtggtttttatttttcaggaattttcgctttactgcccgattcgaactatgcccatttttagccatcctcttgtgcgagtttaccccgtattgaccaatggcgttgtttgccttgttggtttcttgcaggaatttgattctcctggggaattaacttgttaggagaaaaggaatttgggatgggcgaccatgtggtggtgaatgtggaaggcttgggaaacgatggaggggctgtggagaagccatctgaggccgtgaacagctcagtggtggctgctgcgtcgctttctacgactgttgatacggtcgaggagggcggtggagaggaggagccgctcatccaggcggcggagtgccgtatatgccaggaggaggatagcatcaagaacctcgagaagccttgtgcttgcagtggcagcctcaaggtccagctcctcctcttttgatgttatttccatcttggatatggttcttatgttcctgaaattattgtaggcagcttgttgttcatgcagtgcatgtagttactggggctaagaataggctagttggggtagtgcttttcctagtttccattttggcttcattatggtttttcaattctattttcatgttggataagttgatggttttcttgcacataaattgatctaccatgttagataaagttgatttatcacattagattccctgataggttatactacctccatttcaggttataagactttctagtattgcctacattcatataaatgttaatgaatctaggcacacatatatgtctagattcattaacatatatatatatatatatatatatatatatatatatatatatatatatgaatgtgggcaatgctagaaagtcttataacctgaaacggaggaagtagttgtttaattgccttgtatatgtatgttcaggatagtatcactgccatatcatatgatggggataaaattgttcacccctatggcagcatagtttactgggatgctatctatctacctgtagaggatgctaacctttaaacatgctgtgtacaaaaaaattggtttatccaataactatgcagtatcgggcatggcatgtatgtacctttaagcatgctcgtgtgactgtgtcctcactttctcctgaatctagctgcaaatggcaagttggattgttctcatatactttttaatgaagaaccaacctttgatctcatagggaagtgatgtggatatggatattgcatatcatctgtttgtcacaatcccttgtggagaacactttgcaaagacaagttgagtcagcactccgttaaacaaagcagctatgaattccattttacaatctttatgggataagacataccagtgttttgtgcaatggtttttgaagcaatagttgggtcaccacattgctactttatggtatgatgctaccttggacactaaatttcaacagcaatacagtgcatgggccggtcttacgtcatattaattgccaatggcaatacgtaatgcaaacccacactcaagcaagcaaccaccaatagtaaggctgtgttcgggaggtggaattccacctccccgcaagaaaaacatggtggtttattaatgtttaattaattaagtattagctaaaaataacttgaaaaatggattaatatgatttttaaagcaacttccgtatataatttttttgtaaaaaatgtaccgtttattagtttgaaaagcatgcacgtggaaaatgagagaggtgagttgggaaagtgaagaaaagaactcagcctaaatatattggttttgagtttgatccaacaacgaaaaatgcatttttatctcttaatattctattgggagcatatcaagggctactcaaaccatctgtccccaactatctccatgacttatcacagtaatactttattgatctcttctgtaccgtctgctggtactgttaagtcttgagttatgtcttgttatttcatttcattacatttcttccatatttctgatagaagctcatgagatgattaaagatccttaataatcttataatccattaacccagtccattttgtgtgaaaaactggatattaaataagcaaatttatgagattcgttactactttatctgctttgtttcttttagcttggaatttgcttttaagtcatagctattctttggatataatgtgtgtttgacatgaacttagaggctgcttctgtgtagtcaactaacttataatgtgtgttgtccttggcttgtataccatatgagaaagtacttgtatgttttatctatgtaattattttgtattctggaattgacaattttactttcttcatgtacagtatgctcatagagcttgtgtgcaacgctggtgcaatgagaaaggagacattacatgtgaaatctgtcatgaggtcagtaagatttcttctctactactccattactacgcattgctttctagttcttatctagaggctaagatagcacctattttgatatgtgtgcatccaaattgcagtatatttgtttcttcttaggacttcatttgtcaaatgttctgatctgaccttgacctgatgatttgacttgttctttctgcaatctcacgtcctcaccaatacaatattgctgttgcgatagctgaattcctctttaatgccatatgcacctttttcttgatgtgtgctgcttgctcttcttctttcacataggcctcactccatacaggatcatggcttttgtgtgacaaccttgaactcatttagtgttgtctatctgccattacaccgttaccatttgaagttgcttggggagcgagagctaaagcagctcatttttattttaatcaatattagttgatttgaagtaatctgagtgacggggacaggtcgtgataaattgggtagatttgagtttttccatgggtgcttagttgtggccttccaatttagtattagttcgatcttttcctttcctttcatgagcttaaaaccagcatttagttttaggagaatgtaggggagaccgggagagccctactatgctggtacattgcatgcttttgtgattgattaactgtttatgtttcaaatatgtttatactcgtagaatacctgtagcttctttcagtcttctgtagattttccaatgtgtttccgttcctgtgtattaatttcgttgaggcttgtattttcttctgcagcaatataagcatggatacacagctccacctcgtgttgaaccagacgataccatcatagatatcgggtaagttatttctgtacttattttgcttaaatttaccagtttgtccatttgattatattgtgttcaagtgcctttgaaatttgaaaatttagaacatttctaagtcaatactgttggcttgcagtggtgattgggcacgtgacccaagaattattgctgtagcggctgcacaacgtcgtcttcttgaaactgagtatgatgaatatgctggtactgatgctagtggtgctgcattctgccgttctgctgcacttatagtaagtactaaacaacaattcaaggtcctgttgtgcttaataagctaagctaattcatagattgctacttccagagtccagacaatttgtccagtcaccagtatagcctatcgccctatcgatctgttttataattgaagaaccatgcttagagataccttgcatttctctcatagttctgtttaatgaatggaagtataatatttttagttggtttacaaataggcaatcaagctagcctccttctctagtcaatcctttgtatgacttctctagccaaatggcttgtctcgaatttctggaattctcaagattgaacattctaaaatccttggtgcttttccagctaatggccttgttgctattgaggcatgctttgtctatctcagacaatgaaggagatgatgatgcttctaccatgttctcggttagtcttgtgttccttccccactttttttatcttattggttctttctgagctcaatgttgacttaaaaatctttttttacatgacttaaaatctattaatgttcttcaatgtccaacagctctttctacttcgagctgctggatttctgctgccatgctatatcatggcttggatattcagtattttgcatcgccggcgacaaagacaggtacttctaattctgtatggatctcattgattgtcaataaaatcattattgggctattcttatggaggaatgaaatgattggtggaccatctgatcctaactttgacacattaaccacttggttggtttaacgaatgggatgggttgttgtgtcactcttatcatgtttagcagaaaaacgaaaaatgacaccacctcaccagaatcacgtgatgatccctatccaacttgatgtagtattatggaatggaagttttaggccccgtttggtagggctccaaactccaaactccaactcctaactctaaactcccactccagtgagagctggctccagtgggagctccaaacactttttcactccagtgtttggctagtattcagctccagatctgaaaaaaaaatttaaaaaagaaaaaaacaaatgcccaaaccctaactgc

SEQ ID NO: 75991 - DNA, 14160 bp, Oryza sativa
  unsure (1)..(14160): unsure at all n locations
ttcctttcatcgttgtagaatggagattcaaagggcccgacggcggagggtctacgatactgggttcatcgaccctcggaaaatcaacaccgaaatgatcgacaagtacgagaaagacacagaggacaatctcgtccatctcctaacgcagcaacattcaagacgtacatactactgccgtacaacacagagtgagtttttattgtcgttcgaacanattttgttcccatacatatagcatgtacatttttgatcatatatatctcttctcacgcatattccagattccactgggtcctgttttcttcgacttggacgcatgcagagtcactgtgtacgactcaatgaataaagaggagaagatttttgataaggtcttcaaactgatagacaggtaatataatgccatctattccaaagtcgcggggaatctattgctattatgttgatctcaagtaataattaattaatcatagcttgcaactgcatatgtagggcttgggatcggttccgtcaattggtccgcgggacttggaaagaaaaacttggacggaggtttgattttccagtgagtacatgcatgatccaaaattatattggattgaatctctaattacagttaatataaagagtatattaaatctctcatcgtttctcatgtagtgtgcaaagcaggaccagggaactaacttatgcggctactacgtatgcgagtatgcccactgcctatcaaaccaaatatgcacaacacgagagctcgatgtacgtatacataaaccattcaaaatttcattgcgtatcgatttgttaagttgtttattaatttcatatattcatacgtcattatttttcgaacgatagcgtattcacatgagggataatctcccacacaaggattttatcacggctgttcaagaacaactgatgggattcatcaacgaagaagtccttaatctcgacggtgaattctactacgacggatcgacaattcataacgtcggtccttcctcttctgacataacaccggcgtcaaagtcgtagctatagctaccgagcaaatgaattgtactatatatgcatgtatatatatatttatatatgtacacatttacttttgtgttaatatatattttggtaacatatatatatgcacataaaatgttaagtgctttaaattatacatatgtctgtgtaatatatgatttatacatacacacacacacacacacacacacacacacacatatatatatatatatatatatatatatatatatatatatatatatatatatatatatatatatatatatatatatatatatatatatatatatgtctatatantatgtatatatatgnanngagacatatgtatatatatatatatgcctatatattatgcatatatatgtatatatatatataatcaaccatgcagcaaacagggccttgcaaataaaaaaaaatggtgcaccgatctttagtcctggttggtaacacaaaccgggactaaagatggtttggccggccacgtggctgatcaatctttagtcccggttggtaacacgaaccgggaataaatatcgatctttagtcccggttatttcacctgggactaaagatagttatctttagtcccggattcgtagtcccggttggacaaccgggactaaagggggttaccaaccgagactacaaacagtttctccaccagtgtagctgagacctgagaagccctgtgttgcgatggaataattatagaggaaaaaggcacatatggtgtcggagcccaaaactaataacttgaatccgactgagattaatgaatcaatccctggatcagtaaatattgatacatacaatataaccggttcttcattgcatatgttaaaaagtcttacaatactaagggttttacaataataggtactcacctaactaattaatacacagcagaagtttctatacattctgactagtgaggtataacctttagggattctctaagttatcgggatgttcgtagtaatagtcataagggtcctcctcttgacccagatctgaaaaaggggttataagagcaagggtgagtatttacaatactcagcaagttatcatgggaatatgttatgcattgacatataatagggttctttgcaaaaagcagtactagacaatctggaaaagttatagcaagaatttataaaacatataaactttagatttctaaccagggtaccatatgagtcccagtactcaactccatgagtacggctattcgaatagtttcaaagatattctactgtagcagatgtacgctttacccgcagtccatgacttgctgataatcatcggctttagtcatggtccagtattaagtcattaacaattgtggcacctgttccatgaactcatatcctcatatgctctgaatgtaatgttaacagcagcaagaggagttctggcgttcccaaggtatttaaggggaactgatcgtatgacaccacgtcatctcgatcagggtttagaaatataccatatagtttatactcgagtatcacaaaccatttacctgtacatggtaatggttaaagtttcccttcgcggctatagttgcctcctgcacgaggacttaaaaataagaaccactatacagaggtgccatattgctaattaacataataactaggtctgtccctattctagaaactgcggtcgtactcgttcgttcaacataagtatctggtaaaacttatattgattgagacagtactagccacccggaaatcagccaaatcttacgtactgtcccaatctaagtatagggtattttaaccagattgtaagcaaaataagcaatactaaattatctgggtttctatgattgatttatgcatagaaaatagaatattgaatagaaggctataagtaaataatttataaaatataggcttgaatgatcaaaaggtatatggtaacttgccttgctcgatgtcctgagattgatggatattatctattgagtcagaagaatcctcaagacctagggttagacatatgtaaaattcaaatttaaaaggaattcaaatgaaatccaaaaatatgaaaaatagagaaaataaaataaaatgcaaaaatagcaaaaaggggctcaaaagatagagaatgattttagaagaatattggtccaagtttcattggaattggatctatattttaaaagatatgagcttctaaagtttaaaaatcaaataaaagtgaaatggcactgtgtgcgggtcccacctgtcagtctctctctctctctctcttctcttcttctaccttcggccgtttccccaaatgcagccggcggtgctagggtttgggattacggcggcgatggagggggaaagtggttgcggccgaagaggggagggagctaggtatctccggcgacggcgatcggcggcggaggagctaatttggtatgtggatgggttggcgactagggcggcggtggtacggttaggctgtaatggtgatcaaggtgatatgagttagacatggctaggggagggggttctagagcatctacgaggtgtctagagggattccggcagcttgccgacctttggcaaggtgcggagaatagttgccgacgagcgcctccataggcggcggccgtgctcacatcggcagcttagaggggagcatggtagtgcaaagggattgctaaaatggaatctaggtagtatgtagatggttgaaacggaaaaactcaccgagatcggttgaaacgacggatgcggcccagaaaaacttcgcggcggtgaagaacagagcagcgcgggggcggcggtgctcgggttggtgcggcgaggtaaaactcgacgcagagcttcggttagggcttactatgctagaacatggttgatataaggtgttctaagggatatttagggcggaggatggatggagaggggtggagtcgatcgcgcacaaggtgttcgaccgacgagggatggtggttgatggggtggattggcgaagcagagcttcggggttgtagggctttgattgttgatgatggatgatggacaaggaagggattggggtcctatttatagggctaggaggagcggatgagctcggacaccgtcatcgccatggatgagcttgggatttggatgaggcaaaggtggcaaaggctgagagagggcgggaaagatcgatttgagtggcgggaggccacgttcgaatacttaccgatgaagtattgacttgaccgcggttggaatcagctggcgacgtgagggcgctaatccgggcgcgacgcgcggcggcggcgagggtgaaaacggctggctcaggggtgaatggtttgaattgtgagaggagataccaccgtctatcttcaatctaaccgtgcggcaagaattggcgcgattcaccctgggtagaagcgaaatcgtactcggcggcagctttggacgggcgcgcacggcgtcgagcggcgatttcttgcggcggtcgtcgtcccggctttgtcgtcgtcaagattggtgcggcggcggtgggctgagggcgtcggacgggcgacggtgcgccaaggcggtcaggcacgcgcaagcggccctgaggccgacgcgcggcgacacggcgcgtggctaagtcggatgctcgggcggtgcgcgtgaaggggaggatgaggcaaagaaagccacggttttgagtgggttgtggtcccctaggaccaaatctagactttgcacaagattgggtaggagttgggctgctctagttgggctagacatttcatcgagcaccttgtgtgcgatgaacagtgaatttcagaatttttgaatatttcctataaaaagaatgaatttaatctatgaatttgaaagagtttcactagggtttgaagtatagcaaatcttcgatgaactaagaaaataatctatggtttgaaatttgagagaatttgctcaaattcactagggtttggaataaagggaattattagggtaaattagtagggctctaagaaataaatacttgaaccaatttaagaatcaaatagatttttaaaccaaacaaatttaatcaaaagccagcatgatgcagtcaaattttagtttaaaatttgaggatgttaaatatggttgccattaaaaatattacaccactaagttgtactccctccttttcacttataaaacactttaatttttctcattgtcaaacctttaaatttatttaagtttatagaaaattttagcaacatctaaaattctaaattagtttattaaatctaacattaaatatattttaatagtgcgcttgctttatattgaaaatattgctatgttttaaatataaatttagtagaacgtaaaaaaaagtttgactaaaatttttttaaagcgtcttctaatataaagcagagagagtaagaaccagagaaaataatattaattaatcaaacaatgcatgaccaactcttcagtctatttttttactttttttagaggaacttaccttttcagttatgtgaactcatcaatttccaccactctagaacgaggcagtccggcctagcacacctccaaacatgtaaaagcccttaccacccagcctaggctcgtgcaacccaggcagactaatagggctggctcgagtgggccggattgtagagtaggcccatccatgggcaaggcccagcacaggtctacggtgtctagcggcatgatcttgtgatatccttcatgatctcctatcctctcactacatgctctctctctctccatcctaaaatataaatagttttgaatcgatgggacacatggcagatttagatagattgtcagtctagatttatcatactaggatgtgttctatccaaccaaaacttcttatattttaggacggagggagtactacacagtggcaaacctagaacggaaattatccagggtccttaacctgtcataacacatataatactttaatttttaactaatacaatatagttaatataagctaaaacatccaagtattaaaaattacccgggtccggtaaccacagtagtacggaacaccccttatactacccccgttttttaatatatggcgtcgttgacttttttacaaacatttaaacatttatcttattcaaaatgtttgtgtaaatataaaaatatttaagttatgcttcaagaacatttgatgataaatcaaatcacaataaaataaataataattatatttttttaataagatgaatgattagacgtatcttaaaaattcaatggcgttatatattaaaaaagtaatcattgtagatattttttgtttgttcgagctatgtgaaacacggagaaattcaataattggacactttttagtttccaatttactttaactaacacgtgtgaggatgatattgttggtaacttttttgacaatttgataagcacgatcacagcacctaaagctttgcggtgatcctagagtcgccaaccacctcaatctagcaaaagctaaatcaagatgggttttgataaactaaactggctaccggagccgatctagatagaacgatagataactacccgtctcgtgggcaaaacggaaggttttcaggataaacctacaaagatgtgtcgcactctcgcagcgacggcggatgatttacagcgcaaatcaacaaagatggacaaactaaactagaattagaagcaaaagtaaaagaacgattcgattgattgatggttgattgtctttttacaatgaaccggacttgtctcttatataggggttggtcttgccctctacaggctctcctccacgtccaactcgggctaaaaaccaatggaaacccaaaatatgtctttccgagcaaggaaactcgagtcccgacaaaaacagaactggactcggattctaccggtaagactgactacacactgtcggtctgactagtctactagcagcggtctgaccggccgacatacggcggtcagaccaaccctcttagaagaaaaccggcggactttcaaactttgacaatttttcctattttatttttaggtgccaaatttagatgtaaacagatatatgggaccataagcgggctaagatatattaaataatgggagcccgacttgggaaggatcaaattattaaatatcttgtactgctgcttactagctttcttcgtgtgattcatcatgccaatcactctcccgcaaacaacgcagccaggatgaggtcttgccggctctctctctcctcctccttgcgcttgcgctgcccactcggcaggcgttttccaacaagcaaccgctccaacccacttcaatcaatacaagaaaattgcaataaccacaacatttgagtatttgagaaaccatttgtagtattagcccttgtactatactcctacatatttatatttgggttttgactaaaacgaatggtcaaccgttatatgtaaagtcaaattaaggtgagaggtagcagtactcgtcatacgtacgaacaaaacactgtcgctatttccgatggagctgtacacgtacacgatcattccaatccaatccggatcggtgtccagttcagcctgtacacagagcctatctagtcgaccatgcaatgcacaatctgtgcgaccaagaaaagacagatcagagagaaagaaaacgggaaattaacccgcagtagttgccgcccgttccttccaccaatacgtacctcgatggagatcatggaagagccgccgccggcagcgggaggcgacgacgatcgcgaggtggagctaccggaggacgtgctcgccgagatcctccgccgcttgcccccgcgaagcctcgctgcgtcgcgctgcgtctgcacggactggcgctccgccatcgactcccgccggctgctacgccctcccgctgtcgctcgccggcattttcatccacttcaacgccctcacgttcccggagttcttctctcgtccatcttcgtcaccgacaaccgtaaggggcatgctcgacttcctgccacccgaagaacaaagccccgacatcggggaccactgcaacggcctccttttgcttttctctctccttgtggtaaacccggccactcgaaggtgggcgcgcttgccaccattgccccgcaccttcgccaagctggaatctgggttctttgacaaagaattcatcgtcttcgacactaccttatcgccgcactatgaggtttttaacatccaatttgttgacgtcggatggtacaacgtaaaaacgatggatcccgtcttgaagaaatcagaatggccaccatcgccgctcgtcctccatgtcttctcatcggcgacagggcgatgggaggagagatcattctctagagaaggggatgcagccggaaccgtggctagcgctcagaggctgtgccggccggagcagtgtggtactgtctattggcgaggagcactctacgtgaactcgtattttgtcatgatgttaactttagcgttaatatttttatttagtttcaacttgtattccgttttcatatttgttaatataaattcttatgtttattttgttcttcgtagggtatcatgtctgatgggacgacctatcaagtaatcaagcatcccaaaatttacaagagcaaacaaccaccatatatttacataggaaaatcagagaaaggagtgtacctcgcatcacttcatatgctggactgttgccttttaatttggatcctcaataaatcatgtggtcagtttaagtgggtattgaagcaccaaaacaaccttaagcccatgctactacgcctgaataatagtaaacaagatcacggaccgtagatcttacaagatgttaactaccatctttatagtcaaaagtttccaggagagtgggagttatacaatgggaactatgatccctctcattttcattctccaaatgatgatgcaccggcggaaaataactttgaatggtattccgatgatgataatattgtagaaaatcaaggtaactgtgaagagcacgatgatggcgactaccttgagttgcttggatttcatccttataaagaggtcatctttctgaattctatatcaaggaaaggattggcctatcatttgaatagctcaaagcttcaacatttgggtaacttatacccaaaacactataaccacttcgcccaacatgaatacataagccaggcatttccatacacaccgtgctgggtcgatgagttgcctgaagctagtacttcactagatagtctccatcaagattagcatgcacgttgtttgcatgcggaactctcttttgtaaggcttttggtttgtaatataatctcaagcaaagcttccaagtaatgaccatatatatctgcatacgtatatcacgttgccactgctctaatatatatttgtgacatgagttagctataccacatagaccatgaatactcgattactgtggttcgtacatactctccatctcaaaatgtaagcatttttagcataatagtaagtcaaacatttttaactttgactattaataataaaaaataaaaaaaagtcaatcatgtaaaattgacgttactatatttataattaaacaaactatcataatatgcaaatcttattatttaaaacatcttatttttatagatattattgatcaaagtagcttaggacagagggagtaacaactagtaacagtgcacgtgggaggctcgttcccacacatataattgcaaatttattagagacaatccattatatgccactgagtttgtcatagctctacgatttgccactgactttgtcacgttctataatataccatcgacttttacttaacttatatgatttaccatcgccgtccagttagtctccgttagtactgtacaattttgtccaaatgaccaaaatacccctaggataaaacttccaaaatgtggacaaaaattccgaaataccatattataaacataagattgtaaacattcaaaatttgtccaaaaacttaaagtctgacatttcagaatttttatccaaaatttgaaagtttttgtctcaggggtattttggtcatttggatgaaagtgtacagtactaacggagactaaccggatggcggtggtaaatcgtagaagttaagcaaaaatcgatggcatattatagaacgtgacaaaatcagtggcaaattgtagacctatgacaaactcagtggcatacaatggattatctcaatttattatgttttcccactgtgcatattaaacagaccatataaatgtgaagtttaatatgccacatatctctccgtttacaatgtgtcatataaacggaaaacaaccaatgataccaaatatacaatttgcgatagtttgataaatgtttggcataataagaagtgtataattgcaaaaaaagaaaatccctaatgtaggttatagcttccttggtctcacctggttatgcatgtgcatatatgcctgggcaccgtggcttgttgacattcctgacaggtaagaaaaccctgaaaaacaccaaatagaacggaagaaaaagcgaaaagaattactcgtggaaagtatcggcaatccctaccagtataataaaaaatcattatttctataatgatgcatttagcataattagttactactgttttcaaggtagcacacaaatgttgcatttagcataaaagagatgaagagagcctctggtggattggtggctagtggtgcactggtgcatcagggtactgcaagcagcgaaatcgccgactccgctgagcctcgggttgattgccgatgtttgtgactccgatagtggagcgagatcgatgtcggcgactgtgacgccgatctggtgacacgcggcgtgcaacgatgctctcgaggcagaaatcgacggcggcgcgatgcgtgggcggaggggttgcgaggaggcgtcgctgtgcagttggtgtgagggtggggcagcatgattttttggatgaacgcgagagagaggatgagtccgggtctctgggagggcggagagaggaagggggtgagggaggtgggagcgtcgtcgggcgttggattgggacaatcctgaccgatcaatgagaaataaggatgtaaaaatcaattggtaaataatagggtagaattcagtttcagcaaatatagaaataatggttaaaaagcttacagtcatagggcctcatcttttcacttgtgcttttttcttatcaaccaaaatttgaattttcaattttaaatttggagctgattttgagattttttttattgatcgctaagaacacgtatataaaagttttattcacaaattactttttgttagtgaaacgatggctgcgatatttcatcaaattagaatttaatatgttttaattaaattttctcgttttttctttccgttgcaatgcacggacacttttgctagtacctaattaagaaatacgcgaaactcctgatggggatcgatcggccctagcgatcgggttgccccccatctccttcacgtggtttctttttttttttgcaccgcattactttcctattttagtaaatttatacacctgaagtttgtacacctcaagtttacacatctaaagtttacagacccaaagtttataaatcaaaagtttatatatccgattcaaatttaaatttgaattatctccacaaaaaaaattaaatttgaattcaaatattttttatataaagtatttctatacatctaaagtttatacacctaaagtttatagactcaaagtttataagtcaaaagtttacatacccgattcaaatttgaatttgaattatatccgattcaaattggagtttgaattatatccgattcaaatttgaatttaaattcaaatattttttatatatagtatttctgtacatctagtctatagacccaaagtttataagtcaaaagtttacatacccgattcaaatttgaacttaaattcaaatattagtttataggcccaaaatttataagtaaaaagtttatatacccgtttcaaatttaaatttgaattcaaatatttttccatttcaaatttgaatttgaattcaaatattttttatatatagtatttctatacataaatttttctaattttttttatttttttttaaatttatggtgtagtaggaagagaagaaggggaggaggaagggggagaggaatatataggggatggggcgagcgatcgcccatcagccacgcccagaaatacgtaaggcttcagctaaaaaattttctccgtcttcccatttttgtctttttcgccgttttcctttctttttttcttttcccttttttccgttttcttccatccgaccgtctctttttttttctttttcacccttttttcctttcctttttccttttccattttttccgttttcttccgtccatcttttttcgccggtttttcctcttttttttctgtccttctctttcgccttctttttccttttttttcctttttttcagtttttcttcatcagctgcttttttactcttttttttcgtcaccttatttttcaattaattgcaaaaatcgattccccgttactcctttatcatttttcccatttttacctttcaattctgttttaattcaccggatttagtctttatttaaaagtcaatgtttttatcccgatttttgcggattcgcttcgattttgataaaaaggaaagagcagatcgattgtataaaagccatcaaccaattttggaaaatctagaaatatttgaccggatttgatggggaggatcagttctggcattatatgaacatgagatgttttcaccattttccagaggttgaagacgacagtcagctatacgagctggagctacagctctacttgtgggttaggtcaaagagaagcagtctaagcaaaggaggtggcggtctaggctgaaactgaaaagaaaaaaaaagggaataagcttttgttcaaaaagcaaagagtaaaatgtatagggagcttttggtccaaaactaaagaatctaaaaatatttttacccatcgcaacatacaggtattttttctagtgaaaactaatatccaccgaccaaatctagattagtctaaatttataatagaaattaagcacgagtaacgcgttgcacgcatggaacgatgaaaataagcacgatgaacacgtacatgattgcacaagggttagctctgatcgaaccaccacatgcacgctctctcgccaacatgcagcttataagcatctttagtggactaaagatccggcctgacaccctctagcaaccggcgaaccgacactaaagatcatatagtcctgttgtccttaaaaaccaggactaaataatgacgtttagtcctggtttataagagaaccgagactattgtaaaatttggccgaccgatcgaagatcgtttctccagtagtgttacttagtaattttatctaattaaatagcaatacaacagcatataaattaatatacacaggtcaacactgttatcgtcgtcaacataagcaaattaatcaagctagctagccttttgccattccaagttccaaccatggccagctagtggtgcacaagggggatcaccatggtctcaccatcaccctcctcttggccgcggccttcttcttcctcatcctcctctcctcctccctcgtcaaaatcaacgagaaaccgcccaagttagaccacaggaagctagcagctgcagcaggtggcacaaatgtcgtggaggggcggatagcggtctgcctcgtcggagcggcacagcggttcgagctcaccggaccgtctattgcgtggaatgtgctagcgccgcagtacccgcacgccgatctcttcctccacaacccgctcgaccgtgactcctacaagttcggcctcctcaaggacgcgccttgagtggttgcggttaggttcttccgcccacgacatatacccgagacaattcgcgcgcatgccagactccttactcgcccatgggtgtacgggtaattttgcagctctcagtttcgttgtcttctgtttgagaaattaattaattctgttttcacaaaatcatctggaaagaaaaataaaagaataactttgtacacactactaa

SEQ ID NO: 75992 - DNA, 21473 bp, Oryza sativa
ttgcgaaattgcgcccctagtaagtactagtagtctatttttaccctctagaacacaacggaagcatgatgaagatcattgatgaaggatcagtgataaagctcttcacagacaaactggacgtcaccaattcaccaatctgcccgaactctgaaaccgtaagcttggaaggcgttaggaactactgcatgggcctgatcagttcatcagcacattcgtgccttcttctatcctccatcagtccatctatccaattgaagggagaagaacctacaagaaaatctccggacgatcgatagtcctgcgcgccaatccgcatctctgattctttaggctgagttcgggagcctcctgatacggcgcataattaataaagtattagttaaaaggactttaaaaatagattaacataatattttagacagtggttgcgcttatacgtggtgagtttgttcttctccaatgacacattcacaaacgacgctgagatggagtagatgtggcatagaaggcgcggcggatgaattgtctgctcctagacaccaccgaattgaagtggatgctgttagttgagagatgttgttctttggccacatttctagttaaccttttcttcaactaggaaggattaatcacgcgggcatgcatcgtagattgtgtttgagaaacttatataggagaaatattaaccgaaacatataaaatatcatttggcttgtctggattatttgagaacatttagaaaaaaaacccttggtaattggtatattttatctaattaaaggcactcgatttggtaattggtatattttatctaattaaaggcactcgatttttgatccagtggctaagactattcatatttcactcgatatgggcatatgtatcttacattgttagtttaattataaagagagatcaattagataaaaatcaaatgtgtagcttataaaaaaacactatagttgtttcaatattgattgtttatcttatagtttagtagctaccaaaataaagaagaggatggcggtgtttttttgcatgtgagagggaggaggagatggagggactttatttttctaaataatttaagtgaaaaccgattataatatgtttctttttttctcaaaatttcttttattgcttttataacttttaagacatgacacatgttgacttaatgttttgcaaaaaatatatttaattgacgaaaataatgaatccatcgagttaatatgaattgttttctaatttttaagacgtaacacattattagttgaaagtactctgggatgtttaatcaatttttatcatgtaaacttatttatgacataatgcatatagtcaactttttttaaaaaaaaatttcattcttatttggtttccatgaaaaaaattggagtctacttcaagtgatgtattttaatttatggtaaaatatggataatgatgaacttgaattatttatttagttacaaataaaacaacaattgaaacaaactaaaaatcatatactccctccgtcctagaagataagaagtttctagggttggatacgattattaagaaagtaggtagaagtgagtggtggagagttgtgattggatgagtagttgaggtaggtgggaaaagtgaatggtggatagttgtgattggttggaaaaagaatattggtggagaagttgttatattttgggacaaatcccaagggctaaaagttattatattttgggacggagggagtacaacttttaaaattatagtcgttaagctatctgattattgatttttttatatgatgtgtatgtgtggggatgttcatgtgaacacatatattatgtgtgaagggttggaagtgggccttttcgctttttatactgttaagatatcagttgaaaataataaggacaccgtgtttaacttaaaataatcaatggttaggttttgtacaagttaaattatagtcaacgggtgcattaaattctaatttatgattttaatcataaatagcataattacacaaatataacgtataatttggtctgatagaaaaaaatttcataaagaaaaaaaggaagaggggacatctccttttcaaaaagagaaaaaaatcaatcttatcctgcggcttggagtggtgggcctattaattttagtaaaaattaaaaggctagttatttcttttttctcatcttttctaagattttatctaatttattaaagcgccacgtagtatcataggagtatttatatgagcgtcatgtggtggcttagaagtgtttataggaagtttaatggacttttattatataatagatagatagattgattgattgatattgtcgatataattcagcgacacatgtttgtagaattatttaaggtgacatagtatatgttgtcaacttttttatattttaaaaatatttcattgttatatttggctgccatgtaaaaaaatagcccatagaacaacatagatcttgaattatttatttaattataaataaaacaacaacaaaaataagccatgtaactattgaaattggaagattaggaaaaggtagagaatatgagaggagggagtacgtaacgtacgtactaattggaggagggtaacataccagcgaggaggggaggttgggaccggtaccgtgaagagggggattttatttatttttattactaaggccctgtttgattcatcttaagattattataatctagcttattaggagtaagctgaaataaacaagtagattattatagcagattattgtaatctataagccagattattataatctaataagctgctctaaaagagcttttttcagattatcgagtggctaaagacccactactcctacatacttgagaaaaattacccacctatgccatcaaccgaacagatagctgggggcattatagactttagcctttcaaacccaataatccatgcctccaataatccagacaaacaaacaactcacagcttattctatatcagcttattataatccagcttatagcaatctggtttaataatctagattataataatcataagctgaaacaaacagggcctaaatctaatggttgaaaatattggacccaccaatttaaagaaaaatcaacggttgtattttagagtgccacttgacggcttatgagcgtttgtaggagtgacacatggcggtttaggagcgtgtatgaactaattggaggagggtaacataccagcgaggagggaggtggggaccggtaccgtgaagagggggattttatttatttttattactaaatctaatggttgaaaatattggacccactaatttaaagaaaaatcaacggttgtattttagagtgccacttggcggcttatgagcgtttgtaagagtgacacatggtggtttaggagcgtttgtaggaagtttaatggacttttagtatataatagaagatagatagatatatagtagcagatttttttttaataatggattaaaccaatctctgcacccaaggcaaatgtacacaacatatagtactagatagaaaatgaactaaatatatagtactagatagaaaatgaactagtaaacgggtttttatatgctgctagcgggtttgccgacatacatacattagccgtcataggttacaggagcaagacacaaatgatgttcgcggcgcctctggaaaaggtaaccacaggtaattctaatctatcactaggaagttcatcccgttttcattggacactgaaaattcagtctgcgcctgcgtgcatctattaactggcagtatattatatatttatgtcatattttattagacatctttggtgccttctaatctactccttctagatatagagtaatgtctacatttattgtactatgatgtgttatatcctagtacgtacgaggttagtttttttttttttggacggatggagtatactgattctaccgtgcgatcctgatgaatgttcaacaaacaatattgcatcatggtgcatataaagtgcaaaacacgatctcatgtagtttgcgaacatcatgaacatgaaatttatcaaatctcaagtttggcaaattttgtctgccttgaataaaactattatagatatctagtgcacctgtttgcaccggctcgtgcgactgtcgttccttcttactctctccgtccaaaaaaaacttaacttctaggctttgaactttgtcccacaaaaaaccaacttctaccatctacctaccgtcagcacgtaaaagaataagttttattccttcaatagtttttacctacctatcatcattactacttttttcaataatgaggagcattttgatcattttcactctccaataattttgcattgggatgcttgggactgagggagtagctttttagctagaggcgttattgttggagggtctttatcgcggttcaagtgttgctacagttgagtatgtagatgacaattgtttgtggctgtagctcgccgcggaatgatattaatttgctgtcgtcatggctttttctttttttttcccaccttaataaatataggttatgttcatcctatgcagaggagaggattggtcttagattaagtgtattactatcttgttgtaatagtctgggatataaaattcctttatcgtaaaaaaacatttgcaccgttgcgcagattaataagatccttttcacaaaagagctatgaaaataaaaatgttgtacataccataagcttgccaaatgaaaaaaagaaacagctcaagcaaggagggggctatgttttctaagagattatgcaaaccaactcctggaagacttactgtaaagtatttgccatactgcccatatgggtggtttcaaacaaaaaaggcaaaggacaactgttcttagtttggtttgttgtaaaaaagtaagaaagtaaaaaaaaacttcaagtgctttctgaatccttattgtgaatgagcttcatggaaccaattgcgtgttgccacgttaacattgagcgaactcatgttgactgctgagcaaatctggtaattgcatatctcagctaggtcatgcaagatgaacccaaacaatcgttcttccatataagaaaaaaatagtcttatacaatgagagcatattgaaactcttcctattcaggattaaagaaacataccaaagtacattaaaagcttgaagggtacgtggaaaataaaccattgcatcagaaatagtgcccattgaaacattaaagaatctagcttttcagaagttcaggcatatatagcataggtgtaaagtcaaacaaataaatagtaatttgacaaaagaaagatacttgagatgggaatttatcttacaacataaacagatatccacagggaattgcatgagctagtgtaaatcctaatggcctaagctgaagacctggacaaaccaatcacaacagggagcaaagatcacctgatcaacattagtcaatcccgatataaaaataaattagtgttgaactgacgtcggaaaactaacatggtttttttcctcaacaaacttgctggagtaattaggaaggatcaatcgaacaaaccaacgtaatgcagataatcgtcattttgacaaacggtcagcagctatatataaaatcaagttgttgggggtcaaaacatcggcaaggtaattcagcatcaccgaggatgagaaacatagattagtagttgtatgcacttactgctttactgaatcaaagggctggttagcacgctgcttgagcacgaaatcctcctacatgaacaccatgtaatccaaacttgagatgaatgcaaagaaatactgggaaaaacgtagggaaatcatcaaatatgctccctgacaaacttgtgtccggcaacaatgacgacgccagtggccaggaatcggaagggatggagaagtgaatagattgaactacaggatgagtgagatatcattttctaaaaaaaaggatgggtgagatataagcctttattgggtcgtcggtttctggtgatcgatgatcatggtttctggtgagggaggcgaagaggatgcttttcatgacttaatgtcagccatcaagacttctcgttggttggcgtcggcatttgccgcttttcatgatacgtacgtcgaggaagcgagcagcctggaggagtcactagtaaaaaaaacctcatatagatcagcactataggtgccgaaatagctaaaaccggcacctataatgcttttccctcctccatggactcaaaacacgtaaaaccaacacctttaagcaactataggtgccggttctcaagaagaaccgacacctatagtataggtgccggttttttttaaaaaacaacacctttaatataatataagtgtcggttttctaaaaagaaaccagcacctatccaaattgagccgatccaggccgacgcatcggcctcatcctatattagtctcgtccttatcagcctcatcgatctcttagtctctctctcgcctctctcgatctctctggtctctctcgttctctctcgcccctctctctctctcgcctctttgtgtagcgcacggcggcggtcgggcggcgtcccggcggaggcgtcagtggcggcggtgccctcccctccaccggatccggcggggggagacggcgggagacgggaggcagcggcgccctcccctccgcttgatccggtgggagggaaggcggcgggcgacggcgagcgcccttcgctccgctggattcggcgggaggggaggcggcgtgcgatggtgggcggaaccaaggagagggaacgcatgcagctgttgagccgggtggggaaggtgacacagaatcgtcggggagatggcgcggatgagatgggcccgcccggaggaatgcccgtcgcctgcatgcacgcgggagagttaacgttttggcctatcgggtttttctgtgaatagcgtccaggatgttccactgaggggacacgcaggaccatcgatatttgatcaaacggatatggatcaacctgatgtaggcacacggaggaccatccagatacgattgaatgggtgtgatcaacttgatgacgtggagcaaccacagtgcaggaaattagtaagtggggataatttgtatagatatataggatttcaggcgaacatggggtgatgagccacaacctatacatggcctctaaggccaaataaacgtacatatcttaattagtgctagctcttgaatatggagaaattatgtgattaattaagaccttctaattatctgacaatgagtactatatcatgcaatttaatgcaactattttaaacacaagacatagcttcaggctttcagccaacgaggttttaccttatccctgttttatttttgtcatttcagctcagtacacagattagagatgtagaatcagccaagtacaagtggtccaatacttttatgtgttcatttgttagaattaatgaatcttttttggtatcataaaggcagcgagagatatatatgagaacagatgacatgtatatatatatctcacagtttgcttcttttgttctaggttttagtttcgccattaattctcacaaaccaacatgtgtttcttttatttttttggactcatgcagtcatgctggatgtaggtttgggaagcattgggagattggtacgtgccatcttggctcgagtgatgccaccactccgcgacgactactcctgtagatagtgctgaaatcggagggattgattgtacgattgcacaccaataagtaagccaaccagagggggtaattcgttgtagtactccaaaaccaaaacttatagatgaattaaaagattcccttgaatcgatgaagatcggtctgaccggagttgatgcaggtctgaccacctagaagccaccagtctaactggtgtagtagctccggtttgatcgtcaatcaccggtctaaccgccgttcactcgccgaaacctaagtaaacacaaatcgaaattctcccaaagtagattgaactttattgtttctattcgtgtttataaaatgcaacaacaacaatacggctgtcatttttttttctaaagtaaaatatcattggcagtgcgaacaaatatgaaagtacatctgaagcaaaattcaacgatactatttttatatcactaaattttatattgttaagctaattgctagttaaaattatttgaaatgaattgcatgctgtttgggtcaccttttattaccaacactttggaccaccatttattacctagtgcaaagtgaaaatactgtgcaaattattgtggtctaaagtaaaaaattggtgataaaattttgtaataaatggtgaaccaaattgtagttcactctgaaatttatagactttgactcttgaaattgcgtgggcaccttgtattttctagtggaaggagtagtattatagttctttttttttgaaatttccccaaaatttctttattatttcaaatttgaattggatcgaaataatttcgatttgctagcggaatatattcctagaaaggccaggtatcacggctcaccgtggaaaccggtcggtatttaccgaaatggtgatccttgactatttatgaaaactattatttgcagttctactgacacattacacatggcctctcaaaaaaggaggacatattacacacatgacaatcgatgcataggttcatatgtaccttcacatatgccatggtcttatagtactgaacaaaatagtatttgaacacagatagctataacataacgtggtctagaaattacaaaagatgaacaaagattatctcaatatcttgtctatcacaaatttctttgaagcaacaggtttgggaggtatcaggaactagtgcatctgagctagagagatcagagaacattcttgccctccaattcttgcggttcttggcactctgctcacactggaaacaactgtcaccgcgcattcatgatcactgacgtgaaagaggaaaggattgcacggctaagtgagaagatccaccgatgaaaagacttgcgtgttttcgactcatccatcggcattggagctacaaagagtaagcttgatggcaaacgtagcaacagccaggacataattaatttagatggagttgttcagaacatggttcagaacttcagattgcccacttgacattggtaccatggatccctcccaaaatggtttattatcaatttaattttctcctcatttggttgaaatttgttggaaactcattcaaagttcaaaatcgagtgagatatcaacatcacgtatggacttaaatttcaaaaactgatattgtgaacctggtatagagttgactcaatggatatagtcaatgtgagagaagcatgaaataattctctcttggatagtctctatatctctctatttgtgctatgtatgtagtagtattttctcaataaataactgtaaaatcaatcataagcaacactttaaaatatcctatatatattgttatcacaatttttttgctattaccaattgaagtaaaacttctcgtccataggttaattttttctgatggatctatcatggcatgactaatgcgagccacagagctactaaccaataatttcatccctctggcacatgcacatgccacttatagataaaaaagaagaacatataattaatttgcaaaaaagatatcttgtacattagtgcatatacatttaataactggttgctaacatacataacttggtccataaattggccttgcaaaattgcacccattgttgacttaaaccgggagacgtttatccaactgggagaaggccttgctacgtctcaaaagctagctaaagaggtgagcgacttcctccacttttaacctgattcaattcttcataaactattaatgtaggactattcccgacaccactaataagtactagctagtagttgtatttttaccgtctagaacacacaatggaagcatgatgaagatcattggtgaaggatctatcagggataaagctcttgacagatattctttcaaaaaaaaaaagctcttcacagataaactgcacgcatcaccaattcactaatgtttccgaactctgaaacagtaggattggaaggcgctgggaactgctgcatggacctcatcagttcatcagggcatccttggcttcttctgtcccccaaatttccagttgaagggcgaagaacctacaagaaaatctctggacgatagcttcaggtcccgtcctgccaatctgcatgcatctctgattctttaccagaacgcgtatgttttgaccatccaaagttcctatgcatttgatgtgtttttgaggacagtcatgaatatgaacatgcatgtaaagtgcaaagcatgtcctaatgtagtaacatcatgaacacatgaaatttagcaaatcaggttgtcaatttttggctgccttgaataaaattattatatctagtgcaccgctacaatgatggcgtgtgcacctgttgttccctgtttttggagggccgttatcgtggttcgtattgctatagtgtggatgaaaatcacttgtggttgtagctcgctatggcataatatttttatatttttaattagattaattttatcatcttgatgtattgtctgagatataaaactttctttatcttaaaaaaatatacactgttctgcaggtttaataagctacttttcaaaaagagctatgcagatccagtgatcaactggtattaacaatttgtaaccacaataatgtacatagcttaattagtgctcttgaatattgagaaatgatgtgactaattaagataccttcttactttatatatatgacaaggagtgctatatcgtgaaattgaatgcaactattttcagacaatttcatgatatggtttgtacgcaaggcgtagcttcagactttcggtcaatgaggttatgccttatcccaattttcattttacactctagcatacaaagtagagatgctgaatcagcctagtacaagtggtccaatacttttatgtgctcatttgctagaatgaatctttttggttggtgatcataaacatagagagaggccaatatatatgagcacgcatgtgtatccactgtttgcttatttgttctatgtttcaatttctccaccatcagaaaccaacacatctggttcttctatcttttggactcatgacgtatgtaggtctaggatgcattgggagattggtatgtgcagtttaggatgtcgactgatgccgacactccgtgacaactactcccattgatagtggaagtcagaggcacaattttaaggaattctatcagataataggatcaactgcattgaagcagaactcaagaacatgcttactctttaattggatcatatatatcttttgtagatagtgtatgctgtggttgtaactattctattttttttttggccttgtggtccttgactttcactcactcactagctgtatcggttgataaagaacacaaaatagtagctaaccaaagatgcaccgtatcactccttggccattgcgcatgcacatgtagacaactagaccttttaggtaagatcaatacaagtacttttatagtactctgaagtcactacaaccaactctagatctgtttcctttatccacaaggtcttaacacctgagaacctacttatccgacattggtcgtgcaattgatatgttccctttgctaaaatctttcgaagacatgaataatctttttagggactgcgcctactctagaagagtctgggatttggtttcataaaaaaaaatccatctaccacgctgaggcagactcctctataaagaactcgatattcaaactaatctcgtcaagaccatcacagcaagcaaaaagaagtcttggagctctactcgcttcctggtgcaacatctagctagagaggaatagaaggactttccatggtgcaaattgcgatgagatggaaatagtcggccacattttagaggacttagaccaatgagctttagcttttaaacctccgtaaaagcggtgttattttccccatgtaacctctcaaaagttgtaacctcctctattctcccttttcccagaaccttttgtacttctgaacttttacttctcaatatatccggcagagctcctgccgtcgtcaatttcaaaagaaaaaaaaatattgagcactaaatccctttaggtccaccgaatcaaaattaggaaatacaaagctgccgcaaaagctggatagaggcaaataatttctattttgaatggtagaagtagaggattcataattgataaacggagatgtgaactgtgttagctcaaaaacatatccctaagatatagtaacgaaacatagatgatcatcttacaggtgaaaatcatctagaacttaatgtctttagtgctctactttctacccaatgtgacataagtgtcgcatgcatgcctaaatcatcctgcacctgcatagtgtcctgaaacaccaatcaggtttgtagatattatgaatcttaagcaattctcatcactataaaaacgtgaacctacatttcttcaaagaatcagatgaacacctactctcttgattctttaatagaacaatacaatttctaatggtaaggtaataatatatcctagtttgtctgatccataaattggctgcggctcaatggctcccctagtattagctctgtacacgtttacgcacacgttgtaaggataaggaagatcatttgatgaaggatcaacgatgaagttcttcgcagatgaactatcaccaattccctgatccgtcttaaaccataggcttgggaggcaccaggaaatactccatctgcttgacaaatagctcgtgtttttcttggctcattctatcatggtagttactctccatcggagaagaacctgcacgaaaatcttcagatgatccaccgagtgcgaaaactgattgccatagtgttcatggcaaccgctcatttggcgaaattgtatctgtgattcttcacctgtgcatttcacgcatgtggtgaatttcaatgtgcttacgtttttatgttgttccaatatttttcttctcacactccatacacaaagatgaacatttctagttgctgcagagatatacttccattggctaaaaacaaattatacttagtttgcacccctagacatgcattcaaggtcatttctagttgatgcagagactaggggatatacttccatttgctaaaaataaattatatttagttgcaccctagacattcaagtccagctagagccataacttggtccataaattgcccatagcccaattctgccccttgtatttattgtgcctttacgttttggagcagggagccctgaaacaacactcaggtatagcaccatttttttacaaatcggtccttttggaaaacttatttcagaactagaccctgctaaaatacttcaaccataaataggccacgctggcgcggaggttagatggatcagcaccagggacgttggcgctgaccccatgctaatgcggcggctgagccgattccctcaccagcgtggcagggctcaacgccaattactctaatgctgagctcttggacttagccactcgcgacggggccgccaaacatagctcctgtgttgagtggtgtcacaccctgaagttctcctcctaagcctaaaattgaatttataaatcaccctaagaaaatgccggtgcaaatcaagagaaaaccttaataaattaatgcaaataataataggaattggcatgtggaatttttcttgagttctacatgtcgaaatacgctaacaagatttttagtggaattttcagagctctcaaaataattttaaccaattaaaattgagcacatgcaattttaatcccaggaaaaatcctttttccttctttttcctttttctttcttttcttttctctttttcctttgaatgggccgccggcccattcctcctttttctccccctcctcccgctgggccggccgaaggccaaggcccagctaggccgcgcgggccggtcggccgcctcctctcacccgggtcgccgacaggtggggcccacctatcggacccgtctcccacctcgcgccgcgccgccgcgcccacgcctccgcctcctccgggccacatcggccacgcccgcgcatgcgccgcaccttccgcgcccactcccctctctctcccacccgcgcctgcgcccgagatggccgggattcgattttcgaatcccgcctctctctcctcccccactccccgcgttggccggcggaatcctgcccctaccggccacatccgggattcccctcccctatttaagctccgccgtcgccccctctctctttttccccatttcgccgaactccctcgtgccccccatcgctcccgcgccgtgcaaccacccgccgccgccgcttccgttactccggtcgccgctagccgccgctagggtcgccgccgcaccgcgccgtcgctgccgtcgggttcgcgaggccaaactccacctcgtccgccccttccccgtcgggattcgtcgccggaattcgcatcccctcgcgctccggtgagttctacctctaccgccgccttcggccatggatgccggccgccgtggttcatctccctctctctaatctctctctcctccttccttagggcaccccgaagcccgtccgccggttgccgtcgtcctcccgtggctcgccgtcgccgttcgccgtcgtcttcctccgcgccggccactctcggtgaggcatccctctctcctctattcccctccctctccttcctagccgccgcttagcgccgccgccttcacgtcgcctttgcgccgccgcctccgccgccggttgccgtcgccggcaacgcgtgcgcgcgcgccgtcgccatcgccgtggccggtcggccggccttgagccgagccgagccgggtcgccgccgcccgtccgatcagccccgggggcgatctgggccgtcggtcccgtggaccggcggtggaccacccgcgtggtcccggtccacggtggaccgcccccccttgagccgctgccgagtggggcccgcgtgccggcgccccttttccctctctcccgagccgctgaccggtgggccccgcatgtcggcgccgcgccccccttgatgacgtcagctctgggaattattgcgcaataaattatttaaggactttctgttatagtaataaacatagtgaatcttctaaaattcataactaattcatccgagctccgtttaagcccattcaagtctcagtaaatcaagaaaaatgcgtagaatccattaaaaatggttttgttctctgtttcagtagtcttatagcctgtttgtattgtttgctttgtatgtcgcctagattccggttcttccgacgctccggtgtacttcgagatagtcgccgaggttcttccagcagcagagcaaggcaagtcatgcctgtcacttgaacatgttgatcctatattgcaaatgctctattgtttttcttcaaatactgcatcgttttataatgttactatgggatgtttacctattgttacagccatgctattttggtaccctgctcctttgttagctcgggttataacatgaatagacgttggactaggagttgcttagccatgcttagttcaactagcacacaatgggaaaatctcatttaaaatatagactgtaggttcatatgataatgttggtttagtaccaccgctttggtgttggttaattaaaatgaatcacatagagggctatggatgcatggttttgcttgttgcacccatagcaattaaggaccgattcgcgggaaaccctggaagaatttatcgtgcttaccacaagccagcgtgggcaacggctgggcttgtagtgtagcttttctctagctgacgcatccaggcaagggtgggcgtgatggagtttggataggtcctgcgacggcctatgcggcttccggattcacgtaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtttagtcttttgaaattggatagtataggtggatggttgggcctgtcgcaacgtggtatagcgttggacagtggatgattaatattgattaattattacgactgttttcttctttaaaacttctatttataaatgctcgctttatgcaaatgaaccactctagctctcctttgataattccctgcatcatacccctattccggtatgacttgctgagtacagtgggtagtactcagtcttgctctattttccccaaccccagagttcgagtgtgtgtcagatggaggtttctccgaggagtaggcttcgtccgtgccgtcgaggatgcctgtggagtggtgttcccgttgcagttctagtcaaggcttaggtcctgttgtctttcgtttttccactgcttttatgtaagacttttatgatgtttgtaagacgtggatctgaatgtcaacattgtcgtttgtgtaccccggccggtcctggacggggattttaatgcacattctgcttggaattctatttgggaatttctgggcgtgacaagtggctcggaggcgatgggtgttaagccactaatctccatgccaattactctgacgctaagccctaggagttagccgctcatgaccgggccgcccaacacaactcctgtgttaaggcagcccggaggcgctgagcccgcaaacctccacgccagcgtaattggtgctcaccctaaagacctcggcgcaagctaacttggcactgagatttgggacttagcagctcgcccgcccaacacagctcctgtgttggactttgtcttgagggttcagcgccaatacacgtgttgctgaggggaatcggctcggccgccatgtggacaggggggttagcgccatcgtgcttggcgctgaccaacgcggttggcgctgagcccacgacctatttatggttataatttgcaaggtctagtttgaaaataagttttccaaaagggtctatttgtaaaaaaagagggtatagagcactataaaaaagtgaacctacacttctcaaaaggatccgatgaacactacattctctcgattcttcagcattacaatttccaatatatgctaaggtatcatcctagtttgccttgtccataattaaattgggcatggctcaattgtgcccatagtattagttttaaacgtttatgctctagagcacataatgaaaggataaggaagatctatgaagaatcaccacatgtacatcacaattcgccaatatatatattctatctgaaatcgtaggcttggggtgcgttggaaactactccatcagtttgaagagagaaaaggggtattcttggctcgttctgtcctggaagcctgctttggatgggagaagagcctgcatggaaatttccccgagatggatcgactgcaaaaactggctgccatactgatcatatggacatagaatcgcttcaggtcatggtcgagtaatatgcatcttcgatatgttatgtaccttgtcaaccttgtgcatttcttgcatttgggatcatcgaatgtccaatatatgcatcgattgatcttccaatgatattcggtacgcttccgataaagttaatcacagccatcattaggatgttcgtctcgccccattggacatccagagagttcggggctgtgatcatctcttaattggcagaacacttacagggtttacaatttcgaaatggggatttttgctggggcctccgaaattaccgaagtttcgggaattttggtacttttttttgctgaaattatatgaaaatttgacaaattttgaatgaatttgaataaactttgaccaaattcataaaaaattggaaaaaaaacgaatgttcagtaaacaatttaatttgcatcatgaacaaatgcatgtattaaagtggaaattgcagaccacaacctgctgctgttacatggatcatcaattcttgatatccacaattaaagatggccatgcttatcattaattgttggtaaaatacatagaccaaatgatatacttccattatctaaaaataaatcacacttcattaatttgcaccctagacataaaggtcagagagatacaaccttgtccataaatcaacaatggtcagattgtgtccctcgtagtactagtagtagataatttttacttcttggataattaaggaagattataggactaaggaatcattgttgagctgtatgtgcatcaccaattcatcacaagtctgtctgaaatcgtaggcttgggaggccctgggaactcctgcatgagccacagcagtagtatgaagaattcttggctcctcctgtcctgactgaacctcctgccacgcacaagaatctacaagaaaatttccagaaaacaccatggatgcaaacaatggtttgtataatgtgcaacattaaccccctgaaggcttcatcagtcgatttccagatgactaggtagccatcggctcctgcctatttcagggtgacagttgttcctgtgcatccaatgtgcatgcatgtcctgcgacagttgttctgtatatgtgatacactgctacatatgcgtttacgagtgcaaagcacaacttggtgtagttacttacatcatgaacatgcaatttggaaaaacagggtttgacaatttggctgccttgttgaacttagttttctagggctctcgttcctcttactccctccgtctcaaacatactttgatcattaatttatttcatattatgctatcaaacaactataaaattaatatcacacaaaagtatttaaaatacaaatcaagtgatataaaatatataatacttagcatagatattgctagtataattattagtcaaaatttactttcctagaaacaagggcaccctgtaatttgggggcggatggagtaaataacaattaacctgatgggtcaatcatagcatgcatataatgctagccacagagctactaacacattattacacgtgccaatcacacgaataggtgaaagaaaaacatataatttattttcacaaaaaagaaacatatacataattaatagcagctaaggcacatatataacttggtccataaattggcctttgcccaattgtgtccctgactagtagttgtacgtttatgctctagagcacacaatgcaaatacaatgaagatcttctcaggaaggaccatagatgaaactcttcacagataaactgcacccaattcatcagtcaaattaaaattaatcgtagtcttgaaaggcaccggggactgctgcatgggcctgaaaaatgcatctaggtattcttgcttccttctgtcctgtctagttccagaccaaagggagaagaaccagaaaatctccagatgaagaacctgatttagaaactagttgccaaagtgcggatggcgaaagcttctgccccagttctgcgccaacctgcatctccgattctgcagatttctttttctttttttttttgaggtgaacgacggcaagagctctgccggaatttcattagagtagagaaaaacagttcagagaatacaggggaagacatcgaaggaaaagaagggagaaaccggaaaaaaacaaagggaatccgaaaaagaaaagacaattaggggggttggaaagcagtgtgtctgagatcaaattcctcctttactattctcgcaacgcgatcctctgtgtaagagatgttttgaaaaattcttctgtttctttccaaccaaacgttccaccaagtggcgagaagagatcctttaaccctgaatttgaaaggtttggggtgtagttgattgagatcagcccaccaagctgcgttgtcatctgcaggctgtgcccccgagatgttttgccattggcacaccataagccaaacttttctgaagaaggggcaaacatttaagagatggttagtgtcttcaaacgcctctccacacaggctacaaatccaattgcaaggccagtgccggcgcaaaagattttgggccgtgagagttttttggtgaaggattagccatccaaagaagcgcatctttggttcagctgggcacctccaaatggaatgaaaatgaatcgaagagaaggacccttggaattgaaataaataagcactgtttgcagagtaggatcccgattcattcaggttccaaatgatgctgtcattggtttgcggcagaagctgaacattttgcagcaatatcccaagctagacaagatcgttgatttcttcaattgtagtcatttgccgaaaggaaaggagccaagaattgtttgtcaattccgttttaaccgatctctgtttgcgcttagctaggttgaaacacaagggtgcaatgtcttttggacatgcattttgcagccacttatcatgccaaaaatttattttttctccattacccacagttatcgtagtggcagcttgatagagtcttttgtcgcagtcatcgcaaggtaaatccattccaacccaaggcttgttgtcctctttccatttgaaccagagccatttgaaccagagcgcgagaaaatttctcaaggtctgtgtaacaccctgaaaattcgaccgacaaaatcaaaactctaaaaatacggattttcaaaaactttttaaactaattgcatcatgccgatcttattcgtctattttatctggatttgatctcgaagattattaatcgtgagtaaagaatagttaattaggaataaaccttaaaaacaaattggtaaaataaatacaaattaaaataaaggttaggtgggggtagaaataaataaaatattatcgcgaccatatttggattaattaaatttaaatgcgatggaataagaattaaccctaattaaaactcaaataaattatataaaaataaaatatgagtaatattaatctaggataaattcattagttaagatggcacaaatattgagtatacttcatttatgcaaaatttgggaattatagaatcaaatttaaataataaatgggccaaaaatcgggaaaaataggaaactacactgttcattagcctctaggtgctcgacatggtccccctagccccgccccctcccgtgccgcacgcgccgcccacccgcgcgccgcccgctcgcgagccgctcgcccgcgccccgctcgcccgccgcgccg

SEQ ID NO: 75993 - DNA, 83247 bp, Oryza sativa
  unsure (1)..(83247): unsure at all n locations
gattgggggtagttcagtggcatttctgtgtaaataagttaaaaaattaaagggtagtgggtcttttggggtggagtggagctgtggagcagcaaaaacccagctccacccccgtagttcattttgtaggagtagctctgctaactccgctcccaaaaatagaggatctagactgtttggcacagctcgactctaggtaagtttgttgggagctggagctgtgccaaacggggccttacttgccgtaattactctagtgggcattgcagtataactatcatcgatgcaacatctaaactctttcgtacttgtatttttggcaggaagcggctgcaattgctgcagcagaggtggcattcatcctgcaatcagcccaaggccatgcccttcagttcaccatcgctccagactcccccgccactccacagcatgagccacagcagcagcagccgcagccgcagccgcagcaatagctagttacttcagtagcgtctctcaactactgactcgcacatgcagaagaagaggatacctcagctagtggccgctttgttgtttcctgttgcaactggcccagggacgctaagaacctggcctcgccttgtgtggccgggtagaaaccttgtaaaacgccagagattcatttgttgcaagcgaccgcagcttaagccccgctacccttcgatttgtctctgtgtaactcaagcattgatttattgtaaatttgtcgtctgttggagtccatttttttagttcctttgccaagtgttttactgccatgtacagtattattacatgggagcttttatctttcaaagaattaatctgagtgagtgtgaaactgttaggctacgtttgctgagaggttaagcccctgtttgggatgcttctggcttctgcccccccgaccgaatctagcttctcagcccaaagtggatctctctcccgaacaagataatcaggttacatgacctaaaggcgggtttggggaactcagatcctgcatttggcagctagtatggtcattatgttgctgttgtgctaaattaggacgcatcagttgttacttggtgctcgtttaacttattccataattttgaaatgttttcatcggttaaattaatcctctttggctggtaataaactaccctcattttctaatttttcctaatcagatgggtatgattgtagtatctatttgctaaattaaattagacaagtttgatatggttgtagtcacagctatggcaagattcttttctaacaaactagattccacacgttattgactaacaaaacgtgataagattttcttatacttactaaggtgtgacaatatttatgggtaaaagtgtgacgggaaccaactacatgcttactccatcccacaattcatttgttttaaagttgtctcgtttgtccagaaacaagttcgttcttagcaatcggagtttgtgaaattaagaaataatatgtatcgaaagtagaaaaggtggaaaatgattatattaggatttgacagagcagtggcattctagctttttttattgttatgtataggatatatggaaaataaacttttttttcaagacaaaaggagtactttctacatacttcatcagtcccataaaaaactatttttatgaaaccaaggaatgtgatatatcatagtaatatgaatttagatattgtctagatttttggtattaagatatctcatatcttgtatttttatttgtttatatagaagaaaatagtactccctccattccataaaaaactaaataaaataggatacgacgttctctattacaacaaatagactctagctgtgtttagttcctttcaaacttctaaaaattccatcatatcaaatgtttggacacatgcatgtagcattaaatttggactaaaaaacaattgcacagtttgcttgcaaattgcgagaggaatcttttgagcctcgtcatgatttgacaatgtagtgctatagtaaacatttgctaatgacgaattaattaagcttaatagattcgtctcgtagtttaccggtgaaatctgtaatttatttgttattagtctacgtttaatactttaaatataaatatatgtttatatacttaaaaaaaatttgaaaagagctaaacacggtctcttctctatatagatttagtgtcctacagaacgtcgtttttttttatgggtggagagattgagagcaaaaggtagtcaacgtgtaagctacatcacacgctccaccctcgcgtctcgccacaagaatcgggtaggcaggaaaaagcggaccgtgaccgcggcagcagcagcaggaggcagggatcgggatctggggccccaaaagccgcacgtttcgccccccaccgacgtatctacgtgcttccccgtcgaccacccccatgggccgtggccctccgcatccgcatcgcgctttgcgctttgctctttgcgtgggccccgcaccacgtcaccccgtcgcatcgcggcagcccacgtggcagtccacgcccccaatcggccattgacgtctgggaatttgaagcctctcgagtctccactcggtgggtttagagcaagcttaatacggagtagtgtagtcagttactccctccgtatcataataatataaagaattttgagtttttctttcaatgtttgaacactcgtcttattcaaaagaatttaaaattattatttattttatttatgacttactttattatctacaatattttaagcataacttttcgttttttatatttccaaaaaaaatttgaataagacgagtggtcaaacgttgcaaataaaaactcaaaatcccttatattgtgggacggagggagtactaacttctaatttctagttaatctaataatcaattcatataatagttagctataaatatatattatatcattaataattagttccacatatcatacacacggtgttttgttttagagttcgtactgtagctggctacaaatatgtaacccgtttctgttctatctcctctcttatctcctccacgtaagtttatagccgacttattatttattattgtacgtactcttaaaactaaaagggagaatagctaatatggtccctaaagtttcgctcctggatcattttagttcttaatctttcatattgtaatatagtccttgatcccaccaaaatcaccacatggacatgccatgtcaccttcctatgcaaaatctatatgatttgtccaatttacccttacgcataggtaaataaaaaacaaaagaaaaaagttaaaaaaatatatatggtacatgtaagagcaaaaatatacctcaaaagggtgaaaaaagaagtatttttttcctatggttatgtctaattcactcttatatttatttttctatgatatatgtaagagtatattggacaattcattatagatttgcatgaatgatgacatggcatatccatatgatgattttggtgaacccaatgactattctaggccttatgacaaaggttaatgatttctttggaccatttaaaaggttagggactaaactgatcctacaaagaaacttagtgctattctcccaaactaaaaaaaagagtttagaaaaataacgagaatttgttagaccacctccgtggccgctcttctcgcgcgtgcggcatgggtggctgccagtgccgcggggtcacgtcgcgtcgctctcaatcccgagatcgcggcgggttcggcttggcgattggagaagaagaaaagaaatggcgccgggtgcgtggaatatttacggctgagtccctggtttgtttcatattgttaaccgtgacctttggctaatactagtttttttctttctttctttgtttcgagttctcttgctcaggagtgggcataaaaaaaaaccaagctgaaagaccaaatcgaaaagacctgaccaagaccgagaaattcaatcctagatagtgaaagacggaattttattcggtttgtctccccagctaaccgaatagaccgaattaacatgaaaatgctcaatgcaaactacaatccactaagttcaataggattaaactctaatttttcatattcctactctttctaggcatgcaaccccataagagtctttattcagacgtgcttgtgaatttcttttttgtgatttttgtgttgaaagatgctatgatttttttccatgtatgaaactgctcctgaatttcgggtaggaatgagaccgaatttgctagttttgatattttttgcgttgaaatttggtcttcactttttaatgaccgataatgaccgaatagactgaaagaccaagacctaaattttcggtctgaccaaatacccacccttactcttgcgtggattcaggtggacaacttcgcattgcagcaaccgtattcaagctcttgtgccaaagaatttcgatggaaaaaacaccaactctatggatatagtttcggtgaaaaatctagaataacatcgtctaatcctaatcttggtgaaatcttgttcctgccttctcacctttttatatttaagggtttactcgcttccttacagttccgaaccatttcaaattttggtaataccaaaatttggtgagacaatgaactataaacatgtcactgccaacataatcctgttaatttttggtaattatgaaacttctactctcaaaactacttttggccaatgctcccacccttttgtctaatgctcaaacatatatttttgtggggaggattaattcctccatagagttgccttagttgaatatatattgcctcattaattggtcattgatgaggtggcatttaggcagatgaaaacaaaaaagggaaaggatgaaaaccccaatttccagccaatgaatgctcttgctggacgccccacttaattatgaggagtgacgaaacactgcaagctgatctttgtttcctgattgatccatatccaatggcgctggagtcgattccgcttgtgtatccatccatttgactcccaaacaaaaaatagatagatcaactccacttgtgtatccatccatttggcttccaaacaaaagatagatcggtgtagacgtgactaagctcgacaatgatgacacgattgttgcgggatcaaagctttcgtgttgctttgtgataagctcggcaatgacaacctacgtttgggctctgtttattaccggtcatttggagggatgcatggtgtgtgcggaggtgggtgtgccgcgtttgttcagacagccatgagattgaccatactttgctttgtcgagttgtttatttttttttcttgtaacccatcggaattttactgttttggtttgtctactatataaaaacctctttcctctcataaaaaccatccaccctcaaaaattcatttctaaaaaaaagattgtaaaaaaaaaagaaaaccaaacagcctactagatccaaatctcccactaaaccgaataaaaaaaacagttacactgctagttaaaaaaagaagaagaaagataaacaacggatctcccaaggtcttcaacgtaaaaccgccaaaccgggccccacaacaacgtcacaattccacatcccaccgtcactgacaccccggccccacccccagtcaaccacccctcccttccctcccccaaacaccacggaagacgaaacaaaccaaaaccaaaaccaaaccaaccaaccaacttgaaacctcccatctccgatccccacgtcgccatctccccctccctcctcctcctcctccgcctccttccccgccataaaacccaacccccaccaccactccatcgccaccaccaccaccgcgccaacccttcgccgccgccgccgacgaggacgacgacgacgatcgaaatggcctcctccaccaccgcctcctcccagctcgccctcgccctcggcatccccggcctcggcggcctcctcatccccaccgacgccgccgccaccaccaccaccaccgccgagggcaacgatctccacgccgacgcctcccaccccgtcctccgcctcgccggcgccgtccagcactacgagtggggcggccgtcgcgggtcctccctcgtcgcgcgcctcgccggcgagggcgatgatggtgatgagaggccgtacgcggagctgtggatggggacgcacccggcggcgccgtcgtcgctggcggcgtcgggggagtcgctgagggagtggctggggaggcgcggccccgccgcgctcctcggccgcgacgtggcggcgaggtggggcggcgacctcccgttcctcttcaaggtgctctcggtcgccagggcgctctccatccaggcccaccccgacgccgccctcgccagggcgctccacgcgctccgccccgccacgtaccgcgacgacaaccacaagcccgagatggccgtcgccgtcaccgacttccgcgccctctgcggcttcgtctccgtccaggttggttttccaccacccgcatttcgctgattaatcactagttctaattgcttcttgatgcactttgagatcgaatttttgatgataccattagttctgatgttgttgttgcgcatgaattttgttagtttggttggttgaaattgtttatgagatgttgccagcagatcccatggatgattcctaatgggtaggtgggtgtgaggggcggagttgacttatgtcgaaatcgaaatgtcaagtggggatctggctgctgatgaatttggcaacgaactaatgattaatgattaatgggatctgtaattatcgaacgggcaagtacttactgacagcccaacaacctgttaatccttcgctaaaatatcgtcatctataatagtagtatataatataccttcaaactttttattggtttcaagaaaatgcagagaagatgaggttagaatttcattttgtttttttttttagaaaatcacacgcctttcatgaggtactgtggtccagtgcttcacaaacagttgatgctgtccaagtatccagcaagctgcaatggattatcccccaacgccaaaggcatcattttattgttggccccatgtccatgtatagtgtagattctgtccaaatcacatccagcgatgcgtttacaagtatggctgcttaggtaggtgggagccgtttcgtggacagcaattggaagtatggcttgcttactagcttaggtaggcagcaggcatttcgtggacagaaaaaaagggtgttgttcaacagccgtagccaactgcttattattctgaacctcatatgttgcagtaatatttccctatttgaattgcatatgcatcaccgatggacaaataaacaagggggggggggtaatatgctcatatttggttcttgtacaatgtttactctgaaattcagattctggttggttagcatgtgacttaagtaattctagatgtacaatgtgtactctgaaattcagattctggttggtcaccatgtgacttaagtaattctagatgcactccagcttcattgactggtgtttggctagatgtatcacatctttattgaccgatatttagctagacgcaatgtgtgactagtttcagagtaggaaacaaggtataatgaagtatatagaatacactttcaatataattcttttgtttaaatccttccaatttttcggaaaatagattacaaatgctatagaatctcattgttaacaatatgggctacatagtaccttggagcttttaggactctaagcattgattacctgtaaaattaagtactgacctattatactgcaacccaggagctcaaggatgtcttgaggactgtacctgaggttcgagagttagttggcaaagaagaggctgtgaagcttatgggtgccaaagagcatgatggaggcatcggagtaaggtcatatctgcaatcagcttttactaatttaatgacagcaagcaaagaaacagtttctgaagcagtctcaaagctaaagagtcggctgaatattgagagtaaggtaaactattctcttaattattcttgacagatgtattatttatttcacttgcctataatctgtgtcagctgggatgtcaatatcagtttgttccttcgtcgtacgctacgttttgcaaaatgtttgagcttctatctgtcttcttgttcatttctaaatgacaaaggaagactttttaggaaaagcatagttgttgctgtccaacttttttttttttgggaatattgctgtccaactttagtgccatataatccaattgtgtggttaagatggagtgtgatttgacctcatgtacttggggctacaagacattgtgtgtgggatactacctcttgaactcataggctttgcagcaccttgtatgacagattctggtagcattgggctggtttaatttacaacatggtgaaatgagggtcttaaataataaaaaaaagtaaggcaatggttctgattgtgagctacctcacatttctgctttctgaaacccagttcctagctctgtattcagaatttcagatatggcagcctcatatctgaggtaggatcagcagttcagcaacatgttacatgcttacacaaagatattgccaaacctgatattcctttttgaggagattcaagcctgatattctgcaattgaactgttttgctgttaatgttcttttcaggttagaaccttgacaaagaaggagcagctagtgttgtcactggagatgcagtaccctgaagatgttggtgttttagcagcattcttctttaactatgtcaagctcaaccccggtgaagcactctatattggtgctaatgaaccacatgcatatctttcgggagagtgcgtcgaatgtatggccacatctgacaatgtagttcgtgctggtctgacccctaaatacagagacgtccaaactctttgctcgatgctgacatacaagcaggtttgtttatctgatttcttatttatataagcatcacctatattctgttgatattcgctgttatctgattatcgtctattgacaattagtgtttctaactcttctgatgctacactaatcaagtaatcatcattgattatgttactactactggtatggtagaattgcttgctcacttcataattaagaaaggcgtatggtactactactgttatggaaaaactgcttgttcacttagtgattaaacaaggcatatgtttctagaattgcttgttcacttcaaaattaagcaaggaaaatacttccttcaaacatgtggagcttgattacacgaacaaactcagccagaatgttcaaatatactccagaaaatcttgtgctctttattccgtattgtaatataacttacgatcttccttatgcagaactacccggagattctgcgaggagttccagtgcaagcatatgtaacgcgctacatacccccatctgaggagtttgaagtcgatcgctgcctgctgccctccggtgaatcggtcaccatgtcaccggtgcctggcccatccatcttccttgtcatgacaggggaaggcaagattgaggcagattccatgcttgatgaaggaaaggcaaaggaaggcgatgttttcttcgtgccggcgcacaccgaggtcaggatccttgcttctggtcctgggagcatgcagctttacagggctggggtgaacagcagattcttcagctgacttcaataacaccgcaaatcttcagggattaaaggttattgcgagagtaattggtaggaaaacgggtgtcttactgtcgtcctttcattttatcataaggtagctagttaagccatcatagtgtataggcaaatggagataaagtctctctctttcatacccttaatcctgtttatttttttccccaatatgtaatttacatttttcagtacgctggaagcaaatgaaatctgtagatgagcttctagtttcgattattcattcatcatgtacatgcgaaaattgaagtttgctttggatatagaataactaatatgattccttcgatccttggctagcggcagaatattattgttcgtgattacatgcgaaagggatggtgttggactgttgagaggaatggctagctgcagagcctctgcctaaaacgagagatgattgaacaacattagctataaaagaactgcaaccttagctattccagtcatactaactttagacgtagattatcaccggaattatgactcttattataaaagcaattgattaagatgttgagttagctgggaatacatattctttcttgattcttgaattaaatttctgatgactgaaatttctgctgttttttatgagtagaaatgctacctttcatcaaaaaattttttaaaaaaattgattgccttaatgtttttattttatatagttttcctcaaaaaattaagaattgattgatttaatgtttttatgagtagaaatgctgcttttcataaaaaaaattttaaaaaatgattgccttaatgttttttattttatatagttttcctcaaaaattaagaattgattgacttaatgtttttatattatatagttttcaatacttctaacttagaattgatgaggagtaaaatgaaaaatgtttctgctcttcataaaaaaatttgatttactcaatgtttttatattatactcccttcgtctaaaaaaaccaacctacataaggatgagacactacatagtacaatgaatctgaagctagtgtcccatcgttttctaggttgatttttttttagacggatggggtatagttttccgtactagtatattatatagttttccatactagtatcttagttatatagaaagtgaagaggcaaagtatggtaggagtttataatagatagcgagaatgtacattacgttagctttttatatcaaacacatatttgtgttttaatatatattttttcaatcatattgaatatatttgtgttttattagagtgagggacaatacttccctatttcgattatggataaagatagccaaatatataatcatttgactgcaatatgtgtgtgtgactactagaatttagaaactagcacttgcttgtgagctagcaaccttagattaaagtgtgagtaatttgtgttgttgtagaagcggacacaacaacatgatatgattggcttacatatggacatccaaataatttcgaataaagaagttttgagtatatatatacatcaggtaattaaattatagttgggactaaatagttgaattccatctaaaatacatatgttagctcatgtacggactagacctatgactagcaaactttagaacaactaggagtatttgtatttgagatgtctatttaacctcccaaacctttcactttgtttaaaaatacacctccgaactccaaaatcatatactccctatttctttgttaacagtgaaatttggtaagcccggagttgtcatcggcttagagtcagcatcggcttcgaagtcctgggattagccgatgagagttgtcaagtcgtcagttatcggattcttgctatattcggttaaggaaattgatctactaaaggaagcttatccagaatagaccgagttcaaagagaatgcggcatgacaagttatctattaattagaatactttgttagtttttagttgttggatttttgctatattcggttaaggaaattgatctactaaaggaagcttatccagaagagaccgagttcaaagagaatgtggcatgacaagttatctattaatcaggaatagtttgttagtttccttttatctttagaaaagtgtgtttagtgtcctataaggactttatctttccttttatctttaggaaagtttctttcttatccgacaaggacttgtatcaacccatgggtataaatatgtacacccggggtctatgtaatctatcttcacgatcaatacaattcggcgcatcgccaccttttgccttttctactttattttatcgtccgacgggacttggcacctgacgcggggctgcatcggtgttcgatctccggctaaggggtaagtccaatgttctgccagcccgggcaattgtatcgtttacgtcggcgtcgttcaaggctgcatcagtacattcgacctcttggattgctctggtttgaatgatatatttgcctacctatttatcatatatctctgttaatctagtcttagcatatcaatttagctctatcggctgcctctcgttttagggtttctgtcggtatcggctaaatcgcattgctagaatagattagcttagacatctaccatcctgaaaactcagtcaacggcttgattgtctagatattatgtttcttttcatacttagtgctgcatcagttaagtttgatctactaagttgtgcttagaaccataatctccagcctgcttcttgattgccaataagggtttcatcggggtttcagccggtgagttatctggacgttgcatcggctcataaggattgcatatacatataagttggatttagccgatgacaacaaaggtttcactgtttaatctaatcctgtggatttcatgacatcggatctccagccgatgtgtgctttaactttcggatcgatgcttatttatcatatcattatttgccaattggtttatactagattatattgttattttattacatcatcatcagccgattgcctttatatcattatctacattggacatatagccgattgcttaaaccctatagctatcggtatcggctatcggctggaactactccatcggcttgtcagccgatcgactgttttgatctactatttgcatatcttgtcagttgcagcatcaaactgactggcacgcccgcatctcaccaatctttggacctgcacaggagctaagcagatctcccaggccggtgtgttcgatttttttgtcaacattcttaaaatataataacttttacctatgaatctgaacaagtgcatgtttcaccggtggagaacccatctttacatacggttcgcaacatcttgtagttccagttatgtaaccgagactacaaatccgggactaaagatgtccatagtcccgggtggaataactgagactaaagatctttagtcccgtttggtaacaccaaccgggactaaagatggtagcgccacgtgctgacactatcctaaacacttttttctttctttttctccattgttttttaccgtttgcatattgatttcgtactgaactcagcaacaaaatcatccacaatcacaaaaatatcacaatatcatccataaattcgcatacatcttaaatttatatatccaaatacatcacaaaccaacaaattcgtatcacagatcaacatcaaaaacatcacaaatcaagaaattcatccacacaacaaatttctcagccgagccaggcgccgctgtcgctgccgccgtgccaccgcggaggggagggtgccgcacgggccgtgccgccgcgtggcccgcgtcgccgcggaggggaggagagggcgccgggtgggccgccgcgccgccgcaaaggggagggcgccgcccgtcggcaccgcggaggggaaggcgccgcctgccggcgccgtggaggggagggcgcgcgccgcagacgatggagatggggaggggagaagagggaggagagggggaggaggaggagataaggaggatacaggagggtgaagaagatagagagatagaattgaagaagataaggatgagggagagaaagagataaagaattttcggctctctcccccgtgaatttttatctctgtacctcccacgcacgttttttactgctcgcgcgctttttttaatatttagtcctggttggtataaacaatcgggactaaagatattggggggcctgtcacggcctgacaatgaatgaaccaggactaaagatcatatattcccgttacacttcaaaccgggactaaaacatgctttttagtggtaactctagaaaaccatctaattaggaaaagaatataaaaaaaccccaaaatgctgtctacttaaaaatgtggctgaactttcatttttttatcccatggaatggataagtaagttgctactctggaaaaaagaaggttacaatagcaacaatcctcctcgagagcagtccttaggccatccacacaagggaaaaaacagagtggaaagatagagaggacaacaaggtagaccgaaccgagcgaccgaggtaggcgagagttggtagagggcggtgggtagtttccatggcggctaggtagaggatcatcatctgacggtaccggcggccggcagccgacaagtgggggccagatcctcgacgcgtaattgatgaagattgctggcctagcgaggaaccataaagggcgatcaggtgcaacagaagcccgaggtgtgggttgatgatgaagttgcaggtgctgaccatggaggttggaaaagattggccacgactttgaagcagagggggacaatcaagtaaccaaagagataataaaaatggaaatgaatcccaagcgaaacctaactgtcatatgctagtaggaattcagacaatattatcatctaactgtagattgaccatgctatgagtctaactctgagcagaataattgtacgcttgagatttttaactggatgtgcatgttaattttggtaaatagtgagtactgtgttttacgtaaatttaatacgttatattaatttgaatggaagggaaattctcttttatacatattgtacaccttcctttgttttacatacactcctttttttttgcttcactatattttaagattgatgtggctagttatatttttttagtgatttgattgtaacccgtttactgaaagttttaaaaaattttattgctaatgaaaagcccatcaggattatgttctcaaatagtgatccaaccatatggaagtgtgtatgtataaaattgttaataaaattgataataagagcatctgagatgttttgatactttgttgccatcttgtctggcatgatgaattcaatggacattccaaaagatatgattttttacattttgggagtcaggctatgctaagaatatctcatatcttatttgagtacggattttcaaaaactttttaaactaattgcatcatgccgatctcattcgtctattttatctggagttgatctcgaggattattaatcgtgagtaaagaatagttaattagaaataaaccctaaaaacaaattggtaaaataaatataaattaaaaataaagattaggtgtggatagtaataaataaaatattatcgcgaccatatttggatcaattaaatttcattgcgatggaataagaattaaccctaattaaagctcaaataaattatataaaaataaaatatgagtaatattaatctaatctagggtgaattcattagttgagataatacacatattgagtaaacttcatttatgcaagatttagaaattatagaatcaaattcatataggaaataaactaaaattgggaaaaataggaaaaagacactattcattagcctctaggtgttcgacgaggttccctagccccttcccctcccctgccatgcgcgcctcgcgccccgagccgtcgccgtcgccgcctgccgccgtgccgctgtcgcctgccgcgccgcgcgccgctcggccgtcgccgtcgcgcctcgcgcctcgtcccgccgcgcgccattgccgtcgccatcgccgcgccgcgtagccgtcgtgtcgccgctgctgccgtcgtgtcatctcgagccccgcgccgccgctgccgcgctgacgccgcctcgcgccgcgcaccactgctgcgcccgcgcccgcacctcgcgccgcgcgccgccgctgcccgcccgtcgcgtcgcccgtcacgtcgcccgtcccgtcgccgctcgtccgtcgccgttgcgccttgcgccccgcgccgctgccgtctgccgcaccacgcgccgcgcgccgtcgcccgtcgcgtcgcccgtcccgtcgccgctcgtccgtcgccgtcgcgtcgctcgtccgtcgccgtcgtcgctcgtccgcgcgccgcacgccgccgcccgtcgcgtcccgccccgagccccatgccgagcgcccccacccgaagccccgcgccgccgtcatgtcttcccctccccttatctctttcccttcccctatataagccccgctattcccctcttctcctccgtctccaccccctcatctctaccactcctccacgccatcgcgccgccgtctccacgccgccacgccgtcgcttaaagccgccgcgcccccgccacgaagccgccgcgccgcgccttgcgccaacaccgccaccgtcgctgtcgccgccgttgccgtcgccgtcgtcggtaagccgccgcccaacctttccccccctcgcgtccatcgtcgccgccgcccgggagagcaagagccgagagagagagatagagccgggagagggagaggaaaagagtgccgagagggagaggaaggaaagaaaaaggaagagagaaaaagaaagaaaggaaagaaaagaaaaggaaaagagagaaaaagagaaaaaagaaaagaaagagaaaagagaaaaaggaaaaatttaagagatttagaatatttaacatattagaaattaattataggattaatgagaataccgttagatgaactcctactatttaaaatacctaaagtactaagatttgattatagaactaattatttacgaattaaaacaattagatgaatcttaatagattgttatagattatttttagtaatgtctataggagatcaattcgcggtaataatttagatcaattcgcggtaattattatagattattttgggtaatccctataagtaatcaattaacggtagaaaattcggatttagttactagggattatagccgtgtaatatatttaatcgtttagtcatagactaaattaaatcatataatgtttctaggattttgtcagatagttagctcgcgctagaaatctctaacctattatatggatataatgctcaggtagattaaattaaaaatttgtgacaataaaacatttatacccgcaaaatagtttaaatcgaaattgggtttgtcatagttcgcagatagtaaaattaataaaaaggaatcgactttcgcatgtgacttttatttggatttatttggatttttatttgaattctaaccgaattcaaatcaattcttgcacgtaactatagagcccgagggagttgcggatccaagcgaaggccaagacccgcaagactttgagcaaggcaagtcatcactattctttgaacatgttgatcccaattgcgaaattgttttgtttacaaataaaattgcatgcaattatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgacgacataatttgtgaaaggaaaataaagtaaaacaactgttttcgactggggcggctggaggacttgggtggtgtctggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtgggggcagccattggtaggaccgcgaggcgggtgtctacagtggtgtcgccatcggtaggactgccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacgtgtattacacttggctagactctaaattcttaacttgtgtgggaagggatattgcatgatgaattttatgctgttggagccacttcctgagaggcgggaaggtggacgtcctcagaaaaccatgacgaatcaatggtgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagccttggaggatccctatgcctactatcaggagggagatgaagacgatggcgtccagtaggtcttagtacggtcgttgcccgtggcaatggcatgccgctgcctgaattccgctgccttatctatttctgcttttggatgtattccggacctctcggtccgatgatttaagactatgcctgcgggcctatgatgtaataattcgtatttaatactcgtgtatgtgcacttgatattccagctatgaattcgtgtgtaccaaactacttgatccagggaaatggtactgtttacacgattgattcctgttataaaaacgggggtccacagagctggtatcagagccatacgactgtaggaaaagaccaaaaggcgccccaccccttttctaagttggccaagggagatattcccatttagtaatactttcaaaaataaaaacgctatgtttacaaaactcggtacaattttcatcttactcttaactattttatttacaaaacaagttttactctcaactgactttgggtttttcttaaaattagatggcagattcggattcacccgctacctgggagttgagcttacctcaatcagaggggtatgtcattgagctgcatcggatgttgaggcgtctgcgataccctggattcccgtcataccgagtgagacagtgtggctcagtttgggaggctcgggttgagattcacccccgagtcccttccgagttggactacagcttccagacacgtcaccaccgagacctgccagagactgcgatgcaggatgccgcccgggaggccttcctccgactcagctctatccaccgagctgagttagtgagtaccgagtttgctcatcacctgttccgggaggagggcaactcagtttgcacagttcaggacacgccctgctgctacaacccgatggtgactcggttgtcacgatgggctgaggcagtagatgactactacgaggaggctctgttggagattgacgaccaccagagacgtgtgggggagttagagactgaggtgaccgacctcacagcacagcagcttcagttggaggaggagcaccaggcttggggcagtgagatagactcactgaaggcacagctccaggtccacggcgaccagttccagcagttatctgaccagtacaacgatcaccgcgggatgatggatactcttgaggagcagctgagagagagtcaggagcacgtcagccagctggaggagcagcttcgagcagccaagatcagcactacaggggcttctacttccacagcagtaggccgtgaccgctactttttcctcaccccgccatacccaccggcgttccacgctcttctgggagaggctagtatgctagctaccgagtcagcgccctacctagtggaccctacagcgacacagccacctgttccggagttggtgcacactccactgatccctacaccttctccgcagctgggttccagtttggagactccgatccaggtcgactccgagacagaggggaccgacaccgagccagagatcgagccagacatcactgatccttcagaggatgaggctcctgttccccgcatcaccttccttggaggccctcgcaccctcagcactgctcgcaagagcacacgacctccgggcaagaggcccaagccagatccagaggccactacttctgggccgtggggactcaggtttgcgcgagccagcgaccaccctctacctgccccgggatcctgcggatggctggaggactagactgacggactccttgcagcttcgatctcgtatcagatggtttttggatagtatgcaagaccccctcccttacctagattgacgagtagtttgatgattggtttgatgtatcgtttggatgaaccttatttggactgcgtatgtatgcagtcaattgcatcatgatttatgtaccatttgtgaaactctgtgatgttatgatatctattgttgttgtattataaatgagtttattccaccatgcttgcgaaacaaagtccatatcaacacaaccccccttaatgggataaagccataggagctagttagaaaattaggatacttactccatcaacctacacagatggcaagccgacgtcgggcaacaaccagcaatgacgaaactcagacacccgacttaaacactctggccggagttatggccacccaaactcaacttctgcaagccatcgcaaacaaccaaggcaaccgcggagggtcaagctttggagagttcatgagaaccaagccgcccacgttcgctactgccgacgagcccatggaagcaaaagactggctacgcatcatagaaaagaaactgactctagtcagggtacgcgaagccgacaaggtgatcttcgcagtgaaccagctggaaagacccgctggtgattggtgggatacctacaaggaagcccgagaagacggtgctggagaacccacctgggaggagttcactgcggcgtttcgcgagaatttcgtacctgctgcagtgatgcgcatgaagaagaacgagtttagaagactgcggcaagggaatacaacagtgcaggagtatctaaacaagttcactcagttggctcgctacgcaattggagacctggcagatgaagaagaaaagatcgacaagttcatagaaggactgaatgatgaattgcgtggacctatgatcgggcaggatcacgagagtttccagagcctgatcaacaaggtcgtcaggctagagaacgatcaaaggacggtggaacacaaccgcaagaggaggcttgctatgagtcacccacctcagacagtgcctcagcgacttaagggagcccctccgtccggatggaagccccctgtcatggtgaccaaccgtcccgctgcacttagcaacttcaacaggccagttgcacttcagaaccgcacccctacaccaactttggctgcccctggagccaagaagaatgtggactgcttcaactgtggggaatacgggcactacgctaacaactgccctcatccacgcaaaacccctgtccgaactggcgcgaatgcaatgactgttcgcggcactactacccctgctatcgggcgaggtctattcaagactccgcaatctaacaggaccgccactggatttgggcgcggacaagtgaaccatgtccgagctgaagaggcccaggaagatcagggcgtactaatgggtatgttctctatcaattccaccccggttaaagttctcttcgattccggtgcatcgcattcatttatatctctgaaggctagtcaaaagcacaacttgaccctcgtgggacttagaaagcctatgatagtacactcacctgggggcgagataactatgagtcatgcttgcatagatgtaccaattcgccttagggatgtggtatttccctctaatcttatggtgctaataccccaaactcttgatgtcattttgggtatggattggttagcaaagcatagaggagtaattgactgtagacgtagagaggttaccctgaccacaccctggggatcggatatgagagcaaccatggatcaagaacctaggctaaccgaacgtgctgggggtatattcaccatgctacccctaaagggaatgcctgtagtacagcgatttcctgatgtgtttccagaagatttacctggaatgccaccagatcgtgacgtagagttcattattgacctgatacccggaactgcccccatatccaagagaccatatcggatgccggtcaatgagttagaagaacttaaaaggcaaatcagagagttgcaagagaagggatttgtacgccccagttcgtcaccttggggagccccagtgttgtttgttaaaaagaaagacggtagcatgagaatgtgtgtagactaccgatcactgaacgaagtaactatcaaaaacaagtatccactaccacggattgatgacctcttcgaccaacttaagggagctaaggtgttttcaaagatagacctttgatcaggataccaccaactgaagattaggaccgaggatatccccaaaaccgcgttttcaacacgctatgggttgtatgaattcacagtaatgtcgtttggtctaaccaatgccccggcatacttcatgaatcttatgaacaaagtattcatggattacttggataagtttgtggtggtattcatcgatgacattctgatctactccaaagatgaagaagaacatgcggaacacttaagattggttctccagaaactccgaaagcacaagttatacgcaaaattcagcaagtgcgaattttggttgaaggaagtcgcttttctgggtcacgtaatctcagccggtggagtagcagtggaccctgctaaagtggaggctgtcacggaatggaaagcacccaaatctgtgactgaaattcggagttttctaggcttggctggatactaccgaaggttcattgaagggttctctaagatagcccgaccaatgacacaactactcaagaagaaaaagaagtttgtgtggtcagaacagtgtcaggaaagctttgagcagctcaaggaaaagctgacctcagcgcctattttagttcttcccgacatcaggaaagactttgttatatattgtgatgcgtcaaggcaaggactaggaggagtactgatgcaggacagaaaagtggtggcctatgcgtcgcgacaattgcgaccacatgaggaaaactaccctacccatgacctagaactcgcagctgtggttcatgcgctaaagatttggagacattatctaattggaaaccattgcgatatctacactgaccacaagagtctaaagtatatcttcacccagtcagatctcaacttgaggcaaaggcgatggttagaattaatcaaggactatgatttagaggttcactatcacccaggcaaagcaaacgttgtggccgacgctctgagtcgtaagagccattgcaatcatctgagaatggaagggatggtccctgagcttagggaggaaatagctcagctgaacctacatatagtaccccgtggacagataaacaccctggacattcaacctcttttgagaacccaaatagaagaagcccagaaggacaacgaggaagtccgagagttgaaggaacgcttggctgcaggacgtgcaaaggaattttcaaccgacgaaaaagatgttctatggtataaaaagagaatttacgtacctgaacagggtggactgaggggattaattttaaaggaagctcacgaatcggcatattcattgcaccccggaagtacgaagatgtaccaagatctgaaggaaggatactggtggcccaacatgaagagagatgtggccgaatacgtagcactctgcgacgtatgccagaaggtgaaggctgaacaccagaggccagcaggtttgttgcaacctctcaggattcccgaatggaaatgggatgagataggtatggattttattgttggattgcccaaaaccgcaacaggatatgattccatttnnnnnnnnnnnnnnnnnnnnnnnnngacagcgagattcattcccgttaagacaaattatagcagtgctaagctagccgagttatacatgaccaggatagtatgtcttcatggtgtaccaaagaaaattatatctgatcggggcacacaatttacctcacatttctgggagaaagtccatgaagccctaggaagttatctcgcatttagcacagcttatcatccacagacagatggccagacggagagaaccaaccaggtcctagaagacatgctgagggcttgtgctctggattttagcaaggactgggagagatgtttgccctacgccgaattctcctacaacaacagctttcaagcaagcctaaagatgtcacccaacgaggcattgtttggtcgacgatgtcgtaccccgctaatgtggtccgagactggagaacgggcggtatttggacctgatattattcaagaagccgaagaaaaggttcgcttgatccgtgaccgtctaaaagtagcacaatcacgacaaaagagttacgccgacactcgaagaagaaacctggaatttaaggagggagattacgtttatctaaaggtttctccgatgaggggaaacaaaaaggtttaaggtcaagggaaaactggcaccaagatatgtggggccattccagatcaccgccaggcgaggagaagttgcatatcagttacaattaccgaagaatatcgcggaggtgcacccagtcttccatgtatcccaattaaagaaatgcttacgagtgccggaagaacaagctccgctggaagagattcacattagcaatgatctcacatatccagaacacccgattcggatattggatgaagcagaaaagaggactaggagcaaagtgtggcgtatgtacaaggtacaatggagtaatcacactgaggctgaagccacctgggaaagcgaagaattcttgaggacggagtacccgcatctattcgaaaactggtaagaaatctcgggacgagatttgtttaaggggggtaggtttgtaacaccctgaaaattcgaccgacaaaacaaaaactctaaaaatacggattttcaaaaactttttaaactaattgcatcatgccgatctcattcgtctattttatctggagttgatctcgaggattattaatcgtgagtaaagaatagttaattagaaataaaccctaaaaacaaattggtaaaataaatataaattaaaaataaagattaggtgtggatagtaataaataaaatattatcgcgaccatatttggatcaattaaatttcattgcgatggaataagaattaaccctaattaaagctcaaataaattatataaaaataaaatatgagtaatattaatctaatctagggtgaattcattagttgagataatacacatattgagtaaacttcatttatgcaagatttagaaattatagaatcaaattcatataggaaataaactaaaattgggaaaaataggaaaaagacactattcattagcctctaggtgttcgacgaggttccctagccccttcccctcccctgccatgcgcgcctcgcgccgctcggccgtcgccgtcgcgcctcgcgcctcgtcccgccgcgcgccattgccgtcgccatcgccgcgccgcgtagccgtcgcgtcgccgctgctgccgtcgcgtcatctcgagccccgcgccgccggtgacgcgctgacgccgcctcgcgccgcgcaccactgccgcgcccgcgcccgaacctcgcgccgcgcgccgncgctgcccgcccgtcgcgtcgcccgtcacgtcgcccgtcccgtcgccgctcgtccgtcgccgttgcgccttgcgccccgcgccgntgtcgtntgncgnaccacgcgccgcgcgccgtnngccgtcgggttgcccgtcccgtcgccgctcgtccatcgccgtcgcgtcgctcgtccgtcgccgtcgtcgctcgtccgcgcgccgcacgccgtcgcccgtcgcgtcccgccccgagccccgtgccgcgcgcccccaccccgagccccgcgccgccgtcacgtcttcccctccccttatctctttcccttcccctatataagccccgctattcccctcttctcctccgtctccaccccctcatctctaccactcctccacgccatcgcgccgccgtctccacgccgccacgccgtcgcttaaagccgccgcgcccccgccacgaagccgccgcgccgcgccttgcgccaacaccgccaccgtcgctgtcgccgccgttgccgtcgccgtcgtcggtaagccgccgcccaacctttccccccctcgcgtccatcgtcgccgccgcccgggagagcaagagccgagagagagagatagagccgggagagggagaggaaaagagtgccgagagggagaggaaggaaagaaaaaggaagagagaaaaagaaagaaaggaaagaaaagaaaaggaaaagagagaaaaagagaaaaaagaaaagaaagagaaaagagaaaaaggaaaaatttaagagatttagaatatttaacatattagaaattaattataggattaatgagaataccgttagatgaactcctactatttaaaatacctaaagtactaagatttgattatagaactaattatttacgaattaaaacaattagatgaatcttaatagattgttatagattatttttagtaatgtctataggagatcaattcgcggtaataatttagatcaattcgcggtaattattatagattattttgggtaatccctataagtaatcaattaacggtagaaaattcggatttagttactagggattatagccgtgtaatatatttaatcgtttagtcatagactaaattaaatcatataatgtttctaggattttgtcagatagttagctcgcgctagaaatctctaacctattatatggatataatgctcaggtagattaaattaaaaatttgtgacaataaaacatttatacccgcaaaatagtttaaatcgaaattgggtttgtcatagttcacagatagtaaaattaataaaaaggaatcgactttcgcatgtgacttttatttggatttatttggatttttatttgaattctaaccgaattcaaatcaattcttgcacgtaactatagagcccgagggagttgcggatccaagcgaaggccaagacccgcaagactttgagcaaggcaagtcatcactattctttgaacatgttgatcccaattgcgaaattgttttgtttacaaataaaattgcatgcaattatgaacatcctacttgtgattataccatgccttgattattgttcacctttaaatctttgtaaccatagatacgtacgagtccctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgacgacataatttgtgaaaggaaaataaagtaaaacaactgttttcgactggggcggctggaggacttgggtggtgtctggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtgggggcagccattggtaggaccgcgaggcgggtgtctacagtggtgtcgccatcggtaggactgccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacgtgtattacacttggctagactctaaattcttaacttgtgtgggaagggatattgcatgatgaattttatgctgttggagccacttcctgagaggcgggaaggtggacgtcctcagaaaaccatgacgaatcaatggtgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagcctcggaggatccctatgtctactatcaggagggagacgaagacgatggcgtccagtaggtcttagtacggtcgttgcctgtggcaatggcatgccgctgcctgaattccgctgccttatctatttctgcttttggatgtattccggacctctcggtccgatgatttaagactatgcctgcgggcctatgatgtaataattcgtattagatactcgtgtatgtgcacttgatattccagctatgaattcgtgtgtaccaaactacttgatccagggaaatggtactgtttacacgattgattcctgttataaaaacgggggtccacagaagctatgctaaagatatcccatatcttgttttatgaggatagatatcccatatcttgtttgatgaggactcttaaatgactttaatgacatgttcatcagtggtagagagaaagagaggctctgctaatatgacattgataaacttaacgccatgtaagctaatggcaaaaatatatttgttggattattcatgcgtcgtcaggagggatctggtcaattttaccaatatgtttttcaagaactgattacaatctaaactttcttgataatctaaactagttacttttcagcttcctccaccatcttataacttttcgaaaaaccatcctatactatacatgtgtgtgtggttagtcttcacatctactatctatttatatttcatatatcacacctcaattgtctcccttcttgtttaaagttggttgtatctacaatgcgtttatggtgatgagacatgcaaatgttgcttgatgagaaataataatgagtataattttttcctatgattttctcgacccatttgaccggtaaaaaaaagaagggaaaatctggttctataacactaaaagaatgcaattttttatttatactatatcaaaaatttccagttaattctaaaaccactaaaagtttgcatggtttccctttaaaccatttcttcaatatctattagttatatattaccacccaagtcagtgtttattcattacatatctctaccagatcattgtttagttattattagttaacaatatgagcacaacttcaccaccaaccagcatacaaaatcactattaactaattatatgaactactaccttttacctattctgatccgtttagattgggccatgaaacccaacactttcaccatcgctatatataccataccttttatcactatcacaatgcaagcacttccagaagaattcggtaacaaccaacgaattaattaaacgaggcactaaacaacatattaccattctaaggactttttaatagggaaaattacaaaaaaaaatcaccctagaagtcacttaagtttgacattccatcttataagtcattttattgcaaatgtccaccctctactcggttttgtagcaaaaaccaccctagtgcacacgtgcttaaatgaatcgatatgttttcataaattgtcttgacacttttcttgagttttcacaaatataattactgatgagaggttaaatgttgttgcactaagtttcattatatgcagaaacaaaataatgaaacacaaagaataagtctaatgcaaacacttagataagattgacccggctatcttagcctatgagactattcatcaatgataacagactaattcagcatgaaatggagagggtgccacttgcttaatttactctattttagatcaagttcaagccgatgcaagtatctaaatttgtattgagggtggtacacacatggtgaaaatatgtgaggtatagctaaaaattttttttaggctgggttcctgggcaccccccccccccccccacatactctagctccgcccctgaattcagctaaacacgtgcgaacgggatggtttttttttaccaaaaccatgtagagggtggacatttgcaacaaaatgatttatggggtgtaatgtcaaacttcaagtatcttttgtggtggttattgtaattttccttttttatatgaacttttagcacgtaagcatgcatgaactttctatgcttacctgttcactactaaataaatgtgtacatgcatgatttatcacattggagcgtcctaagaataactaatatcatgaatagtacaagcatacacaacatttcctgatctagttcaccacgagcaaaattctgataagcccctaaaaacgcgtgggacatacgttctcaatcctgttcacatgatccaaagaccataattaagcggcccagctgaagtacaccgagtaacatatctatgctaattgcatgagtttgccatctcatacacagcgatttcaactaattgtgacaggaatttgttcgatcatgcctgatgtatttattagctgtgtttttgtggtgaccatgcatccatgatcagctgccagaaaacatatgtatatgatgtgttcttaactgaataatatatgcatagtagtggtgtgagacagggatgttgattccatccccatgtttggacgaatttggcatgagaaagcaacatctgcattagagcgtgactttgtacatatgtttggcaacatacagccagaaatgtgttcatttagtatattttgtctacttcatcatatgaaatggctggtacatagcatgatcagttttggttatataaggatttcaataagagtgaacgggtaaacacatgtctatgttatcttatattaaggttatcttagattaaggttagcgcattgcaaagttatattagatgttggaggaaactaaaaaatggtgatctataaagaccgtgtgttattattttggatagactagcatgataacccatgagaaacctgacctccctaatattgaatatattttgagtgtattgaaggcgtgaccatcaaccaatcaacaaggaggagagaggccatcttaatgaacaagaatgattaaaagttgtctgagttcacaagtcatcgaagattataatggtggatcaaagattataaatgaagatggggtgggcactaaatagttttgggtgaatatattgaggtaggaatataatataatataatataagattgaaatttgattccaaaataacgataacagttttttattaatgagcagcacagaactaaatattgtaacaaccgatatgaatggccaccacttctatcttaatgcttatcagtcatgctatcacatgcagccgcagttgtatatcattagcttctcgtcttaagtgaaactgttaccagatcgttagtttgagaatgtattttaactcactctgtatttatatatccaattatccactattatggattggggcatcaaaggcctccgcatttgtcgtgtgcctttatgtacatactagtatagatcttgtggttctcctaccatctctcgctttatccaccggcagaattgagcaactgaaaaatttgctatgggacatccaaaaaacgtgtaattagctaggagacactgcaaaaacgcttatttgctataggacaccaccaaaaactggtaattagctactggacacctataggattattttattatatccggagaaattgcagagagaaacaattgtgtaagtacgattctacccttcgatttttttctttttattttttatctatccttttctactccttcttccttattcttctctctctattctttctcgctttctctctttgctcttcaagcgagcccgagggagcgccggtgaccgcgcgacgaggcgcgggctagtgtgggcacctcggttggaacggcgttgcgcattgctgaagtatgatggcctgtactcgggcgccagtggcgccgggatgtactagcggcgaccgagcatgggctccagcacaaggaggcggagccgggtggggctaaggaggaggacgcgcccgccacgtgagccgatgacatgccactcggcgtcatcgcccaaggcaaacaccccgccgggattacgcgccgtggcaccacggcggcggctccgacggcagtccctggtgctgtcgacgccgacagggatggagcggttgttcgcccaggcgccatggttgtggttgtggaagaacccgacaagggagcccctggcgcgccgccgtggaggtcgttgaattggcagaggaagcggcggctagtgagcatgcggcggaaccgactactgacgagggagacgtggtggaggcaggtcaagtgcggcggtagcagtaacacggcgagtgtcactagccacccctccacgttctcgctcgactcggccacgcccaccaccgccccgccacgccgccctcatccgccgcgtcgccgctggggcgtctcgaaggagaacgcggcgtctcgccgtcctcgtgtgggtatgccatggcgtgttccggctggtcgacgtggcgctgcgtgggagagagagagggggcttaaatttgagcttacatgtggggcccacgtttggattcatttgagcaagggcaaacttgtctttaatgattgtttttctatccaatttctccggatataataaaataattttgcgggtgtccagtaactaattaccagtttttggtggtgtcctatagcaaattagtgtttttgcggtgactcccagctaattacacgttttttggatgtcccatggcaaactttgcctaaaatactccctcaatttcaaaatgtttgacgccgttgactttttatcacatgtttgaccgttcgtcttattcaaaaaatttaagtaattattaatttttttcctatcatttgattcattgttaaatatatttttatgtaggcatataattttacatatttcacaaaagtttttgaataagacgaacggttaaacatgcgctaaaaagtcaacggtgtcaaacatttcgaaacggagggagtattaatcatgcatgcctgatgaattacacgttgccattttgtagtgactatgattcctcaatgagctttgagctagtgaaagacatgctcctgtagaaaaactaatacaaatcacaaatggtgtatttttcgttattaaaacgaatgatatttatcttccgttgctgctgggaatacaaaataacttccacaacaagctctcagttttatctggattgaaaaggcctattttgatattttcaactgtcagaaagaaattcaaagaaacatattgaatggccaaaagactagactttctatcagctaaaaaaatatacagtagcaaattggaattgcaatttctgacaataattagtatagcgtaatggttaggcctgtgggaacttgctaattgaaatattcactgttatcttcattgtctcgtcgatctcactgcacatacacatgcaagatacttcgatgtgcacaagtgtttggtcagtaattccccatacacaaatcttaatgaacacaaagaaatttggatttgatgtgtactgtagtatgtaaacagatgtgctttcctagcgatagtagctagtatactgatcatgttccttctgcaactgacgcataagttccatccatccagctagacttggtaaaaattaaagacaatagataagcatgcggcatacatgtgaacctgactgcacagaattggagatgtatatatatatatatatatatatatatatatatatatatatatatattacacatagagtaacttgaggagatgctaagctagagaggggaaatatttatgctaacggagtattatagtgaaaatttgagatttgtttttgtaaaataaacattctaagtagtttggtagtgctattgaaaaagtagcatagccagacagttggtgagaatacacatcaatttttgtaattgaagagtgatgtttaaatgagaggaaatatgctgggaaagttgaagcggacacaactgtaaaagatgttagttaaaccttaatcgactacaagattaaaaaacactagtgccgatggctagcgagaatgaagttatagtcttttagaccagttagagatgttggtgaatgctgaagctaccataattataagtgtcagtagtaatgttgattgaaccttaaaaaaccacaacattaaatcaacattggtgctggcggatagtgaaaatacaacttagtcttttatacaattgtgttggtgaaagcgaaaggaatcacaataactagtgtgaattgaaatgttgtttcaatcttaatcaataacaagatagattaaattaatagtggtgctagtgggagagagaatttagtttaattgagagtggtagtagtgggagaagagaatttagttttgagccaacaaatggcataacattttgatattatttccgtaaataaatccaccacgatgattagagtcagatgatgcaccttcccctatggaatagaaaccacctcttttaagcatgtaggtagggatggcaatgggtcgggtcgggtacgggtagagcaaaaccatgcccgacccgatacccgacattgcccgcccaaaccctacccactagagttagcgggcaaaactccatacccataaccatgcccagcgggcgcgggtatgttcagtgggtatccaatggatctcacataaataataacttgaaagatatgtaatttaacaaagagaaataaaatcaataatttaccaaattgtcggttatcaacaataatttgaattacatcacaattaattatatcccttcggaaatattttttccttgataataataccctccacgattttactacggttaattaagatggtattataaatagatttgaacccttcgatcaaataagattaacagttcagattactttctactaccagtagagagcaccgtaatgcgcctctaattaattaatagtgcagtaatgcagtggttaggcctgcctgtgggagctgccaatagaatgggatagctattctactgtcatcatcctttggctgtgtttagatagtggaaaagttgggagttggtagtttggaaaaaaaagttgctagtttatgtgtgtaggaaagttttcgatgtgatatgatgtgatggaaataaactaaacatggcctttgtctcgttaatttacctgtgcactcacgaaattcctattccacgcatatgcaccagaagtgctgtgtgtttctattccctcgtgcgtcccaccagctatatgcatttccctttttttttctttttttggatctggaaataaaattagccccatcaactacgccatatggtatacatgtatttcccttgcgcatgattcccagatctagagaaacaatgatgagttttttttccaggtaagtgtatgtgtttcatttatttggtatacatgacatttttttaacaaaaagcaacaactcaaatttgaaaaaaaaaaaggtccaaataaaaccttcatctcaaaattcaaaactttgaactcaggttttcactttcaactcaaaatttgaaactttcaactgaaatttaaaaactttcaaataaatatttaaaacttttaactcaagatttaaaactttctatccagatttaaaactttcaactcaaattttcatctcaaaattgagaacttctatatcgaaattcaaaactttcaattcaaatttaaaaaacttttaagtcaaaattcaaacttttatctcaaaattgaaaactttcaactatctttttttaagttgttaactaagttatttatgtatttttaaaaattagagctaagcatcatcattagcgttaatagtgatttgcgtgagtgactgggacgtacgggcgctttatgcagcccggcacacgtccactagaaacccccgtacactcatgctagatagtacttcaatatgcatgagtttaagctgatcagcaatttcaatcatgcagaaactaatgccggcgaacacaaagaaatgtggattatttttctgcacactgtaaacgaatatgctttcctattgaagagagaaaaggtagcatccttgtcgtattctttttcgactaacacatataagttccacgcatgcatacagccggtacctaagtaaagacaataggtgtgcctgaatctgatcgctctgaagcttcgagcagctacagcttcagttctaggatctagagcttcccaaaacatttcaatttttcgtccaaattacaagagctttagttctatggtctagaaaatgaatttgaagacattagttggtttcccccgattatttggatatattcttatcagctttattttaaccagctgtttatctgaatataaagttaccagaacaaccccttggttggtgacgaggaaagtgccaagaaaaaaagaaacatatgtatggaacaaaaactgctgatcaactgatcaagaaatatgaactcgaaatccaaaacatatgtagtactagagattttaacggagtttagcatcggaatattattggtaggaactataagaaaaactttgtatatagtgagtaatggaaggcagagaaaatggttaatgatttgttggagtctgaaatcaactacaaatccaaaatagattagtaaaaactgctaatacaccacgaatagatgagtaaaaactgctaatacaccatgagctactatgcgttgccattgtattgtattgtgttgcatgtcatgcatatcaataaaattgtacttctcttcgtaagttccactgactacttctcttcatgcatgtgacaacaaacactcgtgttaaacataccgtgtgacagttaaaagtgaaccggggaggcaggggatgtaaaaacaacatgagctagctatatatatatatttcatcaccatatcaaggtcgtgcggactcattcacaacgtgtgaccgagataactatctccaatataatagcgtttttttcacttgtagtttctctgtgtagttatcctaacggtggctagcttccaccttattagcgcacttcatacgaggagaacaacaaagccgagataacatgtttcgaaagaaaacatgtaattaatatgattgaaagagaggagcgggtggatgacatgtgaatgcatatataattaaaatatccattacccattagaaggggatcagctgaaaagcattatagcattaagatatttggctgaaacaattcagtattttatatgtgctactaacatagcgcgactagataagtgaaatgcgagaaaaaaacaaatatggaaaatgaggttttggaggaagccaaagaaagacaggtgaaatgcgagcaaaagaacaaatatggaaaatgaggttttagaggaagccaaagaaatatatttaacaggatgatatgatggggattgggcggaggccagggctggggaggagggatacttgttataataatagcattactactcccatattcttgtcaaaaactaattataaggaattttttgtgatagattggatccaacagatcttaacccctacatatctagtgctatatgtgaggagattttttatgggattttgactgggtttggcatcgggattattggtaatattgtttgcccaacaataaaagagtactgttctaacagtatgaaacatcacaggatatgtactgaaacattcgaaataacactacgtgcaacatttccaaatcaattgcagaacatcgaaaagtacttactagaaaatccaaataatactgtatgcaacttaaaaaatctatgataacaaatcggggacgactccgcgtcgaacgtccgatattccaccaaatatcggacacccgtctgtctgcgcgcctgtcatgcctcctgctgatgcagcatgcatcttccgtctatcatgcacctctgtatgccacatgcagcctaccacatatattctagtatatgcgcctgtcacaccacctcttccttttcctctttccttctcacgtactccctccgtccaaaaaatgacaaaccctggtttccgtgtccaacgttcgaccgtccgccttatttaaaaaaattataaaaaaaattaaaagacaagtcacgcataaaatattaatcatgttttatcatctaacaacaatggaaatacgaattataaaaaaatttcatataagacgaacagtcaaagttggacacggaaacccagggtttgcctttttttggacggagggagtatagtatactagcacttttttctccttttttctttcaccaaaatttaatcaaaattttcttttaaaatatacatctagtttatgatctaattataccattaagtttgttatatttgaatttttttataaaaaatctcatacagttatatttttattaaaaatatatgtataaaaatcaattgttgttcacaatttatataaaattgtttcacctcactaatgaaatgcgttccagagaaatgcaacatataaaatatattgactgtaacaatgacaaccattgtatgaaacattaaatacgaactggtgatacataacaaaatcatatgaatatacaaaatatttataaatacttaattacttgaaatattttctttatctcatccatgaagcacagcgttgtaattgttgaaaaaaaaaaccctgctgaaacataaaaaaggattatgtgcaacatttgtacatgaagtagtgagacacccggaattacttattgaaacatttatataataccatatgcaacattaaaaaaaattaaacgtgcaacatagtctaattttaaatgaaacattctcttctcaccgagtgaaacatcgagttttaatggttgaaacatataaatatatgttatcgaaatataatcatgtgatatcttgttttgaagatttaattacaacgaatacttcgatataattagagcttggatcggataaatagttttgaagaaaaataattttaaagaccacgtttcatttacacatcggtgtgaccgtatatatgtgcttgcttgcatgttgtgcatgcgtgcatccatggatgacgtaacggagtgagctgccgtaggcgtccgacgttttttatctgatcggacgttcgaagagaaacattttcataacaaatcagctataaaaaattttttcatcagaatactctctccatcctcttttatttgacgtttccgacaagtttgataaaattaaggtttgcacgaaatgtcttttttatccttcgtgaacttcgtctcccccaatgctgcagtgctatcgtgagcgagcgatggcaaagaacagaacacccacgactgacaagctcaacctcagctgcccctacataatcgccgctgccccgatcgatgtgctgcaccatctcaatcgtatgatggtagagagatttgtgccgcggagctgcgcgattcgcgagctcatcaataccacggtggccactgcacagctccccgacgatggaaatgaaacccaatggcaacagctcttgctacgtgatagtgatttaaccccaatgacggcatctctcctcaggcgaaggtgaggaacgaaaccccaactcctcatggtcgcctccagcgacgcatatccacccaattaggaatccatagggggtaattcatactttttctatactataaaaaatatacttgagttacaacgggtgaaggctattttaatcaattattgttagaattttttttgtctaaaaagtatatgcgattttattttgatagtattgatatctaatttgggaatcttattgggatgatagtcatatccagtaagttgctttctaattatctggcaagaattctaaagcaattatgagtccgactctcgtcctttgtaaagccatataccacccccaaagggtatgaaaataccggatgaccttagcttttcaatgaatcctcatctcgtgtagcgaagtcctgttagtaagaccccgcacaaaaatggattatataagaatataattccgaatattcctccgggtgcgtatagtagcattgcgattccaaatcttttttctttatgaatagaaaaaaatcattgtaaagttgatatgtgagtttactaaaatgatttcttatacgactccttatgtatttccaaaagtgtacgaacttaaaaactaactcaatacgaatgacgtaccaaaattccgacagaaacatcttcaatttttataatagtagagactgaaaaaatacccatgcgttgcaatgggtaaaggcatttttttctagtgatacaactattaagagccaaggaataaattgaaacataactattgctatacattataattgaaaaggcgttgactcctgcttgcctctcttaacttccataagacagttacgtgcccgtgcaatgctgaagccgatcccgcacaatgccaaaactgttcactgatcatcccatcaaatcgattttttatcaatctcccaaaattgattgagggcttttgatccacttgatcagttctttagtttttcctaaaatcagagcgaatccgtaaaactcaggataaaaacggcggggcaagatcatctggataaaaatggcggagaagatcatcggctagcaatccttcacaactgttaaacagagattaaatcttgtgaattaatgccgaattgaaaggtgaaattatgaaggaaaggatgagtgaggagtggagaatcggtttttgcaattagttagaggagaaaatgcatgtggaggtagatagatttttgcaattagttagaggagaaaatgcatgtggaggtagatagatgtggcggcgatattagggttcggcctgggcggcgcggtggcggctggaggcgtgtggcaacggattagacacgtatagaggacgtacaaaatcaaattaatggaatcattacttattataggtataaagagataggttagatataaagataaatattagaaaactaactcaaacatggatgacgtaccaaaagaatgacatatattccatacgtatgacgtatattctatcaccatatgaaggatgtatgtacggactcattcacaacgtgagacagagatcactatctccaattgcgtttttcattttcagtgtccctacgtaatggttgttgtcctacctgtggttagcttccatctcattagcacacttcatacgaggaggagatgaacaacaaaatggagatagcatgtttcgaaagaaaacatgtaattaagatgattggaagagagagtagcagatggatggcttgtgaatgcatatataattaaaatatctattagtggaaggggaccacctgaaaagctttatagcattcagatatcagataatatttgtctataagaggagttggagggaaagcaactaaaacaagtgtagtcggtatcttagcttattcgtatgtactgctaacatgccgtgcatgtggcaacagaaaaagaaacggagaggcacaagaaaaagaaacagagagtgagattttggagtaagtcaaataaatatttgattacaagatttaacgggatatatatcaagatttagcggggtgatatatatgattagggaattaggcataggcgaggtttgtggggagaagggaggcgagcgtgcacgtagtagctgaaaatgtcatgggttcatattgaacttatggtgcttgcatgcatcaattagttagctaattagttagcgagactagtaccggtcagtgcatacaactgttgcatgcaagtagttagtagtggccggattgagtggatcgagtggagcatgcatgtgtgggcatggcatgagactcagactaaggtgttgtgtgaaggtgtgtgtcgccgaggttatataaggcatgtattgcgttattagatttctaaataacagaaaagagaatagacatttgttgtcataatgctcctgcgttgattagatttccgaataacagcaaaagtatttgttgccataacacttatttacttacttgtataataatgtataataatttactaccttgggatggattgctggtataatataatgaattgtgtagaaatatacctacgtatttttcattcaaataaaaaaaaattcaatcagcgatcatggtatgtgatcgtgcatcactcgtgaaatcacactcgaaaaacatgcggtctggtacaatccttgcaatcccccaaattaatctctctctctctctccagaaggaagcccaattacataagagtgcgcgccccatgggcctaagtacaaagcagcaagagagttttggcccgtgccatgccccactatcccgtcacgggcctccacaactctacgtctaaagcccaaattctccacagccgcccaataacttgtcgccactgtgatcgatggatcgatctgtcacatccagtccaggacgattggaagagaggaggggagaggggagagagagaagagaggtagaagaaagtgctacccactaacatgtgtggcccgtgtgggtcccacgccgactcagcttgccacgtcagctaaaactggttataataatgtatagtatttcgggtgattcggttttgtaaattaagggacccgctatatctggtatttcaatttagggatgaatttcggactcggcgataaattgaggaacctaaggtaaacttattcctactttttaacccgcaaccgtctgagggttttcccgaatgcctaagaaagcccaattatagctgagaccgtatgaggcccatgatatgaatacggcccacgctaactgatcaaaggctagcacgttcgcggataaaatttaaaattatactgttgtagtttttttctcagaaatatactagatgcgaaaggatttacacaaataaaccgtcgtcgtggtttgaaagtgcgaaatcacaatgaaatcgtaagacaaacgcgcaatactgacagaaatgtgctgtcacgggcggtttcgtaaggcagaaatgcgagaccgacttcggtgtcgctaattggccgagcgggagagctattcagcctcggtctcgcttgttgcccgagcgagatggccacactggccgctaattaataacacaattaatcatactaattagtgattaattaattaccaatgatattaattaaagagataataattaattaattaattgctaatgacactaattaattaattaatcatgtgagtttttgggtctccggactcgcagcgcgatactgcgtggtgtcgcctcctctccacgcaagaccgctttatcacacacttgccttatggtcttggattttttattctgcgatagtggtatatttttgttattttcttctaaacatgtatatacctataaaattattgaaaaaaacctctcatatttctcggatgctttcatccactaggttatctatatatttaacgtctgaaaatttatcagaatacgcaacggaaagagatgaatgtgtcatgtgtgacagtagaaaagtttagcacaacacaaatgatgtgttatcctatcttactataaagttatcccccactaactccttaagcttaacatgcaaagatgtcacatcatcatccactaacgagatgccacatcatcatccactaattaacaatatgtcacatcatcatccactaacaatcattacatttaaacatcatgcaaacatgctatatctttatagtttttataatttaagagcttttcaaatacaaacatgttaaattatcatccaacataattcacataatgtttcaatgtatatcttcatgcaaagatgccacatcatcatccactaattaacaagatgccacatcatcatccactaacaatcatcacatttaaacatcatgcaattacatgctatatgtttatagtttttataatttaagagcttttcaaacacaaacatgttaaattatcatccaacataattcacataatatttcaatgtatatcttcatactaaattcccgcagcaatgcgtggggtttcacctagttaactgaatagctagatcatgcatgttggacgaacttggcaggaaaagagcaatatatatacgcacgagcatcagatagggcgtgagtgcgtcatgcactcatgcttagcatattgttgagcaatgtaccgaaaaattaatgttttctccccatatacatgttcatctctattttcatcctatgaaatgcatgcatcatctgtaaaatcggttggctatatagaggagctaggtaaatggacatgctcattctctttgagaagttggtgtctcttggacaagactttgagttaagacttctttacttttgtttttttgtgacactaagacacgcgtgtctattagaaaagttagagataatctggtcaagactttttttacataaggttttttattaatacatgctaatcctctttgaaaagttcataggacatgtagagatgttggtgagaactgaatagatataaacaagctatacttccttgaacaaacaataactgaaacatcgcctgagaacatgctagagtataattcttatcgccacatgctagagtataattcttatcgccacttggaagatataaattttgttccataatcaagttagataaccctaaacgattaaaatacatgttgtaaacataattatgcattagtttctaatattgagtatatgatgagatttaccattttgttccacattcaactacggatacagcatgagcgcggcggggtcttgagcccccactactggcgtgaagactataaagaccccactaaatttttttagcatatgtagatgggagaggggactataactctatctagtttgcttagaacccactgctatttctttctggatccgccactacgtaatcctagataattgaaatatatgcatgcattagtttgtaatattgagtatatgatgagatttacctatttcatttgtgtttcccactatctaattttgttgaaaacatatattatataataagaggtgtaatcttttcatattcgtctaagtgagaacatatatattatataataagaggcgtaatcttttccatacatgtctatataagtgtaattatgtgccgaaaaactgccttgacatagtggtacttttgttgtttcaatattcgtttgtagaggaggtcaatcgccaccgacctgcattcctgaacaagccccgtttgatcgatcgaacttaaatgactattaatgactattggcgcttgaaaaatgacatgccatcatgtgttttctggcatgaataattaggtgaaaccccacgcatcgctgcgggaatttagtatgataacaacaaaaaaaataacgtgtaagatagctacataacatcagattaagtaaattaatgtggtttatgataatttaaatttaaatagtatatagaatggtgattcaaactaaaaagtaaggtggagaaaagtagggagatagtttggaccgtagattaatcatctaaaggctaaaaacaattgatgtgatatgacttaattagagaaaaaaaaaggagaaagataatttagaccataaattaatcatttaagcactaactaagtgaggataaactatataagcatataggatatcataagacataataaagatatatattgaaatattatttaaattatgtgggatgataatttaacatgcttgtattatgcttgtattttaaaagctcttaaattataaaaactataaaattatagataatataacatgtttgtatgatgtttaaatgtgatgattgttagtggatgatgatgtggtatcttgttaattagtggattagtggatgatgatgtggcatctttgcatgttaagcttaaggagttagtgggggataactttataataagataggatacatgccaaaaccatgttattattgcacagtaaaaaacagagatgtataaatataaactttatgtctctataattttgattcgagtgagatatggcattaaaggtttttgttgtccttatagcgagcggaatgtattaatttgttaaaacacatatgttggcgggagctgaaattacaaagtcatgaatcagttaacaccaagaactccaatagatgccatcatcccaatgcaataaagaaatctctgaaataactttctatcacactagctaatacaattattatgatcgtcagtcaagctgattgtgatagtccatatatattggcataaaaaaaccatagttagagaatgaaaggcaattgaactatcctctcttggtacttttgcaacaaaaaaaatcatattgtttcattcatccaagtgtgtccttcagacaattgtggtatatagacatattggatgtccttaaacgttttaatctgattcggtgagctcacctggaaagcatttctatttgcggtacggttatggtgtaaaaaacaaagacttcaacaatcagaagcacctaattccgcatgttagtcaacatcatggcgtctgctaattcattatatttcccagatgacaatttgattggacgtcacagatgcttattgctaactatagttcgttgtcacaaacgtactcaaagaatgtgctaaagacagtgtgtacacttttgtggtacggattggatcttttgctatgatatttcttagacgattttttaaggaaaattgtctatatatgatgagtgaagaacaacacaagttgttcttccccacccccaatatatgtcctatatagtatggaaataaaaactcactatttacacctgaggtattatttgtttgaaaagttgtaacataaacacgaaaattccaaacaaagttggaaatggaaaatggatgaaagaaaaaaaagagtttgtttaggttgatttgggtaatttatatagatgcaatccactgtttgattcagaagagtaatacagtgttataatttctgtacaacaaaatatacagtacgatgcagatcaagactaatttcctttcagttttttcgaatgcataaaagctttacatgtcaatatattagaagtaacatttgaatacaacggtgacacaagtagtggtcaggggggttttgcagaagactaatttcacatcgcgattcgcaatcaaaacgaaccgaacagacctttgaaactcttgaacaagttgatcgtggcgaggtgttttacaattgtctctatccgcagtagaatcagtctggaccataagtatttttaccatccaatataggtataaaaatttgtggtaccttgagataccagatattggatggtaaaattgctccgaaaccattcatattaatcagacgccgagaatagagaccgtgaaggtactctcgtgtaattaactactgaggaagacataatactggtcaataaaatttccaagatcaaaataaacgtacacacattgttggaagtatctgatttcattctattttggctcgttaccggcgagaagaacgaacgaacaaaatcaacatgtgaagcggcatacgcttgtctcaccaaagatgccgacatgagtgacgtcatcgtcgttgttcctcaaggtagaagacgaattcccacaactctgccgcttaatttcttgttggttcgtgttcaccggcggcgtcgacatgatcgacatcgtcgtcgtcgccgccgtcgtcctcgtcgtcgcacgatcacccgatcgtcgccgcgatccggacgtgtggttcaactgcggcgccaccaactacacgggaggagcgcctacgagtccaacctcgagcgattgattgctgggctggccaagaacgcgtcgacgccgtcgctgttcggcaagggcgccgccggcgccgccccggacaccgtgtacggcgtggcgctctgccgcggcgacttacctcaacgtcctcggcctgcgtgcgacatgcgttcgctcggcagcgtccccgggctggctgcggctgggcagtgcctcgcgtcgctcgaagtacgctgggtcgtctgcacgcacgaccgctcggcatgtcctagctcgcggtatcttccggcacatgcacactcctacacaccgtcagacacgcgaactccatacgcgacgagcgagcgcacgcacacgtcgagcacgcagtgtccagtcggctgcctgcactgtacaccagcggtagtaaaccatgcagcgtcagccgcgcatgtctgtctccgagtgtgcggcacgcacccggtcaatcgtcgcgcactaggcgctgtgacgcatgcactacagcctaaccatgcactgcaatggatgactacgctccccaggcagcacgtgccgatggcaatgggcgagtcgctactacacttcgctcgactcgcgcggccgtcacggtcgcaccgacgcacgctacatatcgcgcacgcgggcgggcagtggacgctcagccgcccactgttctccgtacgtcttctacctctcatggcctccagtgcacgccggacctgcgtcccggcggctgctggcgctgcctccagagcatcaacgacatgacgacgaggtacttcgccggccgccgcggcggccggatccttggcctctggtgcaacttcaggtacgagacgtatcccttctacaagggacagccgatgcggcgcatcggctcgtcgggcgccgacgccgtagctccggcggtggcggcgaacgccgtcgcgtcgccgccgggagagaagcacaagaggaggaggaggaggagcaaagtcatggccatggccacgattttcccacttcttggatcattttgctgcgtcatcttttgcttcggattggtcagaaggtacaagaaaggtaaaagctactctatttcatattataagtcatttgactttttacttagttaaattttctttaagtttgaccaaatttgtaaaaaaatattaacattttcaatataaaacaaacatattatgaaaatatattcaatattaagttcaatcaaactaatttggtgttataaatgttattaatttttctataaacttaaacctaaagaacttcaactaaaaaaaagtcaaacaatggaaggagaaaactgtaatttagccacgcaattgtgcaagaaaatgagcggtgctctactaccagtattatcgcactagaagtatctcaacatttgatttatgagttgtaccgctcgtcggaaaaattattctatatagttgataggttagtacaaatagatatggtgtatttgattagaaaaatggtttagattaattctactaccgatagaaagcatggtagaacacctccgagaaaattagacggcagcggttttactgaaagaattgtttcaattctgaatttaggtgaagtgagcttgcagggtgatatgaatatgcagacagatgaagaagcattggcctggggaagagaagcatgtagttcagagttcacatcgttcaaattatcacaagtgttagatgctacaaacaacttctctgaagataataagcttgggaaaggaggatttggcccggtatacaaggtaacagcaacatgccctatcatacatagactcgtagagatatggaaatcttaaaatcagatatatctctttttttaagagagtcaaaaacatatggtccagcatctggtagctggttgctaatgaatatgtttcaaatcctcttacaagtcatacaatgaaagttattttcttagaaggatgagtaaaatgctgatatacagtacataataaatgtaaataattttggcgtgtacatctggttggatgtagagtccaggttttacccacttttttattaaaaaaatgtacataatcatttatcactgataaatctgttttgatgttttttcctagggtcagttttctgatggatccgagatagcagttaagaggcttgttgcttcacattcagggcaaggtttcacagagttcagaaatgaaatccaactcatagccaagcttcagcacacaaatctggttaagctcttgggatgttgctatcaaggagaggagaaaatactgatatatgaatatttgccaaataaaagcttggacttctttatctttggtattacttctcataatatcctagtgcaaattcatagctaaatctggctgttggagttgtttttatcaactacttacgtttattgatatgcagatgaacgaagaagagttacgctaaattggaataatcgcctagcaataattgaagggatagcacatggacttctttatttgcacaaacattctcggctgcgagtcatacatagagatcttaaagcaagcaacattctcctggactgtgaaatgaatcctaaaatttcagactttgggcttgcgagaatattcagctcgaatgataaagaagaaaacacaaaaaggattgtcgggacatagtgagtttttcttacaattagcacatccaaattatatcatcaatttacataacacaaacttcacatatagtttgtttctttataaattttacctatgatatttcagtggttatatggctcctgagtatgcttcggagggactcttctcaattaaatctgatgtattcagcttcggtgtcctaattctcgagattgttagtgggaaaaggaactctggttttcatcaatgtggagatttcttcaccctacttggatatgtgagttctttttcctatacataaacacataacattgtgttgtcttgtagtaatcaacctctatttattgtgaccaaattacttgaaggcatggcaattgtggaaagaataaagatgggttgaactcttggatgcttcgttgtctactgaattgcatgcatttcagatgatgagatgcattaacattgcattgctgtgtgttcaagagaatgcggctgaccggcccacaatgtcagatgtggttgtgatgctaagcagcgagaatatgacactgcctaaacccaaccatccagcatattttcacataagggtaacaaaggaagaggcatccacagctcttgaatctcccagtcttaatgatgtgacaatgtctatcctatgtggcagatagtttttttttttttggtttgtctcatatatgttttttgtgcgattgctttgatttgaaggggatgtgttctatgtgtcatgtctaataatatttgtcaatcatagacgagacaattgtcaatgactagctagcttagttgctgcaaaacttacatgtctgcatatgagctttttttttccagtttttgtttgttcgtgaacagagaggatgtaaaagaagaaattttggccataccaaatcccatctttatgcatcagttggcaattctgaacaactgaaaataagatgttttaattgcttataccaattgtattcttaccagaatgacaaaatgatgttattttttaaccaagcagtatcattcattttattgccagaaagtcacaatgatcactcatcaatatataatatttcattataagaatatctggtacattttggatattcatacattccggtcgtcaatttgaccatttgcgtatactaaatctcatagcattgaacaaaactgacaaaagtgtgggctggtggccagttgccatgtcaagagttggggcaagccaggcgatgcggttgcaatggggcaaaccaattaatgtcaaccattttaggttttgaaaccaattgcctcaacatttcagcttccaccaacatgtcgtgccaccgacagtggcgtcaggcgtcttactagtaatgtggtgaaaaatgtcactatcctcacatttttctctttattcaggcagcagcagatgccaaaaacatgtcctttagacaaaggatcgatgaataacacaataggtctgtccatatatatatatacctgaagattagtgtaaatatcactacgaaaacaaaggcaacacactgttgtctggattgttcatttctaagtgactgcaatagcttacagtcactataaaaactgcattgatctctcgttagcttttgtgaaccacatcacgtacatgacaaggagctcgccaccctagctgcctgctttcgtacctggtttttttgaggatgaacagcatcgaaggatttttgaggatgaacagcatctcgaaagattttgcacatgccggccggccgtcagtattgcaagcttcctaagagcatttgcaatgtgggtttttgagaaggtgctaaaggaaagagtaagagaaagtcctaaatattgccgatgtgtagggatccggctcctatattgtgctttgtgctgcagtgcagaatagcgatttgcaagttgttaatgtaaagcgtaatgtacagaggtactgttgatgtgccctgtagcgctcgatctcgttcgttcgctataaatcggacggctgagaataccctctcttacttcgcacattgtagcatcctatactgacaaacagtttcatgaaacttaggcaccttgctttgagcgaatatagtgaaggagaacgtttttttttcttattaatattggagaagaatttttttctattaatgactgcaacgaaacaaaataatagccactaaactgctcaatctaatccatttctcgtgtaggaatggtaatgcaaacgcgggaggtgaataacatcgaaaacaaatcgtccaatacgttctgctactcgatatattcctcacaatcgggcccaagacagcccagaaagagcttaggtctgggccttctgaagtctcgtcaaggaaaggccattaggcccgttatacaaatacagcccacgcaagccagtccggtcggattgggggcttgggtttttttattttatttattaaaatatttaaacaaatagttttgtttcaaagttttataaatctacacccctaacgcccaatgtacatgtgtcacgtcataaaaaaacaccatctctgaggcgtcaggggtgtagatttgtaaaactttgaaaaaaaatttgtaaatattttaataaataaaattaaaaatttaaaaaattcgggggcttggggcaccaatgcaacatattgagaaactaaacatcttttaaaaaaaatatagatgtgaatgtgtaaagtgtgacagaaatatttttgtatcatgcatggttgatgacttatgtgctcaagtagagaaagtttaacacaaatgatgtgtttttaactaaataatagctggtagtgtgagcgcagctaggatgttcacattggatgaacttgtatgcttgcgccatacacgcatgagcatccgttgagcaacgtgtggaaaaatgtttctttcccatacatgcatgttcatctattttcatcatgtaaaattgattggctatattttttttagataatgaatagaaaaccatcctagcctttgcgagctacaaccaattattacaccaattcgttcaaagcgagtgcaactcaaagaaaaaaaacattttataaaaaacactcccaaacatgaagcaaacccaaactaataaaaaacagctatataaagagagtaggagtgaacggaacctctttgtaaagttggctataacgtaacgtttacagcgaaagcccattgcgtttttctgctgtttcctagcgatgcaacacaaaaacgttcactatttgttagaaatcgtatgcatagcattttcgtttaatcatgtgcatgccatgtcgatcatggaccggatacggtgacgaagaatcgaggagattgccaccggccggcctgcatccctgcacctacgtttgtatcgtgcaaaacaagccgttcaatcaaacttaacgacttgttggtgacatttctttaatgtgagaaatgtcatgccatcatgttatttttcacaattaatacacgccaaaaccatgcatgttgttcttggacaaactatagaaagaaaagccgtataaatataaacctatgttgctaaatttgttgatccaattggagagatgaggcattaccatcgaaattgattgattgttaatgttgaactctgactgatattatagtaataaaggtctttttctgattttttttagggatcaaggtatattaggttgatgaaacacgatctgaccatcatagtctaaacctgatattatttatcttgagaagttgaactattattagagcgagtgacgagtgagatgttagcaggagctgaaattatgaaggcactattggattcaaagcaacaactttatttccttatgagcattacttcaaaatactatcccatggttgcatcataaaacaaaatattctcaatagtatctagagtcactcaaattggataaagtgaggtaatataacaccaagaagttcggaaaaattacgaagatttattatgtataatcttaataaaaactctatacgaattattatgtataatcttaatggaaattgtatacatttggcattttgttcatggtattttacatatttctccctctagacgttttagattggaggcattattgggtagataattaaatatattgaaggatttgcatcttatccatttttgttgatgcttaatcacttttttgttctattatatggaaataagcacctacactacatgctccctccgtggacatatgtttgtcttaaattcgcagtaataggatatgtcacatccggtactgatttgttttatattggacagaggagtactacacacccataagttgcaccattaatacacgcttaattagttagaatttaatttgttcttttttacaacctatagtttttaaatttgagcttgcatgtttgtagggtaccacgttttgatcaaaagttttaattttttttttcataacttattgcatggcattctcttagtaggaaatagacaagcccaagataatcaatcaagtagttttgtttgccatacatttatgatatatccacttatttcccgggcagaagtagtccaatttttatccattggattcagtgattcagtccaaatgtgtgataaggctttgatgtatttcaactagtctatctatctattatatactaaaagcctattaaacttcctgcaaacgctctcaagttatcacatggcgctctaataaattagagaaaatcctagaaattctaagaaaaaaagtaaaacatctgccccgtaattttcattgattggctatataaacgtgaaagcctgtcacgtttttctgttgtttcctagcgatgcaacacatgtcgttcaccatccgttagcaatcttatacgaggatcgatatcgtacataaaaaacgtacgcatagcattttcatttaatcatatgcatgccatgtcgatatggactggatatggtgacaaggaatcgaggagatcgccgccggctggcctgcatccctgcccctacgtttgtgtcgtgcaaacaagccgttcaatcaaacttaacgacttgttggtgacatttctctaatgtgagaaatgtcatgccatcatgttatttttcacaattaatacacgccaaaaacatgcatgttgttcttggacaaactatagaagagccgtataaatataaacctaattgcatagatgagtcattactatcgaaattggttggttgttaatgtataactctaactgagattaatagtcctgattttttagggaacgaggtgtacgaagtcgatgaaacatgatcttgagcatgcaagtgacatgttggtggaagctgaaattaagaagacaatagttttgaaggaaacaactttagttccttccattagttagaatttaatttgttgttttctatactctataataggtgttgaatttgaatttgcatgtttgtaagttccccgttttaatcaaaagttttaatcttttttcataactaattgcatgacatcctctaaataggacatagacaatcccacaataaataaacaatctaaaatagtttgtttgctatacatatatgatatatccacatgttttctgcccttgcatcacagcctctaaataggacatagacaatcccacaataaataaacaatctaacatagtttgtttgctatacatatatgatatatcacataatttccgggcagaagaagtccaatttttatccgttggatttggtccaaatgtgttatgagacttttgatgtcttccaactagtttaactaaatatctatgacacactaaactgcataaagcaaaatagttgaaacactttgtagataactaaaccatcaaaatagttctaaaaaaatataaaaacttttttaaaaaaagggtaaaaaatggttcgttttttaccactcagattatttttccataaatcggatttcaaaacatttgcatttttcaagcttaattttatcgagcaaacactcccctttttttccatagactcctcttctctgttcgtgaatccaagatccgcttctttctcctgcggttgctctgcgctctcagcaccaaccaaatccccctccaattcctcatctttcttgaccaattcttgaaatcaatcagacgcaataatcaaccactattcttattatagttggatcataattaatcaaggttccgtgcgtcgccactgtgatttgtgcacttgcatttgatcgaattcgttgccgttgattgcgtttcttgatgttgtgtgttgcaggtttgaggtggatccatggcgatcaagggcggcggcgggtcggcggagaacagggggcggagcccgctcgccatggtggtcgccgtcggcctctgctgcttcttctacctgctcggcgcgtggcagcgcagcggctacggcaagggcgacagcatcgccatggccgtgaaccggcagacggcggcctgcggcggcgtggggctgagcttcgagacgcaccacggcggcgccggcgtggagaacgagaccatggcggcgccggcgccggagttcgcggcgtgcgcggcggcgatggcggaccacacgccgtgccacgaccaggagcgcgcgatgaggttcccgagggagaacatggtgtaccgggagcggcactgccccggcgacggcgagcggctgcggtgcctggtgccggcgccgccggggtacgtgacgccgttcccgtggccgcggagccgcgactacgtgccgttcgcgaacgcgccgtacaagagcctcaccgtggagaaggcggtgcagaactgggtgcgacacgagggccgcctcctccgcttccccggcggcggcacccagttccccggcggcgccgacaagtacatcgaccagctcgccaccgtcgtccccttcgccgacggctccgtccgcaccgtcctcgacaccggctgcggcgtaagcgacatcatcgccgaccacgcgcgccgccattgattcattccaccatagctcgctcgctcgctcatggaggtgttcgtccgtgcgtggcgtgttcaggtggcgagcctgggcgcgtacctggacgcgaggggggtgatcgccatgtcgttcgcgccgcgggactcgcacgaggcgcaggtgcagttcgcgctggagcgcggcgtcccggcgttcatcggcgtcctcggctccatcaagctccccttccctccccgctccttcgacatggcgcactgctcccgctgcctcatcccctggtccgccaacggtaagccctaccctcaccgccaccgccgccgaacacgactcccaatgcacacatatactacctctgggggcaactccaaaatttaagattagggggtgtggggtggggaagaggccataagaccgaataaccaatatcgatagcaaatgatgtcaaatagtcaccgttaataacaatcaatgtgtaaaatagttctttaaaaaaaacttaaattttagctttttaataatatcattaaaagtttggaactagactttattactaaatccttttaatgtaaactaatgaataatctcacaaataagaatcttctattttactttaaaaagatgagaaatcacaaagtaattttgtagatcatgtttcttgctaatgtttttagactttctaactaactaaattgataataattgtaagctacacaaataaactagataaatacatatcttagttagcctcaatatagagtaaaaacaggaggcgtgatggtggcggtgttcgtataggggggtgttgacctcctctggcacccccatagttgcgccactgactacctcaatttcaaaatgtgagacaccattaacttttcatatgatgttcgatcattcgacgaatttaaaaatttagtatatatatgcacaagtataagttaagactatagtttctttagtggtaaaacaagtcagaacaaaataaattaaattatagttatatttttttaataagacgaatagtcaaacgttatatgaaaactaaatggtgaatcgtcatacatttttaaatggacggagtatatgctgctccctccgtcccataaaaaccaatgtgacacattctagtactatgaatctagacatatccatgtccagatttgtagtactaaaatatgtcacatccagtcctagattttttttttttttgagatggagggagtatgtagcaagcgagcatgaactttgatgcacatgtcgccggctcgcgcgcgcaggtgggatgtacatgatggagatcgaccgggtgctccgggcggatggctactgggtgctctccggcccgccgatcaactggcggaccaaccacaaggcgtgggagcgcacggaggcggacctcgctgccgagcagcagctgatcgaggagtacgccgcgatgctgtgctgggagaaactcgccgagatgggcgaggccgccgtgtggcgcaagcgccccgacgccgctgttgtgtcttgccccacggccacgccggcgccgccgaggacgtgcgacgccgccgccgccagccccgacgacgtctggtacaagaagatggagccgtgcatcacgccgccccaagcggccggcgaggtgatgctgcggccgttcccggagaggctgacggcggtgccaccgagggtggccgccggcgaggtgccggggctcaccggcgagtcgtacgcggaggagaacgcgcggtgggagaggcatgtggcggcgtacaggaaggtgaactaccggctcgacgccggccggtaccggaacatcatggatatgaatgccggcgtcggcgggttcgccgccgccgtcttctcgcccaagtcgtgggtcatgaacgtcgtccccaccgccgccgagctctccacccttggcgtcgtctacgagaggggcctcatcggcatcttccatgactggtaaattcaacctgcatttccatttattgctttccatgacctgaatattactacctcttgtttctctctgtataacgttgattacttttcacgtaacgtttgatcatttatcttattaaaaaatagtataaatatataaaagtataagttaagattacatatagtttctttgattataaaagacatgtcacaagaaaataaataacatttatattgtttttttataagatgaatggtcaatcgtcatatcaaaagtcaattgtgacatacattaaaaaaacaaagggtgtattatccaagaatatgtaaatatttttctattgattatttttcaccttcttctccttcaggtgtgaggcattctccacttacccaagaacatatgacctcatacatggcaatggtgtcttcactctctacaaggacaagtgagtctcactcacattctgttcatatctgtttcttgattgcttcctcagtaagaaataagtaaggttttgaaatacatgtagtcaatgcatttaaactttgactatcaatatctctttgaaatttttttggttcagttctgaaaatgctatgattgtatttttctacaaaattactttcaaaataatataaccttcatacatttttatgataataattaacaattcaactagtgtcttgtaaccatgttaatgtccaaaatgatatacttatttatcactggaggaagtatatgctaatcatgctgctatgctctgttgagtgatctctgaagtgatgagaaattatgaattcttgctgtttgatgatgttctgtgcctaaacaatttgttggttttaatgtgtgagagaaggtgcaagatggaggacatcctgctggagatggatcggatcctgcggccggagggcacggtgatcctccgggacgacattgaggtcctcctcaaggttcagaggatcgcgagcgggatgcggtggaagatgatcatggcgaaccacgaggacagcccccacataccggagaaggtgctctacgccgtcaagcggtactggaccgccgacgacaagagctcggagccggagccagagccggagaagatgaagaagaaggcggggagctcttcacaagagaggagagctccgaggaggaggaggagagtacagcaagttcttcagaagagaagggttcagaggagtaagaggtgctgatcatgtgtgattattttcagttgttggggagttcaattcttttcagtgtgataggggagatcaggagttgtgttctttcgatttgatgattgtcttaggatgaacaatatgatgttcggtagcaggacttagcatttccatagattcaagaagcatatactttgcatgtctcatggtttcagctgtgcttgttgatcatttctcatagccataaacatgcagtttgcaacagattacaaatatttcttcaacttgtaatgctgaaacaagctgcccatgaacatacaagatcagattttcatgacttggtgacagggatcatataattatcatcagttaacactgctatcgaattgcatcatttttctctcttcctggtaaacaactctgtaatatggcaacatatatccgtaaaaggactggaagtggaaaactatagtcaaacgtgatctaagtttcagagcaagcactacaaatacaaattacaacagagggcaactatcacagtaggtatcagtaagcgcttcgcagtatttacaggagtgtgtaactatcaccattcaccaagtatcgatttatcgattcttttttagcaactgtcaagtgtcaactggccggctagcccttttttcgacctttcttgctgccgctgctgttttcttcttgagaagattgcgggaggctgaggcgaagctgccctggcaaagaatccgtcaggcctgaagaagtagccggggtgcttccacttccagctcgggatcgttctcgctctgttgatactgaggtccctggaaagagctgcagctcctgaggccgtgacgcataaacctggctggcaccagcagactgatggtgctgattgtgcaacggagataatgtgtttgttgggtgcaccatagctaaattcggaccattgccccatatgtgatgtggaacgggttgagttgctgagttactgccattgttggctactggttgtgacatcgcaagattgctttgattgaggtggttgtttcccatccttgcacaaatctcattatgcagttctaatatttgggctctgagcatgatattctcttcttgcagctcattattctctgaaccaacctgttaatatgttcattttagtattagctgcaaaggcaatgatgaatagtacctaaacaactatcggcaagtaataaatcaagcaaacagttgaattaacccactggaaatatgagaggaaaaggtgaataagaaagtaatgtctgctaattacatatttgcagtttccatgaaggcatttcaactgcaagtacacctatgtgtgactgttacaggaaaactacattactatatgcaacttaggttctacttataaaacacaccaatttcattaaaacaactcacgtattgacgctcagttagaagagcggactgttcctttctgagagattctacttgagaaacaagatcccgcagaactcgtgcagcatcacctaacacagtagcctttccactattttgtcgttcaggatctgtaatagcagaagtacaatgatcagaaaaggtatatgaatttgatatttgaagtaaaactaagagcagtaaacacaaaaaactgtttggtcaaggtaaggttctccaaataattcatcatgtgaagaaagttcagtgcaacgcactaaaatttatatgcaccaatcagcagacaactttttctaactgtttatcaatttgcacaattatgtcctagatcagcaagaattatttaaattctaatattttattacatgtgcaccatatcagctctgcatatatttctaattatggagtacaataaatgtagcaaaggttaacattgtgctgttttgacaaattagcatcttcattcatgagcaggctgctaccgaattgtcattactccatatcagatgaagttagcatggaagatgccaatgagcaataaacacaaaattatggataaattcatggtttattcgcattgtgtacttgaacagtaagtggccgttcaaagatagggttaattagatctatgcagtttaaagcaaagataatgcaaataaatagcaatcttggatttcagattcacactaaaaaatagcattgcatcaatcttttgtagggaccaaacaagattctcttgaaattttgttctcagatggaccactcaaaagggggcttcgaataaagcaggaaagccagaacttcacatggggatattttagcaaattgaacagtgtaggacccattctttttgggatcatagaatggcaggataggaatggcacagtctaacactgcaaactccaaaatagatagagacaacatataactatgggacaatagcaaataattgaattcaggaactaacgtatgtccacttaggtgttgtattcctaatttcatactctaaacaatacgcacatacttacatcaggtacctgcgacctgctaaaacacaacctaatttaagttgacttcgtattctccgcaatgtacactcagttacatatcattaagtaattaaaggaaagatggattcaagtaatagaatgcaagttgctggtactaatatttattttctcgaaagagcatagtatatctactataaagatatgacattgattgatgatgatgggactgtgctaaccaagcatactgctgagctcaacaaaaaggtcattcaactggtcacgcttaagtttctctcgttcagctttatgagttttctttggagccttttcctgagatcttttgtcaagagacctgcacagaacaaaaataagcatcacggaaatagaagtacatcatggtaggaattgcactgctatgggaaataaatgtgcggaaagcatgaacagcaacaagattcagaataatctgaaagtgcacatgtaaacataggtcaattttaactcactgataaacttaaaaggcgaagcaattctgaatcatggtggatatctgaatatgaaactaagcatcatacatattttgattatcaaatatcatgtaacgtaagctccttaaatgataccaattgtcaactgaattgatgttttgaatatttaatattattgctactctgtcagcaacttactatgggcaataatttttaatatctactctttatgcgaaaatcattacagcacatataacagataaataacttcaaatctatcatccatagtgagctcactcccccgtcatatgacaggatcacagggtaaaggagaatggacccaactgcacgatcctgtgtttagtggttactcttgtcataattcctaaacagtctctatctcaagaaggtttcttgtcaactatgtttctaataaaggaaactctatcgtcttggatttgtccatttgtgcattgtatataacctttctctttcaaagtgacttcagagaacaagtctcaagcatacggagctatggttagcaaaagaatatatgcatgaaaaggagaactaagacgaaatagatgatgagcagtgctatacatactaaaaaaaaatcttaccaacaaaattcttggaagttatagaaaatcaagattcaatcatagtgtgccacatctgtgtttgtaaaaattcagtaacattttctttatgtgtagctttttcctcagttggttgatcatgatgaaggcaagtttcttgtgcttgaactactggccaaattacgctttcatgcacttttgcaatggatatttacaaattacagctagtttcaatgtgggaaccaaaccatggagataaaaaaaagagagagatattatgattgacgggtagatgttggccctgtttagttcacatcaaacttccccccaactcccaactttccatcacatcacatccaaaactttctacacacataaactcctaacttttttttcaaactaccaactttccccaaacttctccccaatttcaggaactaaacacagtcgttatcattgttccacaacaatagcccaaaacaagtagtacagaaaatgtggtgataaatacattcagattcggcaggatattagaaatgagaatgtaagcacgttagccaaaattagagcataaatacaacctaaaagtgtctaacgcgacgacaatagcctaattgtccatagcaataaaaagacattggttattgttatgaagcttaataaatgggaattggataaaaagaaagtaaacagttaacaacgaacccatcaacagccttgtcagaagcagcatttgagctgccacccagtgaccccgagctctccgtgtcagccaccatgcccagattctggttcctgcatcacacaaaggtaatactggagcaccaaaagaaacaaggctcaaaaccaaatcgaaaacaactcctcctcctccaaacatcatcaaactattagaagatcaggctcagtccattcaaaaaacccaacaatgataacacagaaatcaccagaagctacacttttttatacctacacaagaaaccaaactacaaatacacaagaactaaccatgtgtactaggagacaaagctagcttagcccgaattcttcttgcaagaaacagtagtactaaagatctgcacataatcccaccaagaaaccgttttcttctctttcttttcccccacatcaagaacaagaagccagcatgattagttaaccaggaggggggctgacctcacttggggcatggggaggggggttcacccccgaacccccaaaatctttctttcttggaccctcaaccaacccagccacccgatccggcaggtgtggaaggggaaggaagccagtcaggcggggtcagcaagaagaggaggagaaggcgacgccgccgcctaccaccaccaacaccaccaacaccagcttgagctgcagatttgtaagaaggaggaaggagaggggagggagacgaagaccgagagggaggggagggtggaaagtggaaaaggtgggggaagaaggcgagcacgcggcgagcgtgtggcggccacccacccgcacacttgggtgatccggacgccagcgagctgacacatggcgacgacgacgacgaatcccgtcgccatcggtcccacggggaattcgcggatcgagaacaaaagctgagctcccgttggattgggatgatggatcatggatgggatggcggaggaggattgggatgatgacaactttctttgcttgcttcttcgtcacctctcttggtgataaaaattcgatctttattcgttctgtccttgctgtaaattgttgatgccattcttctttttttactacttcctcagtttaggttatacatctatgtaagtaaatatgagcattgctagtaagaaaacttgaaacagagatagtactacctttatcggtagtatattatttatgggttaaatccgatttatcttcttaactattcaaaagtttaaattatccttttaacttttatattatacattttacaccacataattatttaattcgaacaaattaccccttttctagctattaggtggttttggctctcatatgtatgtgcaaagccaaaaccaaatgtgagactagtcacctccttcctcgtgcatctaccctcctcactcgatcgtgcaaagcaaacctcaccaaccacctccaactctaaggcaatgtttggctaatgggaaatggaaatgatttcccacccaccaaaaggcatctttaaatactaaccattcattctccctctttcatttaatcctaacccttcattcatttcccaatcccaatcccaccctctattttccattatccaaacacactctaagttcttaaagaaaaaaaaaactccaaaactagctacacacgggccatccagccccatcatttggtatattggagtaaaaagcaaaacaacatatttatcgaatgaaaaataatttgtgaatataacttttatatacgtgttcttaataacgatttaaaaacaaatgaaaaaaaataaactacgataaaaataccttaaaatcgactctaaatttacggttgaaaattcacgaagccgccaccgccgtttcgcatctcatcctgaagctggtgctgcacagcataaaaaccaatagtgtgtggcgcgcctactctcatgctaaaatctagccggcatgcatgcaaagatgcaatggtgtaagggcaggattaaggccctccttgtttaggcttataagccaacttataaatcgaaaagtttaagcctaaacaaacaagcagctttttcatttgtcttttttgaagctgtaagccactctaacactattaagccaaaagctaggttagagaagcttttttggcttatgtgaggtagatgtatgactcaactactaaatttaggacattaaatctaccggcttataaatcatataagccaataaactgacttgaaagtctaagtcaataagtttaagcctaaacaaaagggcctaagtcgttttgcctgtgagctgagtcaacctgatcaaataactcacaaggtgttgcttccgactattcagacttgagagcagtttactactcgtacaagatagtggccttaattaactatttgttgatggatgcttacgcaaagactagctaccttacttccctaaaacctgtattaattatgcaacatatatatgtagaacacttttatgcgcacacagcgtcgatttcgagagaaagaagctgacaaattggtcttacgatttgtttctaagggcaagttttataatataggttgttgttacctctaatttcatctctatcaccaatctataattaagaggtaatctatacaataaaagttacctccaatacacaaaacccaataacttgctacaggacactcaaagtatgtagcatttatcatgagacacccaaagaacgtgtatcttctcgtggacattgcaaaaatatggtaattagctgctggatatatgtctcattattttattatttttggtggaaacggagagagaaacattggttaaagacaagtttgcccagggacccacttctcaatctctctttctttgttcatcttcttatgtggctaccttctttctcatgcgcgtgttgtggcagctatatagcacgtgcaacagctggctgggctagagcacggggcggcgcgccgccactaggtaggggtggacgaaaagctcgtggctcgttagctcgttcgactcgcgacaagctcggctcgactcgtttcatttttctaacaagccgagctggcattttagctcgttagagataacgagccagctcgagctagctcacgagctgctcacgagccttaacaagcccatacctcatcaggctgccaggccacaaagcccataggcccatttatttagaaggcccaatagacaatagtgagcactaaaagtgaaaaccctaggtcattcccttatccctcccctgttcccttgcggctggtggctgagttcccccacacccgatgccaccgctctttgcctctcccccagcgcccgacgtcgccgctctcccccagcgttctcctgcagcgcctgacgccgccgccacctaccaacccacccacctgcggcgccgcccggcagtgaacatgagctcctccctatggtgtcggtgagctcgagctcttctcctccgccatagtgctcctccttgtggtccaagtgccggcggaggtcaagctcgtccccttcaccgtcgtgctcctctccgtggtcaccggcgagctcgagcttgtttcctccactgtcaagctcctccctatggttgcagtaccagtgaggtcgagctcgttccatccaccgtcaagctcctccggttctccccgtggttgccagcgagctcatccccatggtcgcctcccttcttgcttgcccccatagctcacgagctaaatcagctagctcgatcttgcagacaagccgagccgagctaggtttctagctcgttaggataacgagccgagccgagctagctcgttatcctaacgagccagaccaagccgagccgagccagctcgacatccacccctaccgctaggagtcctccccggggctccgtttcaaatcgggcaacagcgaagtgggcgccaccaccgtcagccaaatcctcgcgcggtatacgtgccccgtccaccatttttgccatgggtagatcgagagggatggctccgcccacacggacgagtggctcatcctcctcgccggaaggggcgtcgaaccctgaccctaatcttctcgaagttcaacaatttcctcttccacacgctttacaccgccattttctcatgccgcgagctcaccaaattggagctcaggagctgccacctcccggctgccctcggacttctcagggttcccaaatcttactatgctaatgcaacatcctgaaaatgcgtcattttctaatcctgcatcatgccgattattatgttcttaataacttcctaaacctaggataatataattagagggacctcctagaactaactcgcacaaaacctctctggtatttaatctcttttgtgtttttcatttaaaaatatatatttggttaaattgaggtgtttcttgatttggtttaaaaccttcttttgattaaattttttttattcaaatttagtttgaaaacccctttttattattatgaattgtggtccaagaaattctccactattgtcctagaacctaaaccaaatgattccaattttattggatttaattgtcgacccatcatttgattttaaacctatcctttgattccaagcctattcttatttatcgccaaatatctaaattcttccttttgatctagccgctaatttaattcccgtggcttgatttccttctcggtacaagaaaaatattattacaaatattgtgaataattgctcttgtgctaagaaaataaatttatatccttgtcacctaaatttccttttagcctcaaacaattccttgaaacccatgccatatattttagggttcaaatcctatccttttgcctccacatattttcctaccacattccaaaaaatattttgaggaatactattaatttacttttctatttgagtgcttccaaataaattccctcaaactccacctctaaatattgcactcaaataaattagaaaatctcctttgtgaattctctcctaattcaaattcttcgcaaaacctagttatccaaatcaagtatacaaattagacttctttctttttgtcatcgggccgaaactccgttctttcttccttttggcccaatcctttttctttctattttcctccttcctcttgggctgccggcccagctaagccgagccggcccagttcggcccacaacccaaccgcctccctcctcccagtgcgcgtgcggcgcacgccgccgcaaccgtcgccgctaaggaatcaagtcggcgccgtcatccttcttcccacgccatcgccgtcgccgattctcccttgtcttcctcctcttcgaaccgcctctcatcgcctatataagaggatgaaccccttctgtttatcccccacaaaccgagcttgaagctctcctctcttttctctctccttgccatggccggctatcactgtcgtcggccgatctccctcaccggagcaataccggccaatccctcgcgccatcgagcttgcctcgatgagaggaatccatttttcccctttcccctcttcctccacctctgaatcaaacctcaccggagctctctctctcctcccggttcacgaccttccatccgccgttccggctatttcccttactcccttttccggccactgccatccctaggtgccttgcagtcgggaacaccactggccgccggcgtcaccgcctcctcgccaccggagcccggcgccccctctcctcctcctctctgttcgaccgaggagaaaaagaagaaagagacgggaagaagaagaagaagaagaggagaaaaagaaaaagaaaaaggaatccctgacaggtgggcccatgaacagtatactttcgcaatttactctatttaattcaaattccaatatttagaagcccatatctcctaaaccgtagatccgatctcagtaaaacctagacctaaattcatctaaattcaaatgcttcattttgatgcctaatttgttattttataattttatttgaatttattcaaatatcatttgaatttatatttgcctttttcaaatattttcttttaccccaaaataccctttagccactaaaaagccgccggttggaactttatgccttccatggggacgtttgcggtctattggccccaacgtcgaaccgttggttgtaaatcccggcaaaaccaaacccaaggtcgaagtgctgctcccggcatcccacgccttgatgcgtacaatggtcggagcttcactattccctcgacctccacagcacgccgtacagttagctcttgagctctgtgtgatcctagccgctccgccgccactcacggttgtcggagtaacacttccgcctcgctagacctgcacaaacctcccatccctctggccgttatattgtctatcgacaccggctagagaagataccaaacctagtcgtcatgctttagctacgactagcgaacacccaaaccctagccaatatttatcttacctcgatatcggcttagacaactgaaaccttaatcagcctgccatccaaatcccacatcaactacaatattacttatccaccatatcttagccacctactctccatctacccagaacctatacataaaatatagaacctggccgatatactgccctactcctcaatcggcctaaatataaccgaaccctaggtataatcctacccaaacccactatcagccaataccagtcacatatctgctcaaccagttcaattatccactatactccctatccaccaaccaatcagagtctgcacataaaatataggtgaccttagccgcttaattccctctctaccccagccaccaactctttagaatccacatataaaatatcagcccagtaatccatatacctgcataaaagagataagctataccctaaaccctagtcctcctaaccgtttatctctttcttgctattttatggcttttattgaatttggatcttcctcttcttcagtagagtctattttatatggatggcaacctgtggtatttcaagcatcagataatcaggttgcctatttcggatttatttgcgttggagcaaggcaagttattattcctccccttgagcataattaccctatattctatatcccttttctatgcattagtcattcatgattttgaatgcataacctgaacatatagcaaaccagatatgctagcttttgcttagccctgcctagttagattatgcacaaaatttaatgaacttagattgggatagtatggtagaaatggttgatttccgggtggctagtactgttccaaccgacataagattgccaaagtacatgtgaagaacatacgagtacgaccgcaattctcgtatgggcatagacctagctgattaagttatctagcaaaggtggtacctctgtgtagtggttcttatttaagtcctcgcgcaggaggcaaatttacgccgcgaagggcgattgtgatatttaccgaggcgcaggtaaatatatgagatgaattgtgatatcacgaactgtttgtaaaccctgattgcgatgacatggtgtcatacaatcagttctctctaaaggcctcgggaacgctagaactcctctcgctgctgataacgttacgttcagagcgcatggggactagagttcatggaacaagtaccactgatgttagtgaccgaaaagctttgccatgacaaggctaatgtgtttggcacgtcatggattgcgggtaaagcgtacatctactgtagtatgaatattattaaaactatttgaatagccgtggtcgcggttatcgggcattgggactcacaatggcatcttggttacaaacataatttcaaactttattaaatactgttgcatttaaaacattatagactttccttctatattctctgctttctgcaagtaaatctaaccctactcaaatattattatttcatgcattcgttgttgattaatataatagcttgctgagtacgttgtactcacccttgctttaaccccacctttttcagagtcattttagagttcttaccgaagctgggagttcaatcatataagttaatctcattttaacttagttctcaagtatagattagatagatggtttaagtctatagcaaaacactagagttgagtcatcgtatagcttctgctgtaatagttagccacaagtttgtaaataccctattattttatgtaaaggaatctcctttggagccttgtcaaaatatatgcaatgaagaaccagattgttgaacctatatcaatctactgatccagggcttgattcagcctaaacatgtcggttaccgaatcattagtttcgggacccgacagctaaccctcaccacggttgtttttccgccgcatggggagaggactcgctgtggtcgagaacaacgcatgtgctcctcggctccagccgtggcccgcagatcgatggcacgacctcgtcatccgcctcaacaacgcgcccatggcggagcagagccctgtgggagaagaaaagaggagaataaagaaaaaggaagagaagtaggaagaagaatagtgtactggggcattttggtactttcaatgctctttctctctccgtttccaccaagaataataaaataataaggtgggtgtccagcagctaattacctcatttttgcagtgtccatgaaaagatacacgttctttgggtgtctcacaacaaatgccacaaactttgggtgtcctgtagcaaattttgccataactttagtactatcacatttttattgaattttgtgtagagattatccagaggtggctccttcactctcttcttccttctcttttccacatcagcaaatgagtctacatgtcatctaggggcaagtgtttaagggcttatagtacttgccctaactgggccaccacatcagcttaaaaccacaaaagaggatgtaatttatctggattaaatagttaggaggtgtaaaatatatggtataaaagttaaggagggtaatttatagttttatgataggtgaggaggttaaaccgaacttaacccattatttatcagactctcagggatgtaaggtaggaaaaattcagagacatgcataaaatgaattaagtgacatatctatacttactataaagttataaagttatagtccactaaatctaaagctcaatatataaccatgtcacatcatcacccactaataataatacatataacctcatacaagcatgcgacatcatctacaatttatttaattctacaaattaacatacaagcatatccaattatcatccctcacatcatttgcacaatatttgaacaaatctatctatcatttttataatatttaatatatatttaaatatgtttcatattaaagtgcaagtattatttgattatttcatgataattgctgataaaccctgatgtttcattctgtctgtcatcttttgaaaaatccacagagttacgagctttttaatgagtcctatgacagctcatactaatattactagacataaaaaattgtctcatatgtactatttgcgagggacctagatcgaattacggaaacatagaaggatcttttcgcaaaaaaaccaccccacgcaccgtttctatccaacgtggcatagccgagcgggcgccccttccgctgctcttaatagtttctcattagatgatatatgttgtagacagcttttcttgcactccggtactataatacgcgccagcgtgtcactagagcaaacatagaaactgaaattgttccagttgataatggtcatgcgccatttcactagtaaagaaaaacaccttaattatatttttaaaccacggtaagaagaaatttcacaaactttttattcttattaggcgctatatatttaaaatgaatgaattctgtagaaaaatcacacatgaaagtacatgacatagtacataatcgagatttcatctccattcaaataacatagttctagtttttttaaaattaagacattcccattacagccccattcttttttactaatgccgaaaaattaggtacggattattaatgccaactttaaaagtacaattcaattcctcagaaattttattgcacataccaattctcgatagacattttatttcaagctatctattaggttaataatatataatatttaattcatctgatttaagactttgttcttttttgatgctggatttttatttgcatgtttcccaatctcataaacgatacatttcacacaacaactttcttaaaaaaagtttcgtagactacttttctaaaataaccttttcactttgtaatagttttttttcacttgtttatacccacaaataactatcacaaaatcaaattatccatagatccatcaattttatctctcccaaacgggactctatcaggtggtgtctgagataaagttgaagttaacgcatgcaaaacgagaaatccgttaacatattgttaattaagttttaattattataaacttgaaaaaatagatttagttaatattttaaattaatttccgtatagaaatcttttaaaaacacactatttagtagtttgaaagacgtgctaacaaaaaccaaaataaaatctacatcagggatgtaggtatcgaattttctcattattcgggctataataaaaatgaaccatgggtgtgtttagttctttaggtgtaaagtttttaaagtatacggacacacatttaaagtattaaacgtagattaataacaaaataaattacagatttcacctgtaaactgcgagacaaatttattaagcctaattaatccgtcattagcaaatgtttactgtagcatcacattgttaaatcatagcgtaattaggctcaaaagatttgtgtcgcaattttcatgcaagctgtgtaattattttttttttcacgtttaatgtttcatgcatgtgtccaaatatttgatgtgtcgtttttggctaaaaattttttggaatctaaacaagtcccgtttcaactttcgagcggtaaacattcactacgccgaacaaaaaaacggcagcttcacacttcacagcagcgagactgacaagctgacaggccagtacagcacacctcctccagtactggaccagcaaacgaatccgcataatctgagaggtttacccgcataaatcctaggaattattctaccgactgtattattgatctaacgatctgagagaaaaattatgccctacgagcacttgaaccccctccttatataggggcaggaaccgaaattacaatgtacagcccatatgccttacgaacgactaggctaagtaactgactaagattacgggatatttccttaatatacaagttaacaaaaatacccgagtcctttcctaaacatattatatctgtataggctatcccctataaccagttggatatacatgctatgggggtacgtggtatctataatctccacaagagtatatttaattcgactgttacaattcagggactggattaaatacctgaatttcatgaatcgctaggatttgcccattcatgtgtcacgaagatgtgggtgattgagagttaattactgacacatgcattatgttagggttttggcggcgctcaggcgattttgcggcggcggccgtaagtctcgtcgtgagatgtttctggatggagctcgtcttcgatccacgtgtgttgtctgcagggttatcgcctgctttgaggattcgtcgtccggcttccaatcagattgtttgaggggttttgatctgagatcggattcatattcttatcatcaatggtgtgtccggcctggttgcaaggttcagtcctttccctagaatttcttagttcccaatcgtaacataccaggagatctttgcctttggatatggagatggattgtgaagaaggaaacgtcacgatctggtccgggtgccgtattcgttctggattcgttcttggtctccggcccttatataaacaaccctgggtcagatctgtcaagcacaaccaacaattgctgcttctgcatctaatctgacgaattagggctccggtttctttgtcgtctctttcgggtcatggcgtcttctagcggtgggggtgataaagggatcgtcactgggatggtcacccacccgaagcccctggtcgacgcgatgctctcccatcaagagacgtctactacggccaaggagatcatcttggccccaaataagcaggctttggagtcagcgagtcagagtaaagataagatgatccacgctaatcccaagaccttgccagcgacgggggctagcgacacctactcaactgggccgggtgcatacacagaaggagatgtggaggaggaggatgatgaagcggtggaggtactgctagaagatgatgaagtacaactagctgggcagtggacagttttgtcgagattctactcgcttcgatcacccaatcaagcggctctatttgatgacatgaagcgtgcatggagattgcgagctaacatgaaggtcaagtccctgagagataacatgtttatcatcaccttcagctcggaaggggattacaactttgtgctccagggcggtccatggcttcaccgtggagacgctctgcttgttgcaaaattcgatggcctgacgagcccgtccatggttccccttgagtttgtgccaatctgggtcaggatttatgacctccccttggtgcttatgacaaagaggaggggagaactgtatggcagcaaacttggacatgtgagggaagtagatgttggtgaagatggcagaaacaagcatgacttcttccggatcctggttgatttatcagtcaagaagccgctgaaaacctcgcttgctataaaattaatgtgcagggaagtgaagctgtctgacgtttcgagctacgatatgagagggtgccctttttctactttatttgtggttacatcgggcactctgataaagactgtgacaaaagaattgccaatattgatcaaccttttcgttactcagctgagctacgttgttctccgctgaagccttttgagagaagaatgagcacaatccatggccaacaaaagtcaggagtggcacgcaatctggccttccgtggagcagggagtgcaagctcgtcatcctccaaacaggggaaaggtaaaagcagggaggagattattcctgacagggtcgatgctcaggatggctttgagggaagagaagatgtgggggacggggtggtggatgaactgctagctagtcagactagcaatctgaacatgtcaggtgagaatatggtgcagaaaggagaaccggtgggtatggaggaggaacaacgccatcagctgtcaacatctaaccttgtttctgatactgatatgattctagcaatacagaacctgcagcaaccggcatcctttggaggagagtcttccgaggacatcagtgataccaaccggaaaagagtgcaaccacagagcgggagcaagatatccgacagagttcaacaggccttagtattgtatggtcaaggatctggtagagaacaggctaagcaggtggacccaaaggagccagcgagagctctcaaacggtttcggaagacggaggtggaaagtatggaagttttggaagcaaccagtcctggggctactggtaaactgacgggacccgctctcagggcccgtcaggagcaatgagttgcctatcatggaactgtcgtggtttggggaacgctgcgacagttcgcgatctgtgtggcctagttaaagaggccgattcccaaattgttttcctaagtgagactagacagaaggcggatagaatcaggcgtttacggaataggttgggtcttagaggttttgctggagttgatagtgatggaatgagtggggggctcgctttgtactggcatgagtctgttaatgtggaaataaaagctttgtgtgagagatatattgatgcttatgttcgcttgtcgccggatggccctctgtggcatgccacctttgtgtatggtgaacctagagttgagaataggcacaatatgtggtcgatgctccggtctctgaggaattcatccaatttaccttggcttgttattggtgattttaatgaagctctttggcagtttgagcatttttcatctcaccctaggggagagccccaaatgtgagctttctgggatcttcttcagtcgtgtgcactttttgatttgggattcaggggcacaccctttacttatgataataagcgccagggaagaaacaatgttagagtgagacttgatcgtgccattgctgacaatgcatggcgtgataccttccctaatgcgactcttgcacacctggcctccccccgttcagatcgctgtcccatatccttgcaactgtctcaggagatgaaacagccagccaggaagaaaatcttgcattatgaaatatgttgggaacgtgagccgtctttgccagaagttgtgcaggaatcttgggtggaagcagggactaaatctgacctgggtgatattagtgctgctctacgtaaggtcatggcatctctgcattcctggagtaaggtaaaattcaagaatattggccgtgaattacagaaagctaggaaaaagcttgctgagctgctggaaacatatgcagatagtgctgctgttcgccaagcctcggatcacatgaacgaactactttatcgtgaagagatgttgtggttacagcgctcacggattaactggctaaaggagggcgaccgtaacactcgcttctttcatagtaaggctgtttggagggcaaagaagaatcggattcagtctcttaaagacagtgctggcactgtacaccgttcggcaacagcaatggagcagctggctactgaatattttcaggaagtgtattctgccgaccctagtctggatcacagtatagtgtcaagtttcttccagtcgaaagtttcagcacagatgaatgaggctttatgcagcgatttaacagaagaggagatctctaccgccatcttccagatcggcccgctgaaagcgccgggccccgatggattttcggccaagttctatcaacgaaattggggcacaattaaaagtgaggtagtcaaggcagttcataatttcttcatcataggagtgatgccggaggggataaatgacacagcaattgttttgattccgaagattaagcagcccacccaactgaaggactaccggccgatcagcctctgtaatgtcatttataaagtggtaagcaaatgtctggttaacaggctgagaccgttcctagatgaactggtttcgcctaatcaaagtgcttttgtccctgagcgtcttataactgacaatgctctagtagcttttgagtgtttccatttcatacaaaagaacaagaatccaaacaaggctgcatgtgcttacaagttggacctgtccaaggcttacaacagggtagattggaggtttttggagcaagcaatgcacaagatgggtttcgctcaccggtgggttagttggataatgtcgtgtgtaaccacagtgagatactctgtgaaattcaatgggaccttgttaagtgcattcgctccaacaagaggtttacgccagggcgatcctctctctccatttcttttcctgtttgtggctgatggactgtcactccttctagaggaaaaagttaggcaaggagctattttgcctctttcacgtttgccgacgggcaccagggatctctcacttattgttcgctgatgataccctactgttttttgaagcagtgaaagagcaggctgtggcaatcaagcaagtgctgaatgactttgccgcaagcactggccaattgattaacccgtcgaatgctcaatcatgtttggtgcggcttcccctgcagcaatccaacaggatatcagatcgattttgcaagttggtgataatggtttcgatgacagatacctggggtttccgacaccggagggtagaatgaagaaagggcatttccagagtttacaagagaaggtttggaaacgaattctgctgtggggcgaaaaccatctgtcatcgggtggaaaggaagtgcttataaaagctgttcttcaaaccataccggtttacgtcatgtgtatttttaaaatccctgatgcagtgtgcgatgagctgacaaaggccattaggaacttttggtggggagcagttgggggcaaaagcaagacgcattggaaatcttggaattccatagccaagtcgaagcaaagagggggtctgggctttcgtgatactaggctcttcaaccaagcgcttttggcccgataagcttggagactgttagagaatctagatagtctctgtgcacaccttctaaaggcaaagtactatcccaacggttccatcgttgacacctgttttagcgggaatgcttcacctgggtggagaggaattgaacatgggttggagctactcaagaaaggaattatttggcgggtgggtaacggacagtccataagagtatggcgagatccctggttaccgagagattattccagacggcccatcacccgcaaaggtaattgttgtatcaagtgggtgtcggatttgctacaggatgatggaacttggagggttgataaagtgcaggaacacttttggccgatagatgtagaaatgatcctgaagattcgcacctcagcttcacttgaatccgattttttggcttggcatcctgatagattgggaaaattctcggtcaggagtgtgtaccacttggtcgtttcgcttgcagagaccggtgattgctccagttctacagaggtgctagtaaataaatcttggaagcgtatctgggcgtgcaatgtcccacaaaaagtcagaatcttcgcttggaaggctatatctaatagtctccccacaatgaagaacaaaaagaagaggaatctggagttgttgagcacttgctgcatatgtggagccgaggaagaggatgttgcccatgcgctttgtcattgtcagcaagcgaggaacctgtggtcggctatgtattctgcgagagccatctctcatgacgtgaatagtgcttggtccgggacggattggatcctgaaccttttggaggatgccatgtttctcatgctaatgtggcgcatttggcataacagaaatgagatcacccatggtaaatcaattgcgccagtggctgtctctcagagattcatctttagttatgttagctcgctaactactattaagcagtaccctcaagctgacataattaaaggtaaacaggtggcacacccggaccgcattaggcttcccagccaagctccccccgcagtcagttcgcctaggcgctgggagaaaccgagcacaaggtggatgaaattgaacgttgatggatcctttcaggcttcggatggtaaaggtggaattggggctgtttttagagacagctctggaaatgttatttttgctgcctgtgggtctatgctggtttgtggtagtgctatggaagcagattactcgcgtgcagggagggtattgcaatggcgcttcaatggacgttcctgcctttcattgtggaaactgattgcttagaggtgtttaatctaattcaatcaaaagagaaggtgctgtccgagttagcttttgttgtcaaggaggttcaggtcctcatgacaggcaacagggagattaaagtcaggaaggagtcccgtgatcagaatagtgttagtcatcatttccttgctaacaagggaagatgtgaggccttaacttctttctggcctgataacacttgtaatctcatttcacatctcatcgatgtggactcaattgagtaatatagctccctgttttcccccgcaaaaaaaaaaaacctgaatttcattagctaaagatcagctcgacgca

SEQ ID NO: 75994 - DNA, 1762 bp, Oryza sativa
taccacccaccgacacacccactcgcctgctgtcgcgcgtcttttgtcgctgccactggatccgggcggaggacggccgtcgctgccgctcgtctgcctgtcgacgcgccaatccacccgccatcgtgctcctctcgcctttgccgccgctcgccatcgcgcctgctgtcacccgccccatcgcccccgcccaaggtcaagggcggtggatccgtcatcaccaaccctccgtagtgctgtcactgtcacccgcccaaccaccgcccgtccgtcgttagtagctgccgccaccggtcgtgcgggcgccaagcccaccgtcggctgccgagagagagagagagaggagaggaggaggttatagagagaggactgagaagtggtggagagggaagaggataagaagagaagtggtggagagagagagaggaccgagaagagaagataaggttgcctgtgaaaattttttgaagtggtggagagggaagaggagaagaggagaagtggtggagagagagaggaccgagaagagaagataaggctgcttgtgaaatttttttttgaagtagtggagagggaagatgagacaaatcagacttagcagacccttacgagacccgcattcaaaaatgattttcttatgcggacctcttaagggtccacatgcaaaatgagcatacggcccctaaagagacccgcatacaaaaatgaatttttgcgggcctattaaggagtcgtatgcggaaatgcctgctcgatttttacaggtgcgggttgttatggtctgtctgcaatctaacgaggatctcgttcagaaaaatcatttctgtagtggtgatattatgtgaagtattttgcccaaatgttagttttttttaatatgtgttgtcgtgcgtttcatggcaatttggtgaaaaaaatctataacttgctaaagctaactagaaaataagcttcataattgagatgtatggtgccacacgacaaaatttctcctgtcaccattgtaaaattgtcttgggaaatgaaaatgttcccatattctttgtatgcctactctgaaaaatgcttgaaaaatggaaccatagcgaatttacaattacttgatttggtgttaatccacgccaaaattaaattaagtctctgaatctacctacttttgacctccaaagatacattatgcagcagcaaggcaaactaacctggtactaaactactaactattatattgatcaattgattacataattcacgtgtcgagcaatgcttatcttccatccttgaaagctgaatatcattcgaaactagccttcgtgttcttgtttccaagatggaattaaatcttcttcaaaacgtcattacagccaaagaaaagcatgggaaatttcaatctaatgtcataggaaaacttcctctcctcctaacttctaccaacaagcatttgcgatccacaaaacaacactgattctcctcgaatccatcttgaaaatcacactaaaaaacactgattctccttgaccccattttccatgcatcttgaaattaaatcacgagacagtttagtaggatccgtggctatttaagccgcttgatatgatgactggtagctcactggatcatcagcaaagacaagaagacaagaacaaagcaagcatggagagatcagcactaacaatggcgctgcttctgcttccgctgctcgccgtgacggcgagcgcccaggtgttgtgccggtcgcagttcaacctcgccaacgaggcgtgca

SEQ ID NO: 75995 - DNA, 1676 bp, Oryza sativa
  unsure (1)..(1676): unsure at all n locations
agattagtcaaacttggaaccaggtaatttgaaaaaaaatcaaacgacttttaaacttgactggagagagcagaatataaacctttttacttatgaatctgaatatgtctatattccttgtaaaaatactactccctccatctctaaatgtttcacgccgttgactttttttanacatgtttgactgttcgtcttattcaaaaagtttaagtaattattaattcttttttctatcatttgattcattattaaatatatttttatgtatacatatggttttacatatttcacaaaagtttttgaataagacgaatggtcaaacatatttaacaaagttaacggtgttaaacatttagggaatgagggagtatatattttgggatagaggtagcatatccattccattataagtttttttatttatttagcaaacactaagattaaaaaaatcatttcagtcatctaaatggttaatttttttataaaaaagagtaaatttaagcatacctaggttttatggtcaaaattgcaaaaaagaaatcataggtattattacatgagccacttaaccccaaatattatggtttgaaagttttacaaaatgccaccttaagcattttgagcacaaaattaatatataaaatttttaatggtgaagttctttactaaggttgatagtttaattctttcctattttcaaaattttgtttaaaatatgctgacatttatcaagattttaattaaggtggggttttatacaacattgagacattatgtgtcatacatcatataagcattggttttctacaactttaaccataaaaacacgagattttccgaaattttttagttaaaagaaaatagaattgcttaaattcctccttgccagcacctgattggcgcaaattgtatgtattttgatgcatgcattgtaagaacctgtggcatataaatgtctatatcgtggtatgaattcccaattttatatgtctacaacgacaaaactttactttgggtatgtattttgtagacaacgaaactttcttcggctgagttcttatcccaatttttccaactcacatctctcgttttcagcacgcacgcttttcaagctgctaaatgatgtgtttttttgcaaaaatttctatacgaaagttattttaaaaaaccatattaatcatttttaaaaaataagttagttaatacataattaatcgtgcaataacgtgtgctctgttttgcatgccggggtgccgaacacagcctttgaaactttttattaccaaattaaatactccatatagcaatgacgactgggagcgggatgcatggtataagcactaatcagtcaagaaaggtgctggcagaaacgcgttactagctagtacgtgtgagtccggccaggagcatggatgcagcttcttgggcatgacggagcaaatacgtatacgtgtagcatggatgcgaccgagcgtgaagactcggtcggtcggtccgccgtgttcatgttacatgcggcgacggtttcatgactagaccacgaccaccacagacgacggcatggtcgtaggttaacttccagggcccttctgtcaaactaaccactctgggacgagatatacgtagtgcaaaacctaggcaacatactagtatagtagtagtggtgtagtaggagt

SEQ ID NO: 75996 - DNA, 1512 bp, Oryza sativa
ccccgcgctgacaccgccgtcgtctctcgccgtcgcttggcggtcctcgccgcctccgccgcagactccgccgccgcatctcttgggtgagagccaccgctgcctctctctctctcgatctcgatctcgatatatctctctctccacggccaacgaccgacttcgacgcggccgccgccgccgacggcgccaccgccactgccactccgccgcccccgcctcgagctcgccacgccgccgcgatgccacgccgtcgccactgccactccgccaccaccgcctcgagctcgccacgccgcggccgccgcgcgccgctgccgcgcccccacgccgccgggccccgacgccgccgccacgcccgcacgccgccgggccggcccacggcgccccgacgccaccgccgcgccgccacgctactgccgcgcgcgcccaacattgccgaccgtttacgaacgtgattgaaacgtgaccgaacgcgaacgagcgttacgaatctttgacgaacgcgaacgaacgtgcacgaaacgttaacgaacgcgaacgaacgtgaacgaaacgttaacgaacgcgaacgagcgtaacgaaacgcgaacgaacgtaacgaaacgttaatgaacgcgaacgaacatgcacgaaacgttaatgaacgcgaacgaacgtgaacgaaacgattacggaacgcgaacgaacgtgcacgaaacgcttacgaacgtgtatgcacttgtactaaaagtgtgagaacgaacgcgtttatactaatacgatttactggtaatacatatatgattatatatgtaacttggcccgtttagactaatacattttcctgataatgttgcagagaagacatcgtcgtcgtccctcaagccgaagtggtagctagccatcgaaggaattcgcgcaggcaaatgatgtaaagaagtgattgttagatatttaatataagattgttagacttagcatatatgattattacaattttaatataagattgttatcgatttaatataagtttgtaacacttagcatatatgattgttagagatttaatatattattgttagacttattatatatatgtgactattacaattttaatataagattagtagcgatttaatatgagattagtagagatttaatataagattagtagcgatttaatataagattgttatacttagcatatatatatgattattacaattttaatatgagattagtagcgatttaatataagattgttagacttagcatatatgattattacaattttaatataagattattagagatttaatataagattgttagagatttaatataagattcttagacgtagcatatatatatgattattacaattttaatataatattagtagcgatttaatatgagattagtagagatttaatataagattagcagcgatttaatataagattgttatacttagcatatatatatgattattacaattttaatatgaaattagtagcgatttaatataga

SEQ ID NO: 75997 - DNA, 3212 bp, Oryza sativa
acattttacattgattgattataaaagtaatggtccatacaaatctttgtgccggtataactattggccaacgatcaatagaacttgatagttacttttggtgttccttttagtatgtagaaaatgggctacatattttacaacttactgtatctttggtgagatgcacctgctatttttttctatatgttggctagattgtttcattgttattaatcgataccttgggtgcatgtaacactatatatatttcaaacaaaaaagccttctcgggtctaaattgatttcgcagtgtgggagacaattcatttgttccgtgcactgtggtatgattgttgtcatgatttaaatatttttgctctaaaatttatgattaaacattagaaatttacgtgatccaaacgatcactgtttgtgattttatgttagctaacgtccattgggcatttagtgacaatatttatattgcataatcttaaatgtgaagcctaccatgcttaccctattttatcttttttgtttgaaagaattagccatttatacaatcatggtagtttgaatactaaatagtttttatcttttaagtttctaaaataattggtagataaagctcttagctcggtcatctgtgatatacacctgtactcccaagctaatttggcccctatcacacatgtagtcacaagctaatttggcccccatgctgatggtgttcccattaatgtcgatgggggcaaaactgtgaccgatcaggagtcttaagcgtttctaggatgttcacgtggtggcttgagagttcttttaggaggtttaatggacttttagtatataatagataaatataattatattattttgacttaccatagttttagaatgcggggaataattttttttaacaccactcatagttaagtttattttacttttaccgttgttgatctaatttaattattgtgaatacattgataaaaatatatatgattattttttcatattttttatatttatctaaatgacatatataaaagtcagaaattataaccaaaatgtgacttttttgaaagttgaaatataatgaatatgatctttaaccatatatttagtcataaattatctaacgatataaacagataaaaaatatccatttagatttgtggtttctaaccaacattgcatacaaatagttataatagaggcccccactaaagataaatagagggacctcgaaaaaaatcccgtacttacgactccatgcgcactaaaatttttaattacatgaaaagatatgtacttattatgagtattgtgcatatctaatatgatgaaaagatatgttcgagagcgatgaattctagactaccaagagcgatgaattctaccaccatgcagaaagatgcggtgttttttttttctttttcatggagataattacaaataatccacaactttgcacgacaaaggcgcatgcacataattctggtgctcataacaatcatatgcgtatactgatagaatttgcaacaacattagagctaattaagtcgttttaccggacagggagtcagcaatgccattggcaacgcaatacgctatggacagtacggtgatcatggggttgatgcccactgcggtgggcagcacgctgtcattgcacacatacagttgctccacctcccagctctcgccatgggcgtcgacggtgccgttgcccaccgcggtgcccatccggcagcaacccatgtggtgcatcgagcagaagaggccccacgtctcttttagagattgatctaatggttaaaaatattgggtccaccggattaaatgaaattcaatagtttttgcctttttctaagagattttaagaatttctctaatttatcagagtgccacgtggtggcttaggagcatttataggttatacgtggcagcttagaagcgtttgtagaaagtttcatgacttttaatgtataatattatgtaccaaaacatggtcaatatggatcaaacaaaaaaaatcaaatatgttaaaaaatataaagccatctaatcattgattttttttaactcttgagctagaaacctaatagagcaagtgaggagatcggagactcatcatcagttaggtcatatgcgtgattcatcaacactactcttgtcatagatgatcttacttcttagatggattatccgtacagacatatctcaaacattcaacgttttgatccgttcgttagtatgagagctatcataaatgatttgtcaaggatggcttcgcttaagcgtgtcataaattgaatgtgtagattggcttaaaaaagtcattatttatttatgtcgccaagatcattcatatataaattaaagttccatgtaaaaatagatctaataatttttatagtaacaaattatggtgcatacccttaatacgataatagaagaagagagagaatactgagtgggaggagcagatgtggtggttcgtacgttttatacgtacctgtagctccaagagaaaagggtgatcggatcggtggatttaatgtaatggttagtattaccgggtctcctgttttacttaaaaataacagctagatatttttctttttttctcagaaattattagagcgtcacgtggcggtttagaagcttttgtaggaatcccacgtgccggtttgagagcgtttgtagaaagtttaatggacctttagtatataatatataataatatatttattttttggctagcccattcttcaaatttacattgcacgggctataatattgatactataggattcctcgacttatgagtgtttatagagtgccatgttaaatcatatctaccctggtgcaagtgaacttaggggtcatccgatggctaagatgagcccttaattagttgatgtcgtttcatatcagaaccgaaacaacatggaagtttgaacggcatttttcttaaaaaaaacagcaaaagtagtttgcagatcaaagtttgaaccaaatcttaattcataaattgcaccggagcagtatatgtttggggactcaagagtttggatggatccacatcgatggactcatggcactcacggctgtttttgtggcgcagatcttctggtgcagggcgatcactcagtgaaagaggtctacgtatatgtagtcgttgtttcgtcgcgcgtgcagaacgtaaggctaacgtagcacgttct

SEQ ID NO: 75998 - DNA, 541 bp, Oryza sativa
cgaatgcgcgggctaccttcctagtttatttaaattgtgattagttttagcatatatgaaatactatcaaggaactcagtttaaaattttatatccaccatggtttaaaatttgaagtatagtcatactcaatatatataggagtagagttttgtgaaacttgataattataataatatctgagaaaaggttaaaataactaggttttatgatactttgttttttaaaaaaaaaaaagaagtaggagctcaagtggccgttcccaaattgatttctcgcctccactcgtttgtgggggtgatccagtcgcgcgctcctccttccacgcgccaaaaccccagccaccaccaccatctcccgtcccgttcccaccaaaatctccccctccgatttcgcgcggctgcggtggtggtgcgtgtgctgctgccactgacgttgcggcgggagagcgcgatcgatgtctgtgcagtgcgcggtccggccgctcgcggcgctcccggcggcggcggacacgtcgcgctcgcgccgcgttggcggggcg

SEQ ID NO: 75999 - DNA, 819 bp, Oryza sativa
  unsure (1)..(819): unsure at all n locations
ttttgtatatgcatggtactgttcatctagattaaaatattgtggctagattaccattgtgattagcctaatgacctacttggcttagttatttatgccttgtttgatatctagcatgatagaatttatgagtttttcttgtcctatcatgtcgcaagtaggttatgcttgctgtatatgctttcaaataataatgcttggaataaaattaatggctaagtatgtattatttccaacattccagaaacctttagaaccattggtcatggctgctcatgctgttgatctgatgaggcctgagaagtttgctggtgaaaactttaagcgttggcaatccaaagttcgtcattatctggtgtcgcagaacttgtggtatgttattccacaagtgaggccgctgacccaacagcagcatgcggactttgagaccagtaatgatgtggctttaggtgtcatgctttcgctcctgtctgaccagctctacgacgtgtatggtgcttacaccagcgccgcagagctatgggaggcactggaccgtaaatattcggtttcagatgcaggacgttggatatatgtcgtggagcaatatcatgactttaagatgattgacaaccaatcagtggtgaagcangctcatgatcnttttaacgatatgggtgagatgtctcagnttggtgctattgtgatntctaagtttgtggtggngggcattattgccagcttncttcattttggagggattttgccactgcacttaagcacaaacgggaggacatgatggttgatgacctgattgcccacctggatgtggaggagaag

SEQ ID NO: 76000 - DNA, 700 bp, Oryza sativa
atttgaaatttatttacgaagtggttttggagatgattggaatttgcaagtgaataggaactgctgcttttgatgtggtccggtcagaccgggcatgtgctgccggtcagaccggcgtgtattacgcagtcagaccagcgcgggcgactctgtgtcggttttggtttcaggttgtttatttggaaatccatgattgtttcatgattatggcttctagatggatactatgcatatgtaatactgtagtttgctaccaatgaatcaagttggagatagcttggtctcggaatatggtttctttgtttgtttcacgtgtaggtgacttgatgcctcgggatagtattgccggtgatggatcgggagtcgactggatggtaaggcgatgtccgtgatggtcagatatcatgcggaatacttaggcttgagttcaatgtacgtagttggtaaagattccatatggcatacgatggaggtattgtgtgtgtaggatgcggagtcgaatttggaaggagtccaaatttggtatgattggttatgtaaagtttgtttcttgtacgaggaggtttcctatgtggattagaacttctagtatgagtttggttcgtggctttaggctgcctacctcatgtataaatagagagggagcgtgaggcttcccggtttcaattttgagagcaattgagttgatagtttagttagg

SEQ ID NO: 76001 - DNA, 17299 bp, Oryza sativa
atcaagatgtacatcatatcagccacaaaaacacactgaggtgcgtatatgacagtgtataatctgttttttagataatgtaatcctcttaatctgaatcacattttttatgtgattacatgcatgcattctctgcatctgaatcatgagaggtgtcctacctgctgcaagttcccctgtcctacctgctgccacatatgataattaaaccgtataggccaatctaacaaaatttaaaattatatgatgaagactaacgtggcgcatggaacatgcagcaaatccttgcagctatcctgatatagtgatatagctgattttttttttaaaaaaaagctactggaatactctactctatacgtacggtacgagttaggtacatgtatacactgacatcctgagttatccacattgtctctgcagaaagcttagctagaataagatcataggagtagtaggcactccaattggcagccattgcaaaaacatttggaaaaaaatacacaatatacgttgtttttaattagcttcaagagaaacatgagaaaaagagggcaaaatggccccctcttttattaaaaaaatgaatttttagaattttgaatcttgacattattttaattccacatttcaactctaaaacttactaagtttaatattgatgattcaaaggtttatgatgcaagatataatatccaaagtgtatgtttgtcacaaaaaggtcttttattatctctcacacttttttttgggtaaatctcattgagatctcactatccgggaccgatatttttccaaaaaacataagaaaaaactctggtcgtcagaagctggtttgttaaaaactgaaagaccaaattaatgaattcataaagttaggctcaaatttgacaattgtagaacttttatctggcacactgaccaaacttctctgaaattgatgtaaacatgtgtgtattctaaatttctgattaaacataagaaataaacagctggccagctgggtgacacaaactctctggatgcagtgttatataccttcacgccaccaccgggatgcaagaataccaccatttggcgtgaacaaacaagtcaatgcaaggacaatattaggaactaacttgggatttgttttggacatttgttgtgttaaggtttatttgcttcttgtttggggaacttttatttgttattcaattgctactttagtttggctgctggatctatgattgagttgttggaaaaaatcggttgattagacaacttttagtctttcattgagtaaattaagggatgcttagtggatcctgatgttgataggggcttaaatcatgaataatgaccatttaacccggggatagcctgatcctttccccttctcctcctgaatcaatttacttgtcattatagcaaatctcacattaaattgctaaatatgccaaattatattgctacatttattattactacctccgttcttatttatatgacgttacgtcatataagaaattatctaagggagtatcttaatgaaagtttcttgtgagaatactaatactaatatgtttgaattgatgaaaggtggaaaggacaagacatctctaaaaatacttcgaaatatgtgagaatggcaatattttgacaaaaaaatgaaatactataacgacaactgaattgaaacgaatggaataataagatttattcacttcttgtcttgcactaagtacagaacatctcacagctgctcctccattgtttcatatgggcacaaacactgtaagtttgttattgaggataaatattggttgatgaatttgggtaataagagttaataagatagaaaattaattgggttcagtagtagtaagactgtgagggcgtgtatggttcataactatattactcacttccattttaaattactcatcattttaattaactttatgctaagtcgaatattcctaactttaattatctatttttagaaatttatatagttaacatcataaaatctatgtttttgcaccatgagataatttcataatatataattcatgtatagttaaactatacaaatgtttagaaattaatttatagtcaaagttagaaatattcaacttaggacaaaactaacgacaaataattaaaaatgaatgaggatacttataactttggcaaacaagctttgccaaggtaaccactaacataagttggggtcatccttgactgagatatctaaaccccctactcattagtgagggtaagccataacccaaggatggcttcaaagccataaccccctccatatagctagtaagtgtaacacttggggaaaaaaagcaacattttttatgtagaaaattatagggtgtattttatttgaaaggggtctttaagagaccatgagttacgcataaaatatattcataaaatctgtagagccaatgttttatcaaagctatttgaaagatgaatccatcggtattttttttgtcaaaatttacaaagtttgacttctcaaaaaataatacgctgtataattcttctacagagagagggtatatatataacaatagcatttataagaaaaactattttttttcatggttgacctgtcacatgcaatttttattaaccatgaatatgctattgtgcttgatcacttattgctctccgctaaattcctccactaccttgcagtcgactgatcacttattgagctttacagtgtgacaacttgtatatatctactaattcgtatacattgagcctttcatgcatgtttcttataattgaactcatcaccatctgtttaatctgctatcccttggaactaaattttaataaataattttatattattgatgaggacatcactgtctcggatataaccatgcttatgttaaggtttacttaacaatataaaagtgcatataatctatataaggtttacttattatatgtttgaacaaacttactacaccatgagttttgtatcttctcatttacaaaaatacttgtgtgggtgaagcaaagaagatcagcctcacgaagtacttggatgatcaaagaagttgattggagatcaaaccaagattttccccaagtctactcctatatcaccatatcacttttggtctatagaagtcaaaagattaagttttacacgttttggatttagattcgggtctcctaaaagtatcaacttcaaatggacctagccattaatctgaaaagaatcttgagttccatgagtactagttggaaagtttatggagtttactttccaatggttttggtctcatatcaaaatttctcctcagctgtcgagaatccgcaaaacaagccacatacctcatccagttcgagtctgatttggacattcaaccctataattgtgtcgtggctaagcctaaggagtgaataccctagggctaatcctacgatgtccctaattatatttattcagtagcctgtcatcgtttagagtcgggttttccttagattatttatacaattgcagtttcactgttagtttggttcgtggaacccgaactttgagatcttaatcattcatctacatattgagttgcaatctgacttgtttctgctagtgttctttgattcgcatgctgaaattaaccttctcggcaaggccaactaggcagtgcacagttgatagagaagacatgatgctacgattgcaggatttggatcgtgttgatcggaagccggattgtgtgtatcaagttttcccaaatcgagagttatcaatacctatcaaaagatcgagacctagttactcatcagttaatctccctcattgatactaattatatgattatcacttatgcatgcaaacattactctaacatgcactaattaaccctaaagcatgctaattatcactcatcaaagctaatttgtcacttgatacccttatcaatccttcttcttgtaccttcactaggcatatttctcagtacaaaatctaaggggaatatttctcaagttctccaaacagtggccacgcaccatctatgtttcatcctaccacccaaacgtatggatgagacctgctctgtccccagctggtgccatgaaccaaatcataacttagataggctgggttggcatataaactatgcattttaactgtagtatatatatatatatatatatatatatatatatatatatatatatatatatatatatatatatatatatatatatatatatatatatatattagtccttttcaagtgagaaagaaataataagtggttttaacaataggactttcagcttaaccattttatccaaagcaagaacaaaattaagtgcaattaattgctaatatatgcccgcatggactccaaatggaagggctatatataggctaatgctgattgtgaagttaaagtgttatggttgatattagaacataatctttcattgcacggccatgtgtgtttttgggatcatagtgcgtatataacatatatagtcatgtatcacaggatttcctactctatcaatatatacgaggcactttttttaaaaaaaaaatatcgcgggatggttctaaacattgtagggcatctatagcatgttgttgtgagcattattattgccatttaagggggggatgaatgtaataattcaatctcttagtagttagatgcatggtcattgtgatatgttatcagtgggattgatctcatatgaagaatttagataggttgaggctaacatataaacccacatattccaacaatttcaccttaagggttaacaattttgccaaattatctatgcaattctaaacaattgggcattcaacagttttccaagttgccgaatatatataccttttgaaatgtcgttgcataatatttcgaaagcgttttcaaatatttttgcatgatatctcctcaaggcactacaagtcataaagcaaaaatttccaaaacccaaaaagaggctggtacaaagtggaaaaaaaagtagtaactcgtgcgaaagcgaaacctattccgatgcagatgcgtgtacctgcatttacacattacttaaggtagctaagtacacaaacatagtcaggtttagactgaaaaattattgtgacttgacaggccacattaagtatataccaacttgtactaattattaatcgttgaaagcaacttggcttaaaaattacaagattagatacaaagaggactaatgatcaatatgctcaggttatcatcgtgcaccaaaggctaaaacttgtgtgttacagctcaattgttagttaaggtactaaccgtttttgtgagcaactgcacagttagttcaagtccacttctatagtatcatcattctcatatcaacaataattaattaactaagagtttgtcctaattaatattgccttattagctgaaaattacttaaattactgatatttattactgcataatcattttattgcagtgctagattaattgttcacggttataaactaggccatccccgatccccaattttatatgatttgtatgataaccatttgttgtaatttggctcatatttttctgagttacccacaagatttgataagaaccagtagagaagaaatgactccaaattaaaaaatatatgtagtcaaagatagggaagaacattgcttttaattaagaacgttataattagtcaacaatcatgcatgttgcccagataatatgtgggctcacattcagtaaaaaaaaatgtgggctcacacaaatcttcatactttcatgttacaagagtttgattcccacttacctcgtgtgaaaaaatagtttgacagtgcagggcacctactaggctgtgaaggcttttcgtctcggtataccatatctctcatggttcttactcccaccatattttaatatatgacactgttgactttttaaccaatatttaaccatttatcttattaaaaaattatataattatcatttattttactgtgactttgatttatcgtcaaaagttctttaagcatgacataaatatttttatatttgcacaaaaaatttaaataagacgaatgatcaaatgttagtcaaaagtcaataacatcatacattaaaattaaaatacagatgtagtaactaatatagatatgttagaaattgttttagtatatagtttttgaaatgtctgaaaggactcccttcttctctaacctattttatcactaactttatttagatgattccccgaactgttagagaaaacaactatgaatcattacagatgtctcatattgtgttgtagtgattctgtctagctttagtgatcaaagatggccctccattagcatttcaatggccctttgaaaaaaaaatcaagccttgaaaaatggatctcctcaacataaatatatttttgttttgttttaggaaataacatcaacatattttcctatagtcactccaagtttgcaacaaaagacttggtataaaaaaattccaaagacggcaattttcaaataacatctaaaataataggaatttcgtatagtctagatgcacttttttacaagcactataaatatcaccataaatgcttttactttatgtatagatgtttaagagatggttttgacgccttttagagatatacagggcctgtttagatcatttggaatggtaaatagcaaatagcaaatggcaaaagttttggtggcaaaagttttggcattgcaaaagtactagttggtgtttagatgcatgttaaaattttgccattctagcactaaagtgagagagagagaaagggagtggtcccaaagcactttttggcacaatttgctactatagactagcaaatgccaagtgccaaattaccaacttttgctactagtgtttagatccaaaatggcaaaaagtgctacaaaatggtaaaacttttgccattttggaggatctaaataggacctaaatcctagcctttgcttcgatgaaattagccacttattacacaattcactcaaaacagagcacatacaatccaggaactaaggatgtaattaaagactaaaggagacatattatttattcaactctggttgtaaatcttcacccaaagtaactatagtagctagtatgttatgtcatggcaaaactacaataattaatcaatgacttgttggatatgttttgaactttggaacactgtagttagcaatccggatcccatgcagctagctgctactgatttcttgacatgcatatgcagaattagcagcacggaaagaataggacggaaggttcaagattcgctaatatattgttaattgtaccaaaaatactatatatatagcaaacactgtagaagaaatctgatagcgttgaggatgtgaagtttggacgaaccagggaagataatcaattagcacataattaattaaatagtatctacttacacactggaaaataatttattcgaaatttttcaagaaacatctatataaatgaaagttttttaaaaataaaaaaacaataataatctaggtagctacgatacgaaatagtgacgatgaatctgtataattatttagaccgttggataaaattaaatttctagatctatctatcggatctcagttcgatctttaagggtcccttggatttttggataattcaattcctttataattttgtttcctatagactctttgatgaggatatgaatttttacatacaattgtattcatatgattaattccataaaaaaaataagtaagatgttagatctcttgaaaacgggaaatttaactatttgccactcttgtgacatgacaattaacgatttgccacaccctgtcaatgacatgtgggccctcatgtgtctatgacatgtgggcctagtggcaaatcattaagcaacatccgtaagagtggcaaatagttaaaagcccccttgaaaaccttcctttaggcccttttgattcaaaagaaattcatataaattttagaggattttatttctataggaatttttcctatataaccctttgaatcaaaggaatgaggaatcctataaaattcttatggaatgtctctttccatgtaagtttttgaggaaatttaacacgaggtaaaaactaatggaaaaaatcctttaagtttttatctcttctcaaattccatgttttacctgtgatctgcaataatctaaacatttgcattcttgccagaatcttatgggttttcctattccttcgttttcccattactataattatttaagaacatcatatctattcctgttttctatgttttaaatgttttaaaatcctgtaggattgaagatacatgctacttcaattcctcatatgttttaaataggtccttagagccacttaggctggcgagtaaaaatgtgccctatgcaattttaacattttggtagcagtgtagacggttaggtaccaacatcgatcacgatcacagcacaacagagagaaaaaatatatatatatatatattgtgtgagctgtgcaaatctccatgagctcatcatccatatccaccaagagcatcaataatttttatctcccaaaagcagtacagatggatgtagaccggtatagtcagccagcaaaggtcctcttgtgcacaagccatgaggctagattctgtttacccaattgtttttctgccctagcaaggtgagacagagagaaggaaaatattttaaaagagaatcttgtccataaaagaaacttttgtgcaaaatccctgtgaaattttaggcaccatctaggctcgtgtgtatggctcagagttgttccgtaggttcaattagttatctacagtactaaacaacatccaaagagatcattaattagatagccttatcgatcaccggctgatattctcagggagcccaacaattagctgatttaggttagacgctaagcatgcttagaagagcttcttactttggattatatgtagagctggatcggtttccattatccaaaaagagctagatctacgattttttttttttttaccgtccggtagtcacccatgcggctatggccggcgcataatcatttaaaaaaacactccactaagcgctatagcgtataaactgttttagaatcgcgacccctcgtagaatgagaagtttacttaaaacagtttagcttttcttttacattctaagaagttgtacactactataaaattgatctttgctgggtcggccaaaaactataatagtccggttttaataagaaccaggaaaaaaaagcctgttaaaagctatgtgatctttagtcccgattggtgttatctttagttccggttcatcccctgtcagtggcctgtcacggggccaccaaccgggactaaagatcactactttagtgagtaaagattatttagatcttttatacaatatataatccttaagacttatcctcccaaactactcgtcttcatattctcccttatcctcctcatattcctattcctcctctctcttattcttatcctctccttctcctcatccctagagcagatcgaggagcggatgtgcggagggcctgtgggcggccggccaggggcggcggccggccgcgcggaggcggcatgcgtggcggtgaccggtgcggcaggcagcggcatgcgcctctgccggaggggaggcggccggcgcgaaggatgtatttgattttttttttgagaattttttattggatatgagatgtctttgatttgtgtgtgatgtgaatatgtgatgtatttgtgatgattattttagaacttgtgatgtaacttttttagaatttgtgatgtatttggaaatgattgatttgagtatttggagatatccttttgttatgtgatgattgatttagggatgatttgtggatggaatgaaatcattattcaatgttaaaaaaaaatataaaagcaacctgatgcctggctccatctttagtccaacctgacaccaaccaggactaaagatccatttttactcctggttgttttaaccgggcatctttagtcccggattgggtatcccggtttgtaacccgggagtgaagggcctttccccactagtggtaattgtagaattcaaaaaatgaactaaaaactaaaaatctcagttttacaggttctcataaactaactaccaacaagtcgcctctcaaaattttaagatactccaaacagatctaagttatgtttggagagtttaaagtcatgtttggagagtttaagatttaaaggaatagttgattaatagccggtttccctaacttcttgctcttattttatttcctaaaattctatagctatatatttttaaaatttagataagaatttagactgttgactaaaattctaagaaaagctgcgaccactataagcttttccaaacaacaccctaattgcttttggaatctgcagcttgcaatggtagctgagtggagagagagtgagagggctgtcttccaataggaagcacacacaacacaaggccatatgtggagtatatgtatctgcttcctttcatcaccatccttttgtagccttgccttcctgcacggggaaaagcagaggcactgccggctcctctgcaaagatttgctccttccattggtggaattttaggccaaaagttgcaagattgtatatacacagagtgcagcaagaaaactcgcaaataaagcgacgacgacgaggacgagcattggtacttggtgtcacttccctccggttggtaggcgcgcccggccacttgctaaattatgcgaaatgggccttcaccttgtttgaaaatgcaaagcagggataagagcaagtttgatagtacggctaattactggttccaaatcatttatagtcaacttaatggccaattcatataatagttacctataaacatatagtacacaatcaatatccggtctcatctgtcatacacacatgcattttgaagtctgtgctgcagttagctaaaaatctgcagcctgctgctcttatctcttcttttttatctttttaaaatatgtttatagttagtttatagtttgctatggtacctaatgaggaaaaaaaggtttagggagatcactgtagttcactagagtttaatactgccaactagagctttacagacagatctatgtataattggacacgaattggatcagctaattgctgcgtggtgtcattgatttgacttaaataatccctttttccttccactctgctgttagttgattggaggagtactgtactggtgttgattagtcaattggtctaagaaatttgtgcccttaaataggtccatgagaaaattcacccaaaataaaaggctccattgggaagaggccaaatggagagagaggagagctggagagagaaagaaaaaaaaagagacttcggactcgtttagttctcaaaaacttttctaaaaaacatcatatcaaatctttgatatatacatgaatcattaaatataaataaaaagaaaaactaattgcacagtttgtatgtaaatcacgagacgaatcttttaagtctaattagtccatgataaaccataagtgctacagtaacccacatgtactaatgacggattaattcgtctcgcggttttcaggctagttatggaattagtttttttattcgtatccgaaaactccttccgacatccgatcaaacatccgatgtgacatccaaaaatttttatttcaccaactaaacaaggccagtcattcatcactcatcagtgcttatagttttatgattttatcaccaattgtttgtttaaagcctgaaaaattttacaggtggcaaatgtacttcctgttctaaaatagtggtgcagtagagattagctcaaactcaatcttaggtggacaattcagaggtgtgattgtttcagaaaagttaacacacaagtggttggacccagcaagtgccctccatcccatcggttccacaatacttgtccaggaacaaaaagacaccagatttaagaaaaaacttaacatcaaattgctaagcatgttccccaccaaaacaaataaaaaagaaaatggccatacaagttgcacgcaagtctctggtagataacatgctgatatatagtccgtgatcaaataagagcaatcccaataggtagtgtgaaacatggcgtactggtatattaactacttcaaaagtacatccgatccgttctcctataagagcaggtataatagcaggctataaaccagctataaccatattttaaagagataaagaaagagagagaagagtagcagtacggactccaaaacgtaatgtgtgtatgacaggtgggaccagatattaatagtatagtaagcaactattgtatgaattagctattacattggctatagatggtttggagttagcagtaggctatactattaaacttgctctaaggctgccgttcgttccacccagctcccaaccctctccctcgttttccgcgcacgttttcaaactgctaaacagtgcatttttttacaaaaaatttatatacgaaagttgcttaaaaaatcatattgatctatttttgaataaaatagcaaatatttaattaatcacgtgctaatggaccactctgttttccgtgcttaggatatttgctccaaacctcccacaacgaacacagctcgaaccaacccccctcccccatctttttttaaaaaaacgctccaaaaaatcaacccatattgaaaaccgatatataaaaaaccaaatcatatttctctccggatccgttgcaacgcccctgacatataactagctagtatagggtagagagagtatgcgtgaaacgattgttcagatttaatctaacacctgcaattaatgtataaattttgtaggtgtggtttctgtaggagttcctccagggtgcatcatactagtgataggggtgctagtatatatagatgaaatttaaccattcattcatatgaatatttttttaaacaacaaatgtgaaaatttaaagaattaccccaccataccattgagggtcacatttgagatgagttgcattcatttgatgataccaattagaagtcccatcgatatagagggaggggtacaataaatagtgacatactccctccgtttcgaaatgtttgacgccgttgactttttatcacatgtttgaccgttcgtcttattcaaaaaatttaagtaattattaatttttttcctaccatttgattcattgttaaatatatttctatgtaggcatataattttatatatctcacaaaattttttgaataaaacgaacggtcaaacatatgttaaaaaatcaacggtgtcaaacatttcgaaacggagggagtagagtgcatgatggaaaaaaccagtggcatgcataatatctttgtctatgcgtgtctgatttctctaaattttccctcctacttataatttttttttcttatgcatcagactaatccattttatgaaaaccaacctatgtggatttttgatggtgccatagcaatatcccctctggtataaaatataagtctattattgtaactttatcgacacttctcattttaatacaacttaatccaagacctttttctggacattttacattgctatataattctactactatcataaataaattaattactcatcttatctgatctgagtataaatgaatgacaaggaagataaatttgttgttttatttaattactcctcacatacaagtatctacttcctcaatctcaaaatataagagattttagttggatgggacacatcctaatactacgaatctaggcagtattaggttgtgccccatccaatcaaaattttttactatattttaggatggatggtgtagtagaatttgtacaggaggatttactgatttcacttcattcaagagctctttaagccagggttggccacttgggagttgggactgaaaaattgcattggtttcttttttcaatcgataaaaagtactgtactttatgtgcaactacaaaagtagttaaaactatgaaacagagggaatattgctagtggaataaaacatcgtctttgccaaaatttctatcgcagtactgacaacgtgacatggtaacctgtggtggctttaattttgttcgagattaatggtagattccgccgtacatgatattatatatgacacctcaagcttaattggccaagagtgttaaattttccccaattaggtaccatgtctagtagcttcccaaggtaaatggcgtttacgatgatttggacattgtggtctaaatacttcagtcgatgatcaattcaaaagtactagccatactagagttttagattaccctttattaaaatagtatatccaaattggagaatcgaaatgaagcccttttttctcagtctatatggacccttttgtataataggaattaattccaatataataggtattctttgtttgttaaaacaaactttgactgtaaaattttctaacaatatttcgcttatagtaacagattcgtggtaataagaaaatattttcgaactttattctaaccatatcatttttagacaaaacctaaaaattattggatgaacagttaagtcaaaactcaaaattggatagttaacatgtgccttatatttctgaagagataatcgaagaaatgtcattaataagcgtccaaatattcaagaaatgctattgataagtgtgagttctaaaaaaaataccatcatacaaacgattttgtcccaaaaatgccatcaccgtcagggttccgtccattccacgctattaaatacattgttcatcctataacactttaatggcgcgggatggacggaaccctaacgaagatgtcatttttggacaaagtcgtttgaactatggcacttcttggaactcacacttgtcgatgatgtttcttagatttgggcgcttgtcaattgattgtattatctcgtttttgaaaggagtgcgtaattcacaagtaggtcaatattttaaatacgagtcttcggaaatacaggtcaatatataattttgatgcacttgtctgacttttttttttgttgcggggatcacttgtctgacttaatgtttgcttttacatatgacctcgttgattaggaaattttaacatcctcgtgtaaaataacagagtatctattcctatgtcaaatttcaaccagttccttgattcctatgaaaaacgagaccttgtatttggaaattggaataggaggaagtaaaaaattggtgtaagaatccttgtgcctcatttttaagttgtatcctctgtcttgcatattcctgtcaagaaaagaaatgtacgttttttttaaccttgtttgcaaattgtaatcatgcatcatcgtccacaagtatttcaaaaatagtggtcctgagcttatttttatggatatatgtacgggaactgatccaaatagatgggaggataatttaatttaattaaccgtatgtccgtctgaaaggacgacaatgcctaatctatccaatgaaacaaaaaaaaaatcttaaataacattttgttgccttttcaaatcttcactccagtaaaagtctggtgcagtacactagagaggaccacattatcacactttctccctaacatcataatttgatatctggatccaacaatcatgaatgcacatgaagaaaagaaaactttgtagtgttgaacctattagatttatttttatgctaccaattaaattattttcccacgtctaccaagattaaaccagtaccttcagccttcaggcattgttcctttaatccttcagggcattaattgggatttagatgagattaattctatatctattgtgatgtggaatcaatccatacaatttttttatgagggttaaacagatttcctcttcgttccaatttaatttgttttcatgttgtggacataatggttaacaatttcgtggactttgtcacaaaaaattcgaagctcttccaaaccgcacggttaatgttgattttcaaacaaaattcataacattatcaaactttggtcttgtttggtagaactttagatctatttttgttagctaagtatttctagctctagaaatccacggtctgaaacgtaataacattgataacatttatataatcattttatttcttatttaagatgaataatagaatattaaatcattttgattcaaattacacagtacaaatctagtgtgtatctagtctggagccatgctaaagggtgtattcttttctccctttttataacttctactccctctttttacgtgtatgtttaacagcacgtgtatgttttccgaaccgttaaacgttgggttttttcagaaaagtttctatagtcaagatatttcaaaaaaaaaaaatcaatccatttaaagttgtaactaatttacttattaattgtgcattaatgagctacatcattttacatgcgcggacccaactcctcccgaactcattaagattctgataagcacaacttctggtttctaatttattttatgaaatctaaaaatatagcttctcagaatctagataaaaaaccggattgtttagggagcttctggtttagaagctaaaaaaaaatgccctttatctcactttcggcttgcacttttacctcccaaaaaaaaaaagatactacatccaccgctatcaaaatccaaaattactggaggactagtctgcaaaaccccaaagccgaccagattaacaaatgtttccccttcaaaggtaagggagggttaattaagaaacgaacagtgataggtcaaatcagagattagccctccaaatcactccctcacactcattaatcccttcttcttcctcctccaactccaactcactctcctcgatcgaaatccatccttttcgcccatatatactcccccaccacctctcccgagctcggacacgcagagcccgatcgattgccacacgcgcgcgcgcacgcagctgcatccactgttgcacgaccctgctcgccactgtgtgctgccgctgttcctcgtctccttcttcttctcctccaatcgtatgtgctattgcctcctctttgagcttcttttggttactttggttgcttggttggagctggctttgcttgctagtgctagcttgcgttggaggaggatgagagtgtttgttgctgttgttgttgatgtatttcagttagcttcgtggcttcgattttcttgat

SEQ ID NO: 76002 - DNA, 1022 bp, Oryza sativa
agagagagagggaaaagtggggggaaagggagagggaatcacggggagtgatttccccctctttattgcgcgcggggacgccgggatgcggcggaatccgcggcgtcggcggcgctagggcacggactaggcggcgggttcggcgcgaggacagggatgacaggtgggcccacccgtcagcggcacgcgcgcggggaggtggccgaatgggccgcgggggagaggagagggagggggagggagctgggccgagccggcccaagaggggaagggggggaaaaagactttttagggtttttctttttatgaactcattttaactttgtttatttcttaataattattatttgtgctctgaaaattccactaaaatttgagggctctttttagaccaaggagaatttaacaaaaattctccgggccacatttgaatttttcttgtacgtattttagtgtttgctaatttcttttcgaattttaattaattctattattccttttagagaatgatttttatttcgggatgaatttatcaggacgtgacagaaatatccgagatcctagtcggttacgattgtattttatctgtaactacatattctgttagggatatggactttattttgtaatacggaccccttctcctatataaggaggggtctgggtgcctctaggggcacgatttcctcccagatcatacgatcaataatacactcggcggatcaatccccggacaggagtagggtattacttcttgatttagaaggcctgaacctgtataaaattccttgtctctaaacccatccgcttttccagcttgatagccacccccttttagtattgccgaaatcttgtttcgacagaatcctatgaaattcctatggaatgcctaatacaatgtaagtttgggaggaattctaacatgaggtagaacctcatggaaactttcctgtgagtctttatctcatctaattcatgtgtttttcctgtggtccaatcaaacgatcattactgtgtttttc

SEQ ID NO: 76003 - DNA, 7729 bp, Oryza sativa
cgcccggccagagggcggcaaggggccgcctgcaaaatggccgacccagactggcttttttgcattcgggccccttgctgccccaacagagggcggcaagggctttactgcaaaaaaccctccctccgtcaccgcccatccctcccccgtttgccacgtcagcttgccaccctagaggtgggcggcagggtctatttttgcaatttttttagccgatagattatttctgtaaatattttttaaaaaaaatctaaaaatgaaaaaaattccttgagtgaaagcaatgcaaaacacattaagcccgttaccagcccattggttaatatccttgcaaagtgaccacgggaaggcctcggtagtggcagctgtcctggtttagatttattggttgtgagtatgttaagttgtggttttagttttgttgattaactatgtatggtttgtctcattcctctttaaaatgaggtatataaaatacaatgttaacggcttggtctgtatgggtaaaaaaggtattaccaattaccatatagctacactaaacaagctaaaaaggatagattacagtactgcaatttatttttgaaaacaaatacaaaagtgcaattttggaaaagaaaattgaggtaacatttttttaaaaagtataaggtatcatactttgcatttaaacaaccatccccttgagatatactctgttctttcataggtatattaaaggatggaggtagccttttgaatttattggtttcatatacagggagaaagagtatgtttctagacgagagggggtgattgtgatatttttttttatatgctctcatgagctcaaattaacttgacagattttctattcagtctcccctcatcaatccccaaacatgaaacaaatataggtgagaactgacactgcgtgccactgatggtaatgaataattaacatactgcagagtggtaatatatataagtattttcatacggttacctgcaatgcaacacagattcccctagatcaccaattgctgtggcgacctgacagacatatacatgtttagttcagcacgacaacaattggtaattaagttatattatcattgttccattagccttgaccacattttaatcatgcctaatttaagagggatcatggacatccatcaagcaaacgaacggatctttcttgaatgcttgatacctacgacaggcatggtcctaaacctacataaaaatattgtttcaattctctagtgattactcacataggaccagctaagcaataatctcctactaattttttcatgcatggtcccttgcctgtctaattgtctatctatctactatcaattaatccccctcaaatgctgacaagcatatctgcatatgcacagggatacacatcgaatcattgagtgaaaacagggagttcaactctcttgaggacttcaaatgggacaatcaatcgacttctacctatgcaaacaacttggttagcttacatgatgatcgatcatcttggtcaaagctaaaggtgcctaaagaaaattaagaatttagttgatcatacaactagctaggagagaattacttcgattaggtctaattttagtccctacgagagcccagttaatatatatggcatcatttcaatctaaataaaattctccggaacacgttaaggcgtgtgtgttttctaaagataatgaaattgaatctgagctctgtatcaagatgtacatcatatcagccacaaaaacacactgaggtgcgtatatgacagtgtataatctgttttttagataatgtaatcctcttaatctgaatcacattttttatgtgattacatgcatgcattctctgcatctgaatcatgagaggtgtcctacctgctgcaagttcccctgtcctacctgctgccacatatgataattaaaccgtataggccaatctaacaaaatttaaaattatatgatgaagactaacgtggcgcatggaacatgcagcaaatccttgcagctatcctgatatagtgatatagctgattttttttttaaaaaaaagctactggaatactctactctatacgtacggtacgagttaggtacatgtatacactgacatcctgagttatccacattgtctctgcagaaagcttagctagaataagatcataggagtagtaggcactccaattggcagccattgcaaaaacatttggaaaaaaatacacaatatacgttgtttttaattagcttcaagagaaacatgagaaaaagagggcaaaatggccccctcttttattaaaaaaatgaatttttagaattttgaatcttgacattattttaattccacatttcaactctaaaacttactaagtttaatattgatgattcaaaggtttatgatgcaagatataatatccaaagtgtatgtttgtcacaaaaaggtcttttattatctctcacacttttttttgggtaaatctcattgagatctcactatccgggaccgatatttttccaaaaaacataagaaaaaactctggtcgtcagaagctggtttgttaaaaactgaaagaccaaattaatgaattcataaagttaggctcaaatttgacaattgtagaacttttatctggcacactgaccaaacttctctgaaattgatgtaaacatgtgtgtattctaaatttctgattaaacataagaaataaacagctggccagctgggtgacacaaactctctggatgcagtgttatataccttcacgccaccaccgggatgcaagaataccaccatttggcgtgaacaaacaagtcaatgcaaggacaatattaggaactaacttgggatttgttttggacatttgttgtgttaaggtttatttgcttcttgtttggggaacttttatttgttattcaattgctactttagtttggctgctggatctatgattgagttgttggaaaaaatcggttgattagacaacttttagtctttcattgagtaaattaagggatgcttagtggatcctgatgttgataggggcttaaatcatgaataatgaccatttaacccggggatagcctgatcctttccccttctcctcctgaatcaatttacttgtcattatagcaaatctcacattaaattgctaaatatgccaaattatattgctacatttattaattactacctccgttcttatttatatgacgttacgtcatataagaaattatctaagggagtatcttaatgaaagtttcttgtgagaatactaatactaatatgtttgaattgatgaaaggtggaaaggacaagacatctctaaaaatacttcgaaatatgtgagaatggcaatattttgacaaaaaaatgaaatactataacgacaactgaattgaaacgaatggaataataagatttattcacttcttgtcttgcactaagtacagaacatctcacagctgctcctccattgtttcatatgggcacaaacactgtaagtttgttattgaggataaatattggttgatgaatttgggtaataagagttaataagatagaaaattaattgggttcagtagtagtaagactgtgagggcgtgtatggttcataactatattactcacttccattttaaattactcatcattttaattaactttatgctaagtcgaatattcctaactttaattatctatttttagaaatttatatagttaacatcataaaatctatgtttttgcaccatgagataatttcataatatataattcatgtatagttaaactatacaaatgtttagaaattaatttatagtcaaagttagaaatattcaacttaggacaaaactaacgacaaataattaaaaatgaatgaggatacttataactttggcaaacaagctttgccaaggtaaccactaacataagttggggtcatccttgactgagatatctaaaccccctactcattagtgagggtaagccataacccaaggatggcttcaaagccataaccccctccatatagctagtaagtgtaacacttggggaaaaaaagcaacattttttatgtagaaaattatagggtgtattttatttgaaaggggtctttaagagaccatgagttacgcataaaatatattcataaaatctgtagagccaatgttttatcaaagctatttgaaagatgaatccatcggtattttttttgtcaaaatttacaaagtttgacttctcaaaaaataatacgctgtataattcttctacagagagagggtatatatataacaatagcatttataagaaaaactattttttttcatggttgacctgtcacatgcaatttttattaaccatgaatatgctattgtgcttgatcacttattgctctccgctaaattcctccactaccttgcagtcgactgatcacttattgagctttacagtgtgacaacttgtatatatctactaattcgtatacattgagcctttcatgcatgtttcttataattgaactcatcaccatctgtttaatctgctatcccttggaactaaattttaataaataattttatattattgatgaggacatcactgtctcggatataaccatgcttatgttaaggtttacttaacaatataaaagtgcatataatctatataaggtttacttattatatgtttgaacaaacttactacaccatgagttttgtatcttctcatttacaaaaatacttgtgtgggtgaagcaaagaagatcagcctcacgaagtacttggatgatcaaagaagttgattggagatcaaaccaagattttccccaagtctactcctatatcaccatatcacttttggtctatagaagtcaaaagattaagttttacacgttttggatttagattcgggtctcctaaaagtatcaacttcaaatggacctagccattaatctgaaaagaatcttgagttccatgagtactagttggaaagtttatggagtttactttccaatggttttggtctcatatcaaaatttctcctcagctgtcgagaatccgcaaaacaagccacatacctcatccagttcgagtctgatttggacattcaaccctataattgtgtcgtggctaagcctaaggagtgaataccctagggctaatcctacgatgtccctaattatatttattcagtagcctgtcatcgtttagagtcgggttttccttagattatttatacaattgcagtttcactgttagtttggttcgtggaacccgaactttgagatcttaatcattcatctacatattgagttgcaatctgacttgtttctgctagtgttctttgattcgcatgctgaaattaaccttctcggcaaggccaactaggcagtgcacagttgatagagaagacatgatgctacgattgcaggatttggatcgtgttgatcggaagccggattgtgtgtatcaagttttcccaaatcgagagttatcaatacctatcaaaagatcgagacctagttactcatcagttaatctccctcattgatactaattatatgattatcacttatgcatgcaaacattactctaacatgcactaattaaccctaaagcatgctaattatcactcatcaaagctaatttgtcacttgatacccttatcaatccttcttcttgtaccttcactaggcatatttctcagtacaaaatctaaggggaatatttctcaagttctccaaacagtggccacgcaccatctatgtttcatcctaccacccaaacgtatggatgagacctgctctgtccccagctggtgccatgaaccaaatcataacttagataggctgggttggcatataaactatgcattttaactgtagtatatatatatatatatatatatatatatatatatatatatatatatatatatatatatatatatatatattagtccttttcaagtgagaaagaaataataagtggttttaacaataggactttcagcttaaccattttatccaaagcaagaacaaaattaagtgcaattaattgctaatatatgcccgcatggactccaaatggaagggctatatataggctaatgctgattgtgaagttaaagtgttatggttgatattagaacataatctttcattgcacggccatgtgtgtttttgggatcatagtgcgtatataacatatatagtcatgtatcacaggatttcctactctatcaatatatacgaggcactttttttaaaaaaaaaatatcgcgggatggttctaaacattgtagggcatctatagcatgttgttgtgagcattattattgccatttaagggggggatgaatgtaataattcaatctcttagtagttagatgcatggtcattgtgatatgttatcagtgggattgatctcatatgaagaatttagataggttgaggctaacatataaacccacatattccaacaatttcaccttaagggttaacaattttgccaaattatctatgcaattctaaacaattgggcattcaacagttttccaagttgccgaatatatataccttttgaaatgtcgttgcataatatttcgaaagcgttttcaaatatttttgcatgatatctcctcaaggcactacaagtcataaagcaaaaatttccaaaacccaaaaagaggctggtacaaagtggaaaaaaaagtagtaactcgtgcgaaagcgaaacctattccgatgcagatgcgtgtacctgcatttacacattacttaaggtagctaagtacacaaacatagtcaggtttagactgaaaaattattgtgacttgacaggccacattaagtatataccaacttgtactaattattaatcgttgaaagcaacttggcttaaaaattacaagattagatacaaagaggactaatgatcaatatgctcaggttatcatcgtgcaccaaaggctaaaacttgtgtgttacagctcaattgttagttaaggtactaaccgtttttgtgagcaactgcacagttagttcaagtccacttctatagtatcatcattctcatatcaacaataattaattaactaagagtttgtcctaattaatattgccttattagctgaaaattacctaaattactgatatttattactgcataatcattttattgcagtgctagattaattgttcacggttataaactaggccatccccgatccccaattttatatgatttgtatgataaccatttgttgtaatttggctcatatttttctgagttacccacaagatttgataagaaccagtagagaagaaatgactccaaattaaaaaatatatgtagtcaaagatagggaagaacattgcttttaattaagaacgttataattagtcaacaatcatgcatgttgcccagataatatgtgggctcacattcagtaaaaaaaaatgtgggctcacacaaatcttcatactttcatgttacaagagtttgattcccacttacctcgtgtgaaaaaatagtttgacagtgcagggcacctactaggctgtgaaggcttttcgtctcggtataccatatctctcatggttcttactcccaccatattttaatatatgacactgttgactttttaaccaatatttaaccatttatcttattaaaaaattatataattatcatttattttactgtgactttgatttatcgtcaaaagt

SEQ ID NO: 76004 - DNA, 2127 bp, Oryza sativa
tttggcggcataggttctaagataggttccaaacttcactctatctgaacacttaagattcgactatcatcttattattcctcgatccacttgacttgcagaagttgacaacatcgacgtcttcgagtttctccatcaagattaacgactactcaagttgaaagaggaagggggaagaacgacaaaacgatttgcaaagaattctagataaggaagaaaggaaaattttcacaaattatgttttcggaaaattagtccttaaggtttgaccatttggcttatcctacagtcaagatggctctgataccaacttgtcacgcccggaaattcactagtaatttccgaactgatttgtgcataaaatcctcgtccaggaatcagccgaggtacacaaactgacaatttaatatacaaatccatcataataactaaactgataaatacttacttaagaggcacttagtcctcaccaagaagaaaaactgcagcggaaaataaaatctagcgaagcttcagctccactcccacaggcagctcaactggggtataagccaaacgtcttctccttctggatcctttttcttcaactgaggttgattgattattgcaaaaatgagcatatgacatactcaacaagccacacagcaaatatgcaagtgcacaaggattccaaaggatggcataatataggctcatttgcaaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacacaatccaccacagcgcaccgttcctggatcataatcacccccttataaacaaggcatggactccccagtgacccccatgggcttatctcgccacttctcagtctggtgctccataatgaaccatgctatacaacaggtaaagccgttgcccacgctggcttgtggttggtacggttaatgtttcacaacagtagctcgtgaaccggtccttaattgtcatgagcacgactctcaaaaccatgtgctcacaacccaccattatcaagttttagttggcaagtaattaattagccaatcacgattaaccatcgtgagctatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaagtaatcttcttgatcacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaaactggaaaaggagaagatgatgacgtcatgatgacatcatcaatggccggaccaagatggcgacctcgcccgagatagagcgacccgctgcggatttggaggacatgaacacgtagaggacgacgagacgaacccaacgatactcaccctcgtgccaaacgac

SEQ ID NO: 76005 - DNA, 25216 bp, Oryza sativa
cccttacatccacaagacccatggatacccctggagcacccccttcaattttttcaccatgaatgataaactaaaggtccctaaatagctgaggttgaagaaactgtgtaataaagcccccaatttttttttccttgatccgcccctgcatatgagaacacaattaatgtatcacgctaactttccaaaaacaatgttcttctgatggatcgttatgacatgtcacaatcttttaagttacgcttcctttgcaatcaatgatcatcataggactaaaaaccaataagattagttggtcacctatgtttttggcttggtagagacgacctaaatatattgccaagatagtacattattactagtgcacatgtactcatcggacatgtcgatgatagaaatgcacgagtcctctttgatcattttcttgttctcctctcttgtacaatcttgtttgcatgccctcaatggtgatgaattgtacgtagttttgctgtggcggttgcacactcatcttcaatcttggccggtaattaatgtagcgaacgtgtactgtttgatctgtctatataggctggcggatcaatcaagaccttgttgtgaagtttacttggtctaaaaccaaggagagatatgttcaccggttttggccattgttgtcccttgccacgatgatcgtctttaatttcatggtggttgtgggaaaaaaaagtttaagcacacgatccatctaattaactggataatgttccaacccaaatcgatcgatgataatgtagctagctagtccaggatctcaaggagtctctctcatagatactccctccgttttacaatgtaagtcattctagtatttcccacattcatattgatattaatgaatctagatagatatatatgtctagattcattaacatcaatatgaatgtgggaaatgttagaatgacttacattgtgaaacggagggagtatatatagatcacatgcattctgaaacctaactagctaagtagctactccctccgtcctataatattaaaacctatgactggatgagacgtttcatagtgcaatgagattcattgtactatatgaaacatcccgtccagtcctaggttataatattatggaacggagagagtagctactactacatccatttttaaatatatgacgtcgttgacttttggataaacgtttaaatatttgtcttattcaactttttgtgtgaatataaaaaaaattaagtcatacttaaaaatacattagacaataaatcaagtcgcaataaaaaaataattacataaatattttgagtaaaatgaatggtcaaatgtatcttaaaagttaatggattcttgtataaaaaaacggagggagtagtacttttttacaaaatggttgatgaaacactagaatttcgagctcaattgcatgggaggcttcttcacacatcctctccacagaccacagtacacgcaggcaaacatgtatctaaagactcaattgagatcctctgtgcagtactgcagaggacctgcatccctgaagactatatactgccagcatctgcatgcatgcatggtacaaccaataggctccaaattaagcacatatagctccatcgatctccatcgctggagagcacgtacacatgcatcagatcgaaaggaagctagctatgtgacgcatcactcactcgatcgatggctcactgccatctaccaacaatgtacctagctagagcttaactagagccacccatccatccatcatgcatgcatccacatctctgtctagttctctacagtacacacacatagagatcattgatgatgtgatagtactccctccgattacatatataatttctcgatattttagacagcaacacggttgctagaatatatctttgattataatttcattacatatattttttactattataaaaattaaagatgtttgtgtcggtactttggtacgtcatccatgtatgagttagttttaatttcgttcgcttttggaaatacatatccgtatttgagtagatttttaagttcgttcattttttaaatatagaaaggactcctaattgtagctcataattttctaaaaaaatatatctaatcaaattcctatagtaaattacatcttaactaaaccatataacaataataagattaaaatagtgttcacctgttgcaacgcacgggcattcttctaatataagataaatatttaatgttattaacatacttttaaagagattacttccaccgtttcatattataagtcatttgatttttttcttagtcaaaattctttaggtttgacaaagtttatagcaaaagttagcaatatctacgatactaaattagtttcattaaatttaacattggatatattttgatacgaaaggcctcatcttttcacttatgcttatacctattagctaaaatttaaattttcaaccttaaatttggagttttttcatcgtagtttattttttagcctttgcttttagatcattaagaacatgtatataaaaattgtattcataaattatttttcgtttgcaaatatgatgataagcctaatgttgaggctgggagtttgttttgtattgaaaacattattatatcttgctgcaaacttggtcaaactttgaaagtttgactaaaaaaagtcaaacgacttataatatgaaacatgagaataattattcatacacatacttttaaagactcgtgtttctagtgtctttaagctaaatattttagaagttattgatagttaaaattctaattattcaacatcaattctatctatccaaaacattaataattaagaaactggagagctcctagctaagagataggtagatacaaatacgcatagatatattgagagccatgtgagccggccctagctagctagtagaacacacaaacacacacaactaatgctaccatgcatgcatatatatggatggttcgtactagctactacgtctttttagcttgtttgttggtgatccgatccaatccataattgcgagcggcggatggccggccagccgccgccgccgacgattaccccggcggccgtcagatttgaattgttcgccggccggcgtgtgcatgattggccggttgccggccggttgggatcttggcatgggttgcccatgaatttgcatgggcctgccatgattgtgtgtattgtgactgatttgatggggtgcatctagtcgatcatcgattaattcatcgagataagctagcacgatcaaaatctggtgattttgttaatataatcatacctgtgctaattaatggttgaggtgaaatggcattatcatgttggttgattttatcggttcactgttgatacgattagggaggagataagccaccgtttccttcctgatcaagaaaaaaaaagttaaagataaattatgttttgtgcggtcggtatataacaaagttcctccgccattatattatctttgtcaaagaaagaggagagataaaagggataatacatgaattgaagtcacaattttaaaatcctattataagtcgcccgatcaacttgacgtaccaggaaggtgttcgtacagtgtctctgactagtttctgacatctagaaagaatttcgctacatcgatagaggtcgagtttagttctaaatttttttttcaaacttttaacttttgcatcgcattaaaatttttatacacacgtaaacttttaacttttctgtcacatcgtttcaattttaatcaaattttaattttagcatgaactagacacactcagaaagtattgaccaccgattcatgattaagtcgacgcccctacttttcctacgacacgactggatcataagaacaagaagaaagaataacgaaagaaccgcaagcaaaggaaattaatagacgaataggtttcaacggcttcatctttagatcagttagattaattccacatttagcagggatgatcatggtcagactaagaccgagattaagtaaattaaactccaacatatcttttcattaattgtgtcctgttttaagcatttagtttgatttggaaatgaaaattaaggtcaacgaattaagatagatcagatcagttgtttgcctatatggtagtacgtggttttggtgaagtgtcccatttttgccctccgtacactggtcggtgcaaaacgccagtgtcattttcctatcttaattcttaccgtgtggagaggatcagtactcgtaataggggcgcacggtccaagtggaagaatcgtcaggattggccaattaaacctcgggctggatcagctggtatcatgtacacaattcataaatatttaatgtttgtttaaaggggaaatatctaatgaaaaacatcaaataagtgaaaaagccgtgaaaaccatatctaaaaccatatctaaaattcataaaaatgactagagataggtatagacctgaaatacattcataccaaaactcaacttcaattgagagataaaaaaaagacaaattttaggtgaatagtgttatgttattattcattcaaaaattttcttttttgtcactccataataaagttgagtttgaacttgaaatttagtgagaatatatttcatatctatacctatcttaggtaaatttttttatgaatttacaaaacttttaggtctggttttcatggattttcacttatttgatggttttcaccggatatgtccccttgtttataataaacttttaaaattttatcttaaacatcaaagttaatttcctgcgagcactccctgtttttgtttgtgtagtgtaaattttgatttttcagttcttgtttgtatatatttgtaaatgctaaatacccatgtattgtaacaagtatacgttttccctctctcatagccttgataatttttagtccaaaatgcatcagtgtttaggctgctttctttcctagttttctcaactcaactctctcgttttccacgcgcacgctttttcaaactgctaaacggtgtgtttttttaaaaaaaattctatatgaaagttattttaaataattatattaatctatttttcaaaaaaattagttaatacttaattaattatgtaataatatgtattttgttttgtgtgccctcctcctcccgaacgcagccttagtagccctacatgtcagctgacggtgggagtatgtggtgacagattctcaccaacttaatttattaatgctcaaaatttcaattggtgggtgttgatagattcaccgctcaccagcactactcgagtcttgtaaaggtgtaataaaattgccattgcattgcaccatataaatattttgaccattaattcctgttctgtaaatttaacatcatatattcgtgccaaataagatcagatccaaattattccccctacttattgaggacctattttagttcgaataaaaaaaattaacatgcgtatctgttgaactgaattcgtcagtcagatggagtcagaacactggtccggagatatttctaaaacgccaggctgctgatatatataattgagcattcgtcaaagtaaagaagagtatatgtcatgtgctcctctgacaagagagacgaaaaaaacgagcacaagatcactgcaaatacgacgtacgaattgaagctagcagctctcgagcaaacgggatagtgtgtccgagctcaattatttgtgttgtttgacgagttgaaacgcgtattcgtatgtcgagttgcaagtcaaatttctcgagatccatgcacagtttgaattgaattgagcgtacgcccgccgcacagtttgaaaaggtctccccctttgagaatatggtttgggaattcaattagaagcagttcatttgtttttggcaagttctaagcattcctaattcattgttattcaaatatagccaatattttgtttgtaaaaaaaatcagagtaatgcatggccggtttatgacttcggggttttgggcacaaagaaccatctgaaaagagaagtccaatctgcacacttgaaaagtaaaaaaaaaaaaagcaatgaaataatatgatttaatttaaaaacttttctcttttttttttcctgatcatggcggtgatcgggtgatgcgtggcccatccttgatcctggagcccacgcgcttgcctacttgatcatcaatttgcccactttttccacataaaaatacaggcaatgcatacaccttatcatgagctatactcctagctagcaagcaagcacacagaaacattgtttattctttttccaagtgtatattccttcctttttccagctttttctcccattttgtaatgcctgcctaaatggagtagctctatgtatatcttttttctaaagaaacaaactacaaacgcattcgctcacaacacgtgcactcatcccacacacatacaccctactcctatgagcacctcgggaaaactgagtcgacatatcttgagattaacgaagtcaccacggatctcttgctgtcgacgggtacatcacctaccattgaaagaataattaaccgtaaatatgagtatctgtgtcaaatttaggatttgaactcgggtagaccaagtaacctgaccagctacgctcactacgcagctctatgtatataaatgcaaatatgcaatgaccttgccttaatttgggacacgtgtcacagcatgtgctggatctcattagcttgcaaacactcaatgtgcattatgcatatgtgtcaatgtgtgtgttctaccatcacccatcattggtacattttgctacatgacaagtagtaccagatttattaacttggttccacatcttggtggagtaggtcatatgcatttacaagctctttttttcttttcttttctgttgatcaaatgattgatcaagtagatgtgcacattccttttgggagttaaaaaaaatgcttacttaattacattatacatgtatgtctctgtctatctgatcctctgttatgtagcatcattgcacaatgcttggaatctacttaattggtgaatcatgggggctatcaaaagaattaaagggaagggtgagagttgtgcaccagagactatgattaggagctaatgaggggttgttagtttgtacttattgtattctacaaattgtattattgtactagatactaaatacatggctcatcattgggaacccttttcatttgaaagaagggtggcctgcatggtcccctatgaacatgttatttgcttgtcaagacttaggtttgttgggtgagcctcttttgtgtgacagcttggatgaatgtccaaggaaagaattaagaaaacatcatgtagaatatataggtactaacaagtactcccttgatcctacagccatgatctttgcataaaaagaggatatggttcaatgaaagcaaccaaatacacaactctgaagaaagtaacaatgagagaaagtagaaccgcatttctcttttgtgcttttggttcgtgaggatattttaataatgagagggaagaaaaacaatatacaacattgaagaaagttaagtagaaatgcattattcttttgtgcttttggtttttgaggctattgtaataatgagagaaaaattagacatgttttgcatacacccctcatggctaagctcaactatcaggatcacaaattcaggtggcaggtgcctttcttccctgtccaattcaggaaccattctgctgttgaacacgaccatacatgcagctctagatcctcaatattttttcttggccttccttctcagcaaccataaggacagacaggactggatccatagcaaaatagactaataccctaccaagtgaagtgaagttcatcacaaagaaagccaggaatgaactggactttgttctgaagtggctacagacaggtggttgggatggcaattttcagaaactagatttgatatgccttaagtatactgcccaaatctcattcagtggtatcacaatcatgcaacactgccagctgcccagctttaaggctaaaggctaccccatggtaacagtaaattaaccagcatttggatcatatttgtaagttccaacaggttgtcttgagctttcctctataatcaaatcacagcaagtttcggtgaatagttctgaaaggagcgcatctaattatagcaaagatatggtgttaccgtattatattataaccaaccaagccaactccaataaaattatactaccttcattccaaaatactccctctgtttctaaatatttgacaccgttaactttttagcacatgtctgaccgttcatcttattcaaaaacttttgtgaaatatataaaactatatgtatacatataagtatatttaacaatgaatcaaataataggaaaagaattaataattacttaaatttttttaataaggcgaacggtcaaacatatttaaaaaagtcaatgacatcaaatatttagaaagagagtataatcatttttgggcgttttaaaatgtatctggatattggaaaacgcacataaatgattatattttagaacaaaggggtagattagtacacgggcatggcatagttgtaggcacatcattggaagagaatacagagcaacacatttaatctttcaatcagcacaaaacctttcctggtttcagctttgaaattgttggcacaaaatgtaaaatttctatctgataccatttctaagctggcacaacttaaataacaaatagtagagttctaagtatctctcagacttaaattgactgctaatctaatttgaagctaattaatgggtacagggattagtgaagccaggctgaatgggagtcgagcagttaactggttcagtctgaagaaaggggaggaatgtcttcagcgatccctttaccatcagcggcgtcgtaatagaagaaattcttgatcggatcacccttaccagatattgacttaatcacctcctgttaggcaaaaacagagtgcaaaacaatgagaactgtgcataaacacagatgaaattcctgtttggaacagaacaaaattaagttcctgctgcttttgaagattaacatttgacaaagtacagaatacttttcttggcaaaaaaaggaatattactacttttggactcctttcagacatcactgagttgaggttgctaaataattcagaaaattttacattgctacagaatgttcaaatctttcttgtgctagttctttcattgtgtataattccttgaaccatcaatacaaaatccgtattccaccaaaaggctgtagataaaatatttacatctttgaaggtgtccagtgagagtaccgatccaattccatgtgtaactatcatctaattgtggcaacacaatatccaagtatgcatcttgggcccctggactgagaactacacattcatgctcccaaaattgtatggctgagctagggaatcataactgataattagaggacacagcacttctgctagctttacatcgatcttacgtagcaaaaggatagtcaaacttcagcacatgtctgggcaaagtgtctgtcatgggaattgggcctggaggctgtgagacccacaaccaggacaagcaaggcaccctcagccaggggccatcattcatgattataaattaagttgtctttcaatatgtccgaaaagacccactaaggaccttaatatgtagttcctaagttcatggacccaagtaatgtggtttaagtgaattactgcaggagtaaaatgtggatgcatagtatttgttgaggagtttatttttttcttttgggggaaatggttattgtgaagttagtagtttacttcaattaccatctactagagggtaaatccttaattgccatctagttcaaccacatatactcaattttcacattcaagtaatggaacattggtacctacctgaccaagaatgccgccaaggattgcacatacaggaggatgttgcttctttccagctgctaaaagccgttccaggagagcagtaggaatttgagactcacttaaagactgcagtttatttaccacaccatgaaaaaaatcttaaagaacatgattgaaattaaggaacacaaaaacttatataccattttatcacacatgtccttcctcagagccaaaactgcaggtcgatcagaaagtgatgcctcacaagcattgcggccttcagatgactcataattctccagtactgcaaaaggacatttcaagaggacatatgcgcaggggcagggaaaaacaagttagaaagctggctgatttgtttgagtatttggggagataaaactgcactaatgaatcttcaacagtgctgcaaaagtctgacatcctcacctctcatggcaaagtacagtttagttgtttttcttggtaaattcttccagggtacggagatagcttcctgtataaaagatcatttccaatgataaacaaactgtaacattccaaactgaagcatccaaaatggtgatatatggtggcatatggcaacaaattgaacacatatttaagtgatgatacacataaagaaagctaaaaagtcaaggtcaacatgctacgctactccattcttctagggatgtatgcaaaatgaacaaaccagaaagcatcagcacattgtctagtgtagatttgaactcttacaaaattattccaaaaacacctataacccagaaaggggatttctgtggaaccaatttaattaccacatgaaatgaagacctccaatagtaaggctgggctacatgagcataaataagtgtatttttctatgccgtgaaaagaggatttggtaatagtgttgctgtgctctacatcaatcttctgtagatgtatctacgtattcaagtcttatccagattgtcaatcatacttagtttacctactccttaaaaggagtaaggagatggtgttggtatgctacactgatctccgtcaatatctatgtaaataagtatgtcctttttaggatttgattaactgcaaattggcacatgtatacatgtagattgccggctgatatggttttactttgttttagattgaagatgactgttcttagtattgtaaaaatataatatatgatacacatttattcgaataaataagcactctggcattctgatagtcaaaacaaaaaaacagcagagtaagcattttgtctatttatttttttgtcttacagaaaatcatttttttcagaggaaaacataagtttactattattaaaacatgaagacactattcaaattgtttattttttcaggttaaatggttttcatgtatatataccatgtagcttgtataaggtgcatcataaatattccacagctacatttatggcagccaagagagaacaaactacaggggcaatacaaaacatgtaatattaaatgaaagatgttatctcaagttggatcagcttcctctcaaacatataaaaaaaagatcagcttaacaagtcatttacctggagacttggatatgccaactcctttggtttgggttcacctccaaccttctgagaaaaaaaaaaacacataccccttcaaaaaagtatccagggcccaaactactgaacaaagaaaataattcctgaaacattctagtgatcatgatttccaaagcataagtgcttatatattcatagcgattgaaccaaaactagcattgcaagatgaatccttggtacaaattacaaaacttaatatgctagaaagtgtcacattaccatattttaagcaccaaaactaagtaacctttctttgtatcaccatttcaatgatgcagaaaaggaacagatacaataacttggttgaaaaccagtcagtgagagcagattagtacactacattttattaccaaaaaaaagtacgtgctcctttgcaattctcatccttaatggcaccttcatcaggctaagtacatcagatttaatatgttaacatgaacagtctgacataatgacatcaattttgagttcaaacatatcatagaaaaaaaatgagtgcctctagagtacatgaagaaaagtactaacaagtacacaaaccacatgcatgtacacaggaaggaatattggaagcagtatatgagaaacattatggagaaaataaaccaatttaagacatctgcgcgatgcttagtgcttacagatatatatgtggactgctggaaaaaaattaaactgaaaaatcaacagaacatatagcatgtcatatatgcccatacctgaacatagctatggttctgcaaatcaacaaatatttcaccacaggaatccttgcactcaatggcgtagaatgcaatatgcttgcttctcttccggcagttgtcgttaattaacaactaaagcagtacaacacatgcagaaatgttgtgagaactgagcgcaataaagagaaatttgttgcagaattttagtttaaaagacactgagtgacttggaacttgcaataggatgaagaactaaacgggagaagaatacacacctttgttttaataggcgcacagctaactacaattatgtcaaacttgtcaaggaattctccatcaattaatgatggatcacctaaaggaaatagcagaaacagtaagaaatttgtttttagaatatgctgtgaagatccaaagaattagtcattgttatggccacagatatatcagaattctctcagtaacatatatgctgatttcttggtacaatgatacactatagtaacatgtgcctgttactaaaattaaatgatttcttacaagaactttccttgttaaagtgcagctaaaagtgtaagattacaaattgaaatagaatctcttctttaacattttattcaaagattaaccattaggacgagagcaattcaagaatgcaagaaggcatcctactttatgtacttctaattctgacacccaaaccaatgaagaaaaccagactaggctcacccttttcgactgcaactcggaccattggattgaaatctttcagggactcacagcaaacctcagctcgtgatctaccaccatatatgctctcatcatgaggaattaagaaatttgcattgagatcatcctctgtgactaaatgatcatccatcaaggataaactgccaactcctgctagaacaatattcttgcagaactacagggtaagagagaaatggcatttagtgtataaggctgccttcgattatgagttaagctttatcaatatatccagaagaactgaggtacttaagtacctagatgaatatacaattgagtcaggatgcagctgcttatgatactctatgactacagaaatctagtttctaaggcatatactttaactactacctccgtttcaggttataagactttctagcattgcccatattcatatagatgttaatgaatctaggcacacatatatgtctagattcattaacatatatatgaatgtaggcaatgccagaaagtcttataatatgaaacgaaggaagtagtaaatagtataatagcaatcatattcttaacaaagcgaagtgcattgatcagataatcatgggatatgactgtaaaagaaaaggataaatagacatatattggaacaacgtaagctagcataaataaatgaaagaatttatctacagaaaattgagcctaaacgttgagaactaaaagcaattaactttaacagatggtacaacaggggtcctacaaaagagaaaaagccagcctaaaaagtaaataagaacattgagattttatctcgcaggcaatgcatccatagcactagaaagtctacaagaacaacagagcaataatcaaatgcccagaaaactaatgagttataataacgaactaaaagcaacaggtaaacatgggcaatttggcccatgaaactaacccctattactccataactcaatgcaacttcgtttcaatgctttgaatgcccacgcggtgtaaactacaaacaaaacgcaacaattggagaggaaaatcttaaaatacctacctcagtagtagtaccattcatgccgcacacgagcacatgagctttacttagcctgttccaagcagcacagattcagtagtcaaaaacagatgaaagacatcaaaagttttggttccgaagctaacaaatacgatggaatggaagaataatttgggggtgaaagttacgagaaattcaaggaaagcaccaaacaagctcaaaaaaaaagatttaggaaaattcaatagcagacacaagatacgaaaacagcggatatctctgtcttcacttcaaaaatacaaacacttcgggctcaagtttttcttttaaagaaacaaacaacagccattcgttctaacataaaccatgaaatcccccaaaagaatgattttcttttcttccttttctgcaagaaacaacctgcgattaaaagagaagaaaaagaagaagcatcaactcaacaaaatttcctccacataagcgaagagcgaaagaaaacccgggacttttaggggaagagagagagagagagagagagagagagagagagagagagagagagaggcggagccggggatacctcttctgggcgtcaacgccccagacgcggatctggcggtcgtagagcgccgtctcctgcgccgtcagctcctcctccgcgccgccgccgccgcccatcgccgccaccgcccggatccctagcctgggacgccgcgaatccgatcagcagccgaaggagaagggggaggagcagcagcaaagcgagggtttttggcgttcttggctttcgctgctgctagtagatgatggctttcacttcattctatttctttttctctttttatttgtttttttttctgttcggctgcgatttgggctttgggccttgggccttgggccttggatgaacggcccagcaggtagtttcggccctgaggtgatgatgggctatatgggctgatgggccaggccctatggttgatggtttgcgtcactaattaacagcttgtttggttaggggaatataatagagggaatgagagtttggagtgtggagattgttagggcatcactaatgtatatggcaaaatgatccatatgaatgggacccacataaatagtttttacctatggtaatctccacaatgtatatggatacaaggtatcattaggagaagagagaagagtagagatagataatataatttattccatatgggtagtccatatgtatatggataccttttgttatttttttctatatgaactagttgcacaatggtaataggtggttgaatgaaatattttattgcttatggactacttttacaccacattgtggatacccttatgtctattgtttgatcggtggatatataagagttttttttggagttgggaggggcactttgagcaaactccatgcttggaaggcaattcccttttttttagtacaacgagataaatcttaggcaaaatttgctacaggacacgcaaaaaacacgtaattagctgagggacatcgtgaaaatgtgaaactgcccgaggacactgcaaaatatgtgaaatttgccgtatgacaccgaacgcattattttattattttctagctgaaagtggcgagtatttttttcaaaatgacaagattgcccccaatggcaagtatattttcttcttcagtggcgaggcgaggcgcgtggcgagctcggcggcctaggtgcggaggacggcattctcggcgtcgacagcgaggaggccctgggtggtgaggccaagcacgatggcgacgtgcgcgttgtcgcggcggaggtgcgccacctgtgcggtgaggccatcgaggtggcgctgcttccgcatccgcaactgccgcaccaaccaccgctgacgacgccccctccccccgccgctgccgacaccgtgctcccccctctcccgcttgaggaagccattaagaaccaaccaatcgacggggaggtggacgggcacggcgtcaccgccagacactcggcacccagccgcgcgcgccgccacatggcacctagctgtgcccgccgccgcccaccttccgcccttgcgtgccccgtgagagagagagaagagagagaggaagaggggaaagggatgcgcctagccaccgcacgccggtgcttcccccctttaccgcccacatcgcgccgacctcgccgcatcacgcgttcccggtaaagtcaacgggaaagggaaagaaggaaagagaaggggcaatccgtgcatttagaaaagtatctcacctcttttgacctggaaataataaaataatgcgaccagtgtcatatgcccaattacacaatttttgcagtgtcctcgggcagtttcacgttttctcggtgtccctcagctaattacgcgttttttgcgtgtcctgtagcaaattttgcctaaatcttaccgtacatcatcacttcgaattagatttatctacatccgtactctaatagagatagggtgtgtgttcgttcatagggggtgggtgtaactgcgttgttagcgtctgtatttgtattgtgttttaaaaatttaaaaaaaaagagaagagattgggagtaaaagttaaacaccaatgaccaatcccttcaccaactcccttctccaagatcccaattggcaagtaaataaatttaagcactagaaaaatttcggaagtttttgttcttgaagaactttatttatcagatttttattcaatatatattttttcacacaattttgcaagaatacattcatattgctatattgcctgttgaattcgcgatgagcaccttgccgccaccgaatggcatggctatactcatgtaaaatcgtgtaattcagatagaatcgtgtaaacggtatattcatgtaaaattgagtgaaaaaaatattttgaagaagaaaaaaattctatgatttttacatgtacattatagaagatcttgtaaaataattcttgccttccaaacaaaattagcagtaattcaactcactgtaactcgttgaacatcacaatcagaagagacgcacctgcattgcatggcaattctttttctttctgtcaaactttttgagcaaaaactttttgccaaataatgaacaacaaaaacctgattggcaaaagtggtttgaatctaatttacagcaacgaaccagagaaaattcgacgcatacctgcggaagaaacctatcaaattcgccacaaacttaggcagatccatcacacaaagaacgcagcagctgttcatggcaaatcagaccacgccggaaagcatgtatatatgctgctgttatgctccagtgttagatagtatagggagagagatactgcgaataagccttagggacgattggaacttaagtaaacttgaagagatagagatggaaaataattctatcctaccataacgaactggatcaatacgatcttatccatatactagttcttcagagaaatgatatggtgtgaaccgactggatgcgtccgaaaaaagcaggcgatttttaatctgacccttcgatttccaccggatgattaatatctgaggcgattaattaatatcttggttaattgagtgagtacttgaagaaaccaaaagacagaacaggcatgattattgttgctggttcattcagcgattattcagttgaacaggtatatgaacaggcagggaaaatgaaaccgttattttttgtaagtattttctgcctactaaaagagagatcatttttccctaaaaaatagaatgagatcattttgcacatgttatttatggatctccactcctccggtccaatatcattgaatgaaggaataagtctattctgcctccctcaactcttgctcttggctgaatcccacctcttaactgcaaaattgggtataatgtctcctacctttgaaaactaatgcaaattggttccttcgatggtatgggagacggtttcgactgacgtgacaactttgaccacgttgactgcctaagtcagctctgtcaaaacttcgtctatcctatcttcttcccttttttactacgacgaactaaatcttagcgtacatcatcacttcgaattcaatttatatccatccttactctcatagagatagggtgtgcgtgtattcgttcataggggggtgaatgtgcgttagcgcctgcatttgtattgtgatgtaaaaaagaaaaaaaaaggagagattgggagtaaaagtaaaacaccaatgaccaatcccttcaccaactccctcctccaggatctcaattggcaagtaaataaatttaagcactagaaaattttcggaagtttttgttcttgaagaactttatttatcagatttttttttcaaaatatattttttcacacaattatgcaaaaatacactcatattgctatattgcctgttgaattcgcgatgagcaccttgccaccgaatggcatggttatactcatgtaaaatcgtgtaattcagatagaatcgtgtaaacggtatattcatgtaaaatcgagtgaaaaaaatattttgaagaagaaaaaatgtatgatttttacatgtacattatagaatatcttgtaaaataattcttgccttccaaacaaaattagcagtaattcaactcgctgtaactcgttgaacaccacaatcagaagagacgcacctgcattgcatggcaattctttttctttctatcaactttctgaccaaaacttttgccaaatgaaccataaaaaatgacgaaacaaaaacctgatttgcaaaaatggtttgaatccaatttaatttcgcatgcatacctgcggaagaaacctatcaaattcgccacaaacttggagagatccatcacacaaagaaagcagcagttgttcgtggcaaatcagaggacgccggaaagcagctgcatatatgctgctgttaagctcctgttcttcagagaaatgagatggtgtgaacggtgaaccgagtggctacatatgaaagaagcaggcgatttttaatttgacccttcgatttccaccgtgtgattaatatctgaggcgattaatatcttggttaattgagtgagtactggtaggtagaaaccaaaagacagaacaggcatgataattattgctggtccattcagtgattattcagtttaacaggtatctggagagagagagagagatcattttgcacctgttatttatggatctccactccggtccaatatcactgaatgaactcttgctcatggttgaatcgcacattccaatcgcaaaaccgggtataacgtctttcctatgttggaaactggtacaaatggagaccttcgttggtttgggaggcggtttcaaccgatgtgatagctttgatcctattaactgtctcctgagtcgttatgttggcaacttcctccatcctatcttcttcctcacctctccccctctctctattccctcttcgtcctctctttccccgacgaccgatctgttgccgtggcggtggcagcaaccctgcatcctacctactctactgatggacggcggcgcggccgatccagggggtgccgctccatgtcactggtgttggctcctcctccggctgctctcaaccccacgtcatcgctgctgtcgccgtcaaactaccatcagatgcattatgtgtgtcctaaccagatcactcactcactcactcagccagccagagagaagagagagagagagaagctgagagcagcaagaacgcaaagctagtgcagtagtactgtagtaccagtagtagtattttttttcctcaactcagacgcactagtttgtttgtccatttcttggtgtccaccacgccgcttccgccccagccgccgcagcgccatccatggagagtgtcagcagagtcacgagcacggatgcatctgccatcgctggttgtggccaccgccatgccaacacatcgatcgtcgagggaagagaggagagagagagagaggggtgaggaagaaggtatgatggagaaagtcactgccaagtggatccataaggtgactcagcaagttgatgggggtcaaagctgtcacatcggttgaaaccgtctttcaagccactgaagaagccattttataccggtttttaaagatggagaagacgttatacccgaatttacagctgggaatatgaattaacttaagagcaagttgagggagccaaagtaaacttattgcttgagtgaagaatttttttcatttttagattttttttaatatttacagaaataatctatcggccaaaaaaattgcaaaaatagaccctgccgcccacggcgggtcgaccgcgccgtctgccgccgtcggccaaaattgcaattacccccttgccgccggcaatgggctaattgcaatttttgccgcccataaagaggttgcgctcgtactttttgtatttgggccacttgccgctccagtagagggcggcaaaggacccagatgcaaaaagtacggccaaacgatttttctatgttatgttaataataaataaagaagtatttattggtaaaacttgttaatattgttataaaaatgtattgaagttggttgtttcgcaatttcatatgttaagtaaggtattattttgtaacttattcgacgtattagtactcggataattaataggcctatcgcagtctcggtcgtagaaacattatatggacttaaacaaggagaattatgtaacatgaagaaatagtagtacaatttgaacatgatacaactatttccattgtggttatatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaacgcgctttagttaccctgtattgctctggtagttcaagctgcacaacacggctaggtggagttagaacccttctggtgtctatccattctttgtattgacatctccttggtggttcctaggaggaaagaatagatgtaaagcgagcaaagttagtaaatgttgtgagaaaataaggattcatgtaatcaaaatattcttaccatgaaatcgtcgtcaagaatatttggacaaacaaagaaccttcgacccaatgttgtaggctttatggaacgaagaacctgacaacgatcaccacacctgcatcttggacggagtgccgtagttagcacccgccagtcgctctattgttcacgacattgtcgttcataagctgcttttctctgtaagtattgctcagtactttcggatgcgaaataccagtgaccttcttgtaaacaagtggttaggtcgagaacgggattttctgtatcgatccactcgatgtatgcgcaagccgtagtgcgggtctgctgaatagagtagtgttacgaagaataaagcgattgcccatacggaatgaataagcatatgcagataataaaatacctcacggtcatagttagggcacctaaaaaagcgccttcctcgaatattaggattcctcgaagccattagttggcatcgatcaccgcataggcagagaggacgctggcaccaaggtggtagtaggtatcctgacgtgccatctgtgaaaaatatagtgtttcgtgttagaacaattcaaaaagtagtaatgtcaaacaaaagataacttgtaaaattatgaaataataataaaatcatgagaataatgatgtacaacaagagtacatgctatttaaatatagaaaacgttactaagggtacataacgatgacgtgcaatttaacatatatgtagagttcgataatataacataacataacataacattacatgtcgaagtccgacattacatcagcatacctaaagacactaggtgccttagtctgacgttacatcacgagacctaaagacatgacatgccgaagtttgacattacacgacgaaatataaacacatcgataagttcgaaacaaattacaagcaaagccacatgccaacatagaacataagaactacaccacgtagccagacgtggcacgacgacgcctaggacattatcgagtggaggtagtgccttcacccgtagggctagctccatctgctgctgatcctgatagtcctgcctccgccgcacttggtttctccttgtctttaggacaatgcttgtaggtgtgcccacgttcatcgcatttgctgcaacgcttcaccctgccagcctccgactcgtccatatcgttgcggatgcgacgagtcttcctccttccagccttgcctcggagcttcgatgggtcaggaatattgagtacttcatcgttagtctctgtgaactccccagctatgccgaacccataaatctcgccgctccatgtatgatatattgcttacttactgaagtactgtgaaacatatactgcatctggtatgccacactctgctgcggcagcaatgacatgggtgcatggcctatggagcagcttcggctttgcacaagagcaatgacatgtgccatcggctttgagaacacactcctgcttcactctcttgcggtagatacccttgcctaccttatcttgacatagtatctcaaacctgtgctgttgggtaccttgcactagagctcgatgtttcatggcctttttacgcaactcctctagctttttcttcatgaaagttccaaacaaaatgttgttgttcggcatagagggaagaactgcctggaaccgatccctaaaatacctgcatgtcccatgtaaaatgaacttcactatgccaactagtggcagtccacggacaccgcgcatcacccagttgtaaacttctgccaaatttgttgtcattattccatatctagcaccacctgtgtcatacgccttggcccatttctcttttggttcatgcagaatctactgagaaaatttccgaatctccaatccagttcttctaaccaatgttggactatccgttgggagaggtccaagagcttgaggagggtcagcatcggcggtcgatggagccgctgcacgctgatcactgcatttggctgtcaactcatctaatctcttccaaagctcattgaattttttctcctggttctgattgcatagcctcttaaacatgttcatgagctccttgttcttgaattgcatgaagaaattagctcccatatgacgcatgcaccacctgctctgtacatcttcccactcaccagggtatcctcgttccatactcccaaactgcaactcttctatcgctcgcagaatgccagcgtgcctatcatgtatcaggcacacatttggcctcataccaacaacttttgttttaaccaatttcaggaaccagtaccagctatcagtattctcactctcaacaaaagcaaatgctaagggcaatacctgattgttcccatctacccctattgctgttagtatctggccccgatactttcctgtcatgaatgtcccatcaatgcagagaacaggacgacagttcacgaatgccatcttgcatgcatgtagagctaagaatgctctttgcagcacactcttgctaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcgtattattgaccttggttcatatgtgagattatcgatgacatgcgcatacatctcagatgcaacaaatgcacatgtaatgttcctgtggtatttctgaacaccaggtagaaaacatgtatgcttggtaacgactgacactgtccaataatccttccatttccccttatacgcgtgcactctccagggacaactatctttttccttaacacaccgaacttcatattgcgaccggttggacttggcaacccaaaactctctatgaagtgacactgcaaaatgttttaccgcctccttcatatcttctgctctactataaatcgctccctgaataacctcattttctttgtactcccatctcacactatcctcttcagagacgaccagctcagaaaaatcctcactagcccattctgttggattaatatccgtctcatcatctgacgaatcaccttcctctacacgctcgttgtcagaatcctccctctccatttcatccacaatggcaccgacagtctccccctcgtcggccactccacctggttgaatgcccactggagctactacacccccgtcctctcgtgcgttgacctcctccacagaagtctcatttacttcagcacttagtccctcgccatcatccatgttcatctgcacacatggatccttcgggtgaacaaacggaaccatagctagaggccacccgcgttgcaatgcattttccacataccatctccatactcgagagttttgaactggcattagttgccaataaaaaccctcagctgcccgacttactatgacattgattgttatgtcacttgtctgtggatcaactctcaagcccctcattaaccatccttttatagaaggtacactcctctcagccggtctatcaattcccctttctgatacaataaaatctgacagatctaccccagttggcccgtaacggacatttcctgggccatggtaaacttggaatatttgtttgtttgacatatctgtcaacgaaataactagatcacattactctttcatgcaataaacatctacaacgtaatatcttcttgtgtttgccaatgcaacggtaaagtattgattccaaactagcagatctacgtagttaccgatatctataatacacacttctagattagtacaactaaaaccctaaaaatataatgcatttattcaaacaaagttttaaaaaaatacacactatttaactcaatagtcacatataggatctatgaatattacctgaaatcggcgtctgaatctggcagggcttcgccccttcttctcttctcctcccctttcttctttttttttcgctggatttgagggggaggaatgagggctgggggctgggcggca

SEQ ID NO: 76006 - DNA, 26367 bp, Oryza sativa
aggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttactaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatggcagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcagggtgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactgatgaagcttaaggctattaatggctggtcggacaagagttttacagaactccttgagctgttaaagtatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtgggggatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtgcagtggaggacaatcgataggatttaccaggaattctcaaatgacccaagaaacatgcgtttcgcaatgtgtacggacggcattaatcctttcggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcagagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcaacacccgatccagcggttgtgttccttcttccatgcaatcggccagaagatcattgatcccgagggactagataaactacaggcagaacttgtgagaaccctatgtcatcttgagatgtactttcctccaactttctttgacataatggaacatcttccggtgcaccttgtgaggcaaacaaagtgctatggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgaaggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgccaaacaagttgttcaagtgttctacatagttgacccgtgtaacaagaaagtacatgttgttcgtgaagggaaaaggagaattgttggattggacaatattgcagacgaggatgattacaaccagcacgtccacggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaatacactcgttttaggtaagtttatatgtgatgggtttatttgtagggttttataggtgacttatatgtacgggctagagtgttgggtttgtcataggtggttttattgtcacggttctatggttggcgttcgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgccctcctctccaccgccgcctcgacctctccaccgccgtcctcgccgccgccaaatccgccgccctctacgccctcctctccaccgcctcgacctcgacctctccgccaccatctctgccgccgccctctacgccgccctccccaccgccgcctcgacctctctgccgccctctccaccgccgccgcctctcgaccgccgccgtccatctccatcgacctctccgccgccatctccgccgccctctctaccgccatctccgccctctacgccgccctccccaccgccgcctcgacctctccaccgctgccgcctcactcactctttcgacggccgccgggacctcctctcagtcgccacgccaggaccgtcgtcgccgccaccgggatctcctctccgccgcctcctcctctcgaccgggactcgtcgtcgccgtgtgccgcctcctctgctcgtcgtctcctctccaggtacccctctctctctgatgcccatgaatggaagaattgattctttgataattaaggaactttattaggtttagggtttgaaatttagttcaaatggaaaaattgattgattggccgcagatttaatgttgttccgaggttatcaaaccatcacagaatacaaaatgcatggggaattttggtggattggtcagtgtagtccatggacggaaccgacctagacaccaaaattctccatgcattttgttttctgtcattctttgatgattaaggaactttgcagattatctaaactttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgacgttagtagtactgtctccttttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctgccactgctgttattgtgggctacttgttaatacacccctattgttgctgcccctgtggagtatctttgcccctgttgctgctgcccaatgtgttccttgttaaatggccagtgatgaattgctcaataagaacaaattatctacacttgttctttttttatgcataagaacagattttctgcacttgctcttttttctggattgataagaggagactatatacacttgttttctgtcattctttgatgatttatatacccttgctgctgctgcccaatgtgttccttattaaatggccagtgatgaattgctcaataagaacatattatctacacttgttcatttttttgcccctacacttgttcatttatatacccatgctgttgatacccctgtggcatatatactcctcctgctgctgttttatgtcaatcatgcaaattctgtacccttgctgctgctgttttttaaatttgcatgattgattcagtggttatatacctctacacttgttctttttttatgcataagaacatattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcatgaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtttgggaggaattctgctctctcaagaccacccaagagtttagggaatcaagcgaggcacatcgcctactgcaacagcggaatgagcacccgcatcggctgggcaccgcaggatacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcatataaacgactatcttcttttctagttgggcttggttactgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagatcccaatacaggaaacggaaagtctccaaggaagagagggacgctcgtttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttatagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttcttaaatgctactccttgtaagtgcataccttctatacttgtgatatgactggactatatctcctaattaaattagttctaatacgtacatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcatgcgacattggattctcctagtcatcgtacctaagtggagtcgggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaaccccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttccttattgacaagttgtgcaggtcgatgacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattggggggtgatgtatctgtgatggatctgtgactggaatatatctgtgatgtttctatttttcagagggcatggctagcaaatcctgaggctagccaatatttagcatttattttttttctggaattaactcatcagtgacgggtcggaacaaaaatccgtcaaaggtaacataacctgtgacggactagcaaataaaggcccgtcagaggtgacctacctgtgacgggcctttacttttggggccgtcacaggtagatcacctgtgacagcttctaactacggagacctcaacctctgacggcctttatttaaagggccgtcagagatgagtcacttgtgacgggtcctaactcgctcaaggctagcggagaccaacacctctgacggccttctagtaacttgcccgtcagaggtgggtgtcacctgtgacggccggccacccgtcaaaactcaccagtgaccactgatcactgaccatgcgcgaagccgtcaaagatgagggtttgggcccgtcacaggtgaccttggccagtgtagtgatacatgattagcctatgtgatgctacattaaacatatgctaattatggattaattaaacttttaaaaaatatttagcaaattatctctcatttatgcaattagttttgtaagtggtctatgtttaatattccgaattagtatccaaacattcgatgtgacagggactacctcatgactccatctccctggatccatatgacatatattaggtcgtccactcttctagagtttctagttaaaaaggtctactccactgtcttaaagaaaaatcttctaaatttagacatagtctatatatatagatttatagttgtaagttcgttttttctgataacgaagatgtacatcgttagcatatagtagcaaatccagcacgttacaacgacagtgcaaactcctctcctctggcctttactcctacacaagaaccaaaagagcaagagagaggaccttgcaaggcagccaagcatccatgcagtgctgctgacctgcccgtacaaaaaacaccaagaaaccttttgaatcgacgatggccctgttgccgtagccagcaacaagcgatgacactttggatagggacaatgacacaaaagggcccgtctagaacaaaaccaaagaagaaacaggggaacatgaggagcacagggaatgatgaagcttgctccctatcccccccccctcccaagtcccaagagcttgagcttcaatacttcagaatcacctcccgagggacaccgggcaaagcgagagaccacttcttttccataaacaaagcaaaggaaaagaaaagggggacagaatgacagtctgataaacagatcccacatatcaataacacattttcattttttaataatgaaaatagattatatctttgatttttatcataagacacacaaccgtaagtttgctaaaaaaagggtaaagataaaaataaatcaaaataagagatgaggtgatgggataaatcctcaactcccctttattattgactagcgttaaaccacatagattttttttaagctagcaattttaatggaactacgtcgcttatagtggaataagaaatcttaactactgatttcaagagtgtagttacactgtgcataatatcctgctgctcctgtggtagcaatgtagatcaaaagtgaagctaatatgaagataacatgcataaggttagataattatttaccattaaaaactttatcattacaacaacaccaaattgactaacatacaacatattttcatgagttcatataagaacaacaatggtttccttaaaaacccttcataaccacgggtcacatcaaaggttttattagttcgatttatttatacgccttacttaggattcatagttttttttaagctactggctgctgatttatcacgaaaatgtgttaaaccgtgtatttttcttaaacagtatgtttacttaatataactcatctcatttttacgttaaataagcttaaagcccaaacctcatattcgaccgcagccatacatcaccgtgggcagcttgaaaacaaaaccggcctatgagtatgacattccacacaaatctcttaattagagcatgtacaatagcaggctataagccagctataaccacatatcaagaagaaagcggactacagatttgtagttagctgtaacacgaacttcaaaacgttatatgtgtatgagatgtgggaccggatattaatggtgtagcatgattttatagctaactattgtatgaatgggctattagattaactatagataatttggagccaatggttagctatatactattaaggtggtgtttagttagagggattaaagtggggctaaactttagtccctctcaaaaaaatataagtccctatataagtccctaccaaggacttatatttttgtgagagggactaaatttagtcccaagttcccaaacaacccctaaacttgctagtaagggggtgtttagatggggttaaaactttttagtccatgtcacatcggatgtttggacgctaatttggagtattaaacatagactaataaaaaaaactaatttcataaatgagagctaatccgcaagacaaattttttaagcctaatttatctataattatgaaaagtttactgtagcatcacattgtcaaataatggcgtaattagactcaaaagattcgtctcgcgaattagtccttagttataaaataggttttataattagtatatgtttaatactctaaattagtgtctaaacatccaatgtgacatgtactaacaggcccttactctttacgagtattttttttcccatgggcaaaaggatccatgtgcacgagcgcagcagcgagatgtacgtgttccaggaaggaagagtccaaacacgtacgtacgcctcgaaactaaacctaatttggcacggtgcacgcagcgaccccaatgccctccctccaaagtccaatcgaactcgccaagtggacgtctaccagtacgtgtaggagtacatccattgcaagccaagccaagcaaaccaaaacaaagcttgttgcaaaaggagaatcaaacaacagcccaaaattatagattggttcaacttaaaaaccctgttttcaaaattctttttgagaagggtactttttcactcgacctctagattcaacctgctaatgcaaccatttaaattggaaacttagcccctcaaacaactcaatatgaaattcgcttctttggagatttgaattcaaaccttaaggtactactcaagtcactgtaaccaatagactgcaaccttattttcaaatatgtgacagtgttaacttttctgcaagacacttgaccattcaaattagtttgttattatttgtttttatcaataatataatctaagaataacttatagttttacatatgttcactgaatttttgataaaaggaattgtcaaataattatgtttaaatgtcgatcatgccatatagtactagatattactacgtagtgtaaagataagacatcctttatctcaagatatactaagtaaggctcccatcggatggtctattcagtcaaagaaaaagccaaaatttgaattttcaaacttaattttgacattgattttgagatattttcaacgtagtttctttttcagcattggcttttaagtcaccaagaacacatatataaaagttttatctacaaattcatttgtattctctaataagtcgttttggcttattacgaaaaaagccaaacgataaggccccctttgaatcgcagggtagaaaaaacggaggaataggaaaaacacaggattctgatgggaattgaagtgtaaaacagaggattgcaaaacacagaaaaaatacaggaattgtcatttgattggagcgcaggaaaaataaaggaatcggatgagagagatagactcaaaggaaattttccaagaggttggagctcttgctaaattttctccaaaatctacatgcaatgtgccattccataggaatttcataggatttgaaaagcttcaatcctttgaatcaaagggccaaatagaaaaatttcttataggatttgaatcctatgaaattcctacataaatcttttgattcaaaggggccctaagaccttaaatcagtataagatatgatagatcccagtactaacagtccaaacaagttactagcagcgctggagtatcacattcgtactaaaagtttggaacggaaaaagatttttggaacgggaatttttttaaaaaaaacgtggattcgaaactttgaattttaaaccgtgccagatggcctcgaacgccacgccggcgcacgtggctgatcgatcgtcgccacgtcgctggaactactcgagcttgatcatcacacagcattttgggtttaaaagaattttttgaggcgaattgtgcgagatgctgtcgtaccatgaaaatccgtttattaatggccaagttgtaagcaagagtcaacttgttaacaatattatggaccggaacaacttgttaatttaggtttaattcattcacacctctacacattacctcaaaagaaaacagaacaacgttgatatgctgtccgtcaacttgattacttgagggctgtgattcggagtatcaagttgacaaaattttcctctaaccggcaggccaggttgacaccaatatgaattggtttttatttaatatcataaaaaaatggctagtgaagattgggatgttgtttggtttgattccaacaaagtcaatgtgagaataatatgtagtggtagtacgtttgtggaagaaaaaatggtaataaggctagattttaattacctttgctcaattacgcatggagagtgtttcacttaaaaagaagaacttgaagaataagggtgtgtttagttcacgtcaaaattgaaaatttggttgaaattgaaacgatgtgacagaaaaattggaagtttgcgtatgtaggaaagttttgatgtgataaaaaagttggaagtttgaagaaaaaatttggatctaaacttggcctaagcctaaattaatcctaagactaaattctagttttaggtaccaaaatttataggatgtatgtctttatctctgagaccgaagatgtaaatcatttctattatcttagaaaaataaatatccgaattatcaaacgagcaggcccaacataatagaactacaatcgacatcgacttgctcttacattttgtaatcctggagtgaccatgatggtcccagacgtcacgaagactttggaacacaccttgagtagaccaaagtcttgttcattaaggatgagctaatgtgatattccaactagtagactggtgtggttagtaggcagagatatccattatgaagcatgcaatttgctctaattaatgaattccacttgccacctttgtcaaagcctcaaaagggagaaattttgcataccaaaatacttctacattttgcataaattcatcagtgcaaaatgcagaaatctctgcacaaagttcagtttccgggggctgaatttaaactgaacataaaacgcagaaattcttttctccctttcagagcaatataaaaatgtgcaaagatccaatcagaggatgatcctgaaaaaaaaaatttagccaagaacaaaacaagcgtcggcataacaaaaattcattgcaaaaatatgaaccatttgtgccggcacaatcatatccacatgcagcattattatgcaaaggaataatgtactcagtagtatctcttctccaagcagagagcatcttcttctgcatctcatcatcatcatctgcttgtgtttgtgccggccggctgcagagtgtaggcagtgctcaactgcataaccatacttaattatgcatactaattatattatatatgtagtgctaattaattaatcataattaaactatagtacataatatcaatcactcacacttacaaaaacaggttattggcttaattacatgtaattaacagccatcatcatcatcatcatgatcacaagcaccccaaaggttaaacaaaaaagttacaaaaggtaaaaaaaaaaagaaaagtaaaaaaaggagggtaaaaaagagaggagaaaattaaaagttatttggatctctagctaaggtgaaagaaaggcttccatggctcaatgcaccttcttggagaagaaccccttgatgccgaagagcccgccgccgccgccgccgccggcggaggcgcgggcgactccggcgtcggcgcggcggcagctcacctggtggcggtacccgatgcaggagttgatgctcaggttgatgccgcgtatcccgccgccgccggtggcggaggtggtgtggggtttcttggcgccgccggttggcttgtccttgtggtgcggcggcctcctgtccgcggcggcgtgcttcgccgccggcgatggcgggcgcctgatctgccagaccgggctagaccggcccaccggcacgccgccgcctgcgcggccggggctggcggcccagcggcgaggaggaggaggaagggacgacgccaccgccgccgcctcgccgcgggagttgctgcgggagcacggggcgctactggccttccgcggcggcgggcggggcttcgacgaccccacgccgcccccgccggcggagcggctccgggagaacggccagatgttaatgttcagctccgatccgcctccgcctcccgccggtctccgccgcctcgtcggctgatccttctccttctcctccgccgccggctgctgctgcttcttggcgaatatatccgtccaccttttcgacccaccaccaccaccacccgacgccgccaccgcagcagtgggcggcgccctggacgcgacggccgcaccaggctgcacctcctcctcctcctcgtcctcatcatcatcatcatccgcgacggcgagggacatggagaggtcggcgtcgcggcgggggtaggggaggggttggagggggaggaggacgccgccggagaagagctcgtcggcgcaggagggggatgcggcggggtcggcgtcgaggggccagaagcggaactccggggaggcgctgctgctccgccgcctctgcgctgctgcggccatctcggatcggcgtggagactgcttcttggagatggaggagagatggttgggggggaatggcgaggctttgtatggcgtggcgtgcggggagggagggacacatggggaggtgggacccgcgcacgccctcccatttttctgatgcagttatgagaggtgggggtgtgggacccaccgggaagtggctctgtgggtggggtagagggaggggaagcgtgagggcattttggggaactttattaaggactcgttcgattttcatgcatgcttaggaagaaatatttccacttcatgtaaaaatgaagaagtttattaacatataattaattaattaagtgttagttatgaaaatatatttatttattttttcttaaacaacttctatatggatttttttaaaaaaaattacacagtttaacagtttgggaaggtgaagttgaagttgggctagtactactttaaaagaaagttgaaataaagttacacaaaaggaacaaaatagcaaatagtgctctttgtttttaaggccgagtttagttcaaaaattttacttcaaacttctaactttttaatcacatcaaaactttcctacacacaaacttttaacttttccgtcatatcgttccattttcaaccaaactttaaattttagcgtgaactaaacacaccctaactaacattgtcaggattcactttaggtaagtgtggcatgttatattttttaggcctataaattacaagctatacttgtatacttgtggtagagttaggtaaataattaagtttatgatacgtgaggctaggtgctcagaacgtatggcaagccatcaaatacaacgctaaggaggtgtggcaatctaaaatgtggtgtcacaagttgaagaagtgaacacaaggcttctgctctgttttttattaagatatagattttattttggtttttttaccattttttaaactacaaaactgtgtactttgtgtgaaaacattttatgtaacaattactaaactatcatataaatctatttttatgtttaatataattaaaacttaattacactaatgcgtgtttaatctttcatctctggtaaactcaagcagcgatattgatagtcatggtttcacttacctactcgactgcactaagcggcggttggccatcactcgaaagtttaaccaattcgtgtcgttgaaaatgtctgattaaggatctacgaggggctgaacatattgtggtcattatcagcatgtcttaccagtaattaaatcccatgaaattaacattaatatcatatcatccacctctatctccggtaccatgtccacggagtatacggtgtatacttgctaccactggtggagaaatcatatttggtcggtcgactaaatttcacaatagtctcggttgcaataaaaccgggactaaagatcatttttagttccggttaaaaaaattttgatctttagtcccggttggtaacaccaaccgggaataaagatcatttttagtcccggttcaaagaggttggtgggtcgagtcaggctccaattatctttagtcccggttggtataaacaattgagactaacgatctactaggaccaaaataaactgccgagccgtgcgccgatcttatctactcggtatcccctccccctttcttctctccttcattaagactcggtatcccctcccccttccttctctcgatcagagagaggcctccttcccttcctcccccttcccctctcctcctctttcccgcctcctcctcctcctccccctctctgtggcgaccgggcggcggtggcggagcgagccggccgcgcgacaggcggccgtgcggcgaacggggtgcggcagccggtcgggcggcggcggccgcgtggcaggcgaccgtgcggcggacgggtggcggcggcggccagtggggccacgcccagcagcggcgggcaggcggcgggtggccggcggggccgcaggtggcggctgtggtgggcggcggcaaaggcagcccgcgttgttttctttttttattaatttgtgattcactaagatgtacttttgtatggataattctgtgatttattgcacatttgtatggatctgtgatgtatttcatttgtttgtattttttaggatttgtgatgtatttgatttgtgtgtataagtaactttaagatttgtgatgtagatttaggatgttactttgatttggggtatgtatccaggagaaaataaaaaagaaagaaaaagaaaagggaaccatctgactgccgctaccctctctttagtcccggttggtgactaaatatctctctctttagtctcggttggtgttaccatccgggactaaagatcgatctttagtctcgggtatttgaatcgggactaaagatagcgatctttagtcccgtattcttactctcggttggctatagaggattaccaatcgggagtaaaaagggtttctccatcagtgtacagttcacgcttttttttagtaacgaataatgtagcctgccatgcatgcatatagggtgtgcttggttgcttgtattcccggagtacgtctggctcatttctcttatccaggttgatcagtttatcctggtttaacgtatacatatgcaagtgtttagttgtagcacagggctgatggaatggttgtatgtaggagatgtttggttggatagatatctattcttgtgagtggtgaagttaccatataaagtttgtggagcgagatttttttcaagtccctaaatctgtttatgggtgataaggttaatccacaatagatgttatagattaaattgtgttactctgggtctatgcccacctactaatatttttgagctcatgtttctgttagagaatcgatgtactacgtatgtatgttttactaagttgctccggtccataatggaatggcctggcttactagatcaaaatgcaagagagtgattattatagcaaaaatcatgtacataatttcatcggcgacactggtatatttgacaattcaaaaaagcatacaaatatacgtgctcatggcaagtcatttttttaccggatattgattacaaccgggacctatagcataggtgccgatttttaccagcggccgacattaattttgttggtgggcattggcggaagggtaataggtgccggttttgaattaagaccgatacaaatactcatctctcagctggattttggcgaaaaacgtttaataggtcccggattttgtccaaccggcatctttaaagccggtccttatacattttttttaaagtagtgtaaccacatatacaaaactaaaccactggtttggaacaaatgccgaggagagaagggacggtggtgaccccatccacgggttctgcacgcgtgggtgcaaacagtgcacctgtgagtgcagcctcacagcatgagacgaggtaggctgagttgcgaaggttgattcgaccatttcctctcagcctggctccatgggtctttttttgcatccatcgggtctggctctaagatagttgcacacaaccaaacaggcacaaatctaatctgctggctaggtgcgagccaggtgcataccgggcaatcaaacacacccatatactctttccattctataaaaaacaaacctaggatgagatgtgacttcctccatcccaaataaaaacaaatctagtacgagatgtgacacatccttatacaatgattgtaacaatatcaagtaaaaaaatcaaactaaaatttaaaattttaacaaattttggtcgaatttcaccgtagtcaacggctttcatgaaaaccaaaaaacctcaggagtggttttcagaaacgattcagatttatgaaccctgtacgttatatcttctttgaaccttttttttgatgatagtattacagatcgctgatgagaaatttgacatagcactgtcagtagaaactatatataaatatgccacagatcgcagtgcttgtgaattattgttagtttctttcatcggcataaattcccataggcacgcacggattttagttttatgtcgaaacaataggacactgacaacatacggatccgtttaattgtctgaatgtcttatcaatttcaccataactggttttagatatgcacgactttattagtgaaggtcagtataaccaatcaacaacgctttctttcaaaagaaacatatatatactgtagctttgaaaacggggtgtttcaactaaagcatgagagcagattagagaaactaaaaagttttcaaccctttgtggggaactctcatggatgtaatggatagagaatacacgagtatattccttaatatgcacctagaaaaagttgtactctaaactttctatggtttactcaaaacttatgccctacaaacttgacaacaattgatggtattagatgagctaccaactggtctattgttacctaagttggtcctgggtcctggcctatatgtgcaacatgtgcctaggtaccccagtttgtctctccatgatactaatgaatgtggaatatcttttagtacattaatctacctagctccacctcatgcattcttggtgaaatatatattgtgaaacccatatttcattctcggtacggtgccctcagtcacgctccactactacaaaatatcaaatagatgctggcattatatgtgccagagtaggtaaaaccagcacctatagcgcctttctccgtacatgagcccgtcagcccgccgaaatccaaagaaccgtcacctttattctcaatagatgccggtttttaaaaagaaccgacacctattactggtgtcagagaaagatgtcgggttttattgaaaatccggtaccttgtagtatccatcccatcagagtagttggcgcggggcccaccaaaaaacgagcatctttgttgtaaaaggaatatgtgtcagttttttttttaaaaaaagggcacccagtaataccgagctgagccacacgggaagccattcttgtccatccatccaccatccagagtcaacagagtcacgttcttatctctcatctctctctcgaactcgtctcttcgcctctttcctccgcctcctctctcgcctcgtcctccccggtggttgcagtaggtggcggcggcagcggcaggagacggcggtagcaggcggcgatgggaggagaggcagtatcggcgggcggcacactcccctcagccagatccagcgggaggggagacagcgataccggcagcagcgggaggagctaaaggcggcatcggcgggcggcgccctcccctccgccagatccggcgggaggcagcggcagcggcgtcggcgggaggtggcggtggcgtcggcgggaggtggcggcagcgggcgacggcaggaagagaggtgatagtggcgggcggcgccctcccttccgccagatctgacgggaggggaggtagcggcggtgccccacgagtgttttcttgttcttgttcttgttcttgttcttgttgtcgttttctccctacttcccgctctccctcgccatcctctctcgccctcctctctctcgctgatctcgccatcggcgattgtctaccatcagtagggcctctcggcggcttggcagaacggcagcagtggcctctccttcctctcctttgattgattgtgaataaatttgtttgatgttaatgtatgatttgtgattatctatatgaacaagaacttatctcattttcttttagatttttcgattattttttttggcttggaggcatcggctcgaattgagccgagctgtaacatcctcaaattttaaactaaaatttgactgcatcatgctggcttttgattaaattagtgtgttttttaaaaaaatctatttgattcttaaattggttcaagtattacttctttagaaccctactaacttactctaattatttcctttattccaaaccttagtaaatttgagcaaattctctcaaatttcaaattataaattatttctttagtctaccttaatattagtgaggatttgctacacttcaaaccctagtgaaatattcaaaattcctgaaaaacactgttcattgccttcaaggtgtttgacagaatgcctagcccaactaacttagcccaatccccacccaatcttgtgcaaagtctagaattgatcctaggggaccacatcccactcaaaaaccatggtttagttggccttctcctccccttgcgcgcaccgtcctggcgtccgactttgccacgcgccgagccgtcgcgcgtcggtctccggattgatcacgcgtgcccgaccgccttggcgcgctgtcgcctgtccgacgccctcagaccgtcgtcgccgcaccaatcttgacgacgacaaagccgggacgacgactgccgcatgaaatcactgctcgacgccatgcgcgcccgtccaaagccgccgtcgagtgcaatttcgcttctacccggggtgaatcacgccaattcttgccgcacggttggattgaagatatacggtggtatcccctctcacaattcaaaccattcactccctagtcggccgttttcaccctcgccgccgccgcgcgtcgcgcctggattggcgccaacacgtcgccagccgaattcgcacacggtcaagccaatccttcgacggtaagtattcaaacgtggcctcctgccactcaaattgatcttggccgccctctcacaacctctgccgccccagccctatccaaagattgagctcatccatggcgatgacagtgcccgagctcatccactccttctaaccctataaataggaccccaatcccttgcttgttcatcatcgatcatcaacaaccataaccccacaactccgaagctatgcttccccaaacattccttcaaccactctcgcccatcggtcgaacaccttgtgcgcgatcgactccacacccctccatccatcctccgccctaaatatcccttagagcacctatatcctaccatgttctagcatactaagtcctaaccaaagccctacatcaagttttacctcaccacatcaagccgagcactgccgccctcgcgctgctctgttcttcgccgccgagaagtttttccggccgcaatttgtcatttcaaccgatctcggtgagttcttccgtttcaaccatctacatactacatagattccattttaacaatccttttgcactatcatgccaccccctgagctgccgacgtgagcacggccgccgccaatggaggcgctcgtcggcaactattctccgtgccttgccaaaggtcggcaagctatcggaatccatctaggcactctatagatgctctagaacccctcccctagccatgtctaactcatatcatcttgatcaccatcacggcctagccgtgccaccgccgccctagccgccaacccatccacacatcaaattaatctctccgccgccgctcgccgtagccagagaaccctagctccctcccctctttggccgcaaccacttttcccctccatcaccgccgtaatcgccaaccctagcaccgctggccgcttttggggaacggctagaggtagaagaagagaagagagagagagagagagagagagagagagagagagagagagagagagactgacaggtgggacccgcacacagtaacatttcacttttatttgattttcaaactttagaagcccatatcttttaaaatatagacccaattccagtgaaacttggaccaatattcttctaaaatcattctctatcttttgatcccctttttgctatttttgcattttattttattttctctatttttcatatttttggattttatttgaattccttttgaatttgaattttatatatgtctaaccctaggtcttgaggattcttctgacttaatagataatatcaatcaatctcaggacatcgagcaaggcaagttaccataaaccttttgatcatttaagcctatattttacaaattatttatttatagccttctattcaatattctattttatatgcataaatcaatcatagaaacccagataatttagtattgcttactttgcttacaatttggttaaaataccttatacttagattgggacagtacgtaagatttggttgatttccgggtggctagtactatctcaatcgatataagttttaccaggtacttatgtcgaacgaacgagtacgccgcagtttctagaatggggacagacctagttattatgttaatcagcaatatggctcctctgtatagtggttcatatttttaagtcctcgcgcaggaggcaacaatagccgcgaagggcaactttaaccattaccatgtataggtaaatggtttgtgatactcgagtataaattatatggtatatttctaaaccctgatcgagatgacgtggtgtcatacgatcagttccccttaaatacctcgggaacgccaaaactcctcttgctgctgttaacaatacgttcagagcatatgaggatataagttcatggaacaggtgccacaattgttaatgacttaatactgggccatgactaaaaccgatgattatcagcaagtcgtggattgcgggtaaagcgtacatctgctggagtagaatatctttgaaactattcgaatagctgtactcatggagttgagtaccgggactcatgtggtaccctggttagaaatctaaagtctatatgttttataaatttttgctataactctttcagattgtttattactgctttttgcaaagaaccctactatatgttaatgcataacatatttccatgataacttgctaagtattgtgaatactcatccttgctcttataacctctttttcagatttgggtcaagaggatgacccttatgactattactacgatgaccccgataacttagagaatccctaaaggttatacctcccagttagaatgtatagaaacttccgctgtgtattaattagttaggtgagtacctattaatgtaaaacccttagtattgtaaaactttaacatatgcaatgaagaaccagatatattgtatgtatcaatatttactgatccagggattgatacattaatcatagtcggatccaagttgttagttcccggctccgacacgagccaagccgtattttttttcttgcgatccatacaactcaaaggtgccggtttttgaaccggcaccattgacaatactcataagtgccgcctgcgaggtgccggttgtcaaatccggcacctatgtagggctggcaaccggcaccaaaagggttttctatagtagtgctcgtatgtatacaaacctttacatagagagacaggggtagagat

SEQ ID NO: 76007 - DNA, 20962 bp, Oryza sativa
ggcgcggaagcgtgctccgtcgacgggtgccggtcggacctcagccggtgccgcgactaccaccgccgccacaaggtctgcgaggcccaccccaagacgccggtggtcgtcgtcgccggccaggagcagcgcttctgccagcaatgcagccggtaatcacacccccaaatcctctaaatccatccactttatgtgatccattaatcaagaaacgatcgatgatgtgctctcgatcgatgagggtcatttgttaatagtttttcacctgctttatttgctgcccccaatttggttcctcatcggggaactgtagctatggggatttggtgcttactttggtggtgcattctctgacgattttgggggggagaaagggaaaaaagaaatttaggtggtctgcttgggtccccaaggcctagctgtctaaacaattgagttggtaatttgttaccagttaggatctgatggctcccgggattatttaatctcacctatgctatttgtcgaggattaaacaattgggttggtaatttggtggcctttagggctctgatgtcgcggataatttaatctcaccgggatactattttaagaaggctgttggtgtgggcagatgacatgctttgcttgcttgtgtagggttttttgttttcttcctgtattattccgcaactcatcgccgaatctttcttatgattgacggggtggagcgggtgttgaaattggcttcatgcttagagaccatgcaaattaagttttggttcttcaaactgggttgtgtttcagtgagactgaacaggaagcagtttcagttcacaagatctggatgaaactagttaaggtctagtattgtatagtagtgttgttcagtgggtactcccgttagcgttcgggttatttcatgggttactcgctagagcgtgggcatgcaaaaccgaaagctgttacctttggttgtgttatactctctcctccctgattctcagtttctttgctgtgtttagcgtagtaaactattctggagtttcatgacagtaggagaaaacaaatagctgaacatatttttgggtggattatatggtttctaaaaatatttggagttctattacaggcgtgtatctgactgaaagtggtacgagaaagtaaaacgtagtatcatttagtgaaatcttgactgaactgttaaccatttgactgcatcataactgagttggagaggttcagacatccagtttaatatgcactgatgatttccgctttgttctcagataataattctttaacagtttttcaaactagactcttgtgtgaataaacagtgattattatcttcttaggccatataatttctcaactactaaattaagcaatgacatagaatgataactccacttctgtatcaaaagagatcttgtgatattttatatcagaattcagaatatgacaatactcttctaactcaagattcatctcattgtaaaaataagcgcagtaaggttttgattgtgctgaataggattgttgctcaagccaaataggtcctctattctattcggactttcctagatattaccatctcatctcccacacaacaattctattttccaattggtgggatgtgctaattccaagagcttgatcaggttcaaagcttggggaaacaggctaacaaactcaattttgagataataaagatccaattgtcatttccattccatgttgcgatcccctcatccttcttccatcattaccaaacctcaagagaatgcaaaatacattatcattgtgtatatagttggttgaggacaacaattataatcatttttacttatactgcaaaattggttttccactcatcttgttcaattcctggaacctacaaatgatcattactttatgggtttattttacctcttacatgtctcatccaattaggctgtgtacatattgcattctcatgtatgataccagaatatatctgttctagctggctgtattttgggtgttctatgatctgtgcttgacagtatagttactgagagaatcaccacagttgagtcatcttgtttattttctgggtataactaagaaacatcttgtttgttaaatcaaatttctggcatgcatctacaatatttatgtctttgtttctctggttcaatcttgttggtctacagttactgaagacgccaggagataactctagttgagtaatcctgtttacaaattctcctgtcatatttgaagtgtcgttatatcccttgtagtctagaatagataagtcatgctgattgatcaaagcatccttcaatgacacattaggaaggaagaaatcatgccataaccttgatctcctaattattcattcctgtatgacactggttagtaagataacaccgaattggagcaatggatggcacagtacaaactgcagagacctcatagtaacccaatggaaaatctgataattgttgtcatcctctttttactggcatattgtcagactcatcagtaagaaaaaagaattatttacctcagtgatctgttgtgctcaacctttgtgcataaccacaccttatctgtatttgagttagcagaaatttatcatgtctatgaaggtgaccttgcattagaataaagtattaatcttagacaatctagagatgtaatcaaactaatcttatatgcaattccatcctcccaactataagaagatgccgtacttgtccatttccttctgttaaaaccatcagcatgttgtctttgcttactgtggtttctgttagcacgaccatcagagctttaagaagatagcacatctgtcctctgtattttgtttttaaaaatcattgcacctacatttgtattgttcttcttggtatacccaaatcatttgattttaatgacactatgaccaatttatcgccccaccatgggcatttagaaaaagggcattaagccggtaactagtctagtcaagttgccatgctacctcctagttgactagccaatgacaattatcaactaactgaccactcatcggttgcttcgattacttgctgccttaagctacgttttttttggatgtttttctggagctgcaaaaactcgaattcttgtgaaaagctgaaaactcctttcaagatttcaaaccaaactttgaatcttaccatttgaaatcaaggataaaaaggttatcaactatactatgagcaaatgagtcttgttaccttttgaaatcaactataaaaatgtttacttcaatttccatatgagtaaggtgcttgtttccactttattttaaccttcctggcctgcttgtcaatatggaattagaaaaaaggagcgtccaatgttgagacaaaggatcgtgcacatgagaacttgcaaacagttcactatgaaagctcctgtaatttgttcttaaagactactatcacttgcgtactatgatatagaagattagaacatggcaaaagttcaggtaagtagactaatgtgatggcccaaagaacaaaaagagaaatggaggagcagactaactaggaggtgaagttcctcctcatatattaccatctccatcgagagcccattcaatggtccttgttgtgtgtcttgacaaccctttgaagcttcctcttgagcttatggttgtgtcatttgctcacgctaatgttataaataccttttagatttctcaagatccaacctcctgattgtcactactctctcctcatcacaccatgttgcagcaattttgcagaagcaggatggaagtaaatgtcccctctgtttgagggtatggtataatctctaccaaagtatgaacaactcaacatctcaagttacattggtaatgaagcgtgtttaatcattgttagggaagagtttggtttactgctactactctctctaccatcaaatttatacttttctttttcacaaatccacatgtgcttaactagtagatcataaaataaatcaaaacaccatcgtcatccgcctttgctttctgatctggaatcctcatgataatctaaaaggcaccctatagtttctctcgtaaataggaaaaagagattggtctacaatgtttattttatggacctaacaaatggtgaatactagcatatatcgataataacattatattcatatgatacgcattacccaaaaaacaaaggaactctacttttaatataagggtatttgtatggcagacagctaaatatagctttgtagcacatgtgtagaagagtaagtttcacaaaactacatatacttctgcaaactatcatcaaactatagatttaagccacaatatcagaaaactatacattttaatgtcaaatatatatgccaatctagcacataatttaccacaaaaagtacatttgagagttccaccttaggatggttatctttgatggaacttttaaatctgcaactttgtaatgaaatcagttctaaatctgtagtttgtcaaaaaaaattttttttgaaaagggtatactttagcaatattgtggtttaattctgtaggtttttttttataaattcaattctaagtctacagttttgcaatacaacgttgtgataattttgacattgtatttgtagtttgtgaatttttctctttataaatgattatgactctttcttcaaataaatataatgtgtttgatgccaaggaatttcttttttctagttgtcgttatttgattcagctcccacacggaccagactcaaaaaaaggtacctttatttctttgggtttggtgagctcttactcttacgtgcatttatataggcaacaattgttataatgtgcgaagacatgaaaaggttagatttacataagaattgcaatgataaatttcatattaccttgtactccaactaatggtacccctgtcttttctctcatttagtttttttttttttattgagggggggggggggggttgggaatggggggcatataggacgacgaaacctcgataagaaatcgtgctgtgtttgggggcatggtatctcagagtagaagggagcatagaacaaggaattggaaccaagaacacagaaaacttgatcttgctgtcaagaacagacatacagaattttgctgaacagatgcaaagcttttaacaagaactttcaaagtcgataacatgagtctaccctaagtccctaatggtcaatggtcaacacacagtatggtggcttaattcatactgaaaactcagatcacatgttgggttaacactgataggacttggctgaaggctctacttgacttggacttgacacaaatactcatcttctattaatcagagcgacatagttaagctagtaatataaaagataaacaaccaagtaagcaaatggacttggtagataattgaaggtgtgttccatctaactaggagtctaggactgtttgtcgacctgagcccacaccatgtcttggagagacataaactaaggcagaattttccttggatatcctgggctgccagtcctaggcatgacattagcatcctgaaaagcagttctgaactccatattttttagcttgcatgatctttccttttatcttctagacgattgtttttcttattctttcctcttggatcccatatgtgcgtttgtgcttggcttaatatgaatacatggattcacaattgacacgtttagattgccaatttcatgcataaacatgtaagtttgatacactaattggcagtagccaagcagatctgcatatatacaatttaatgcatgtgaatccaaccagcccgtgtaagcgtgtcatgctgagatgcagcagccatgagcaccctctgcccctctggtgcacgcgaatcagccaaggtttttctgggctacaacaatatacttgacagcatgacattcatcaataacgctacccaatgcccaacttgaccttgagtagctaggaaactgtggttgctgtgcagagcacacatgagagccaatagtttgatatatgttgtcccagttaagtacaagatcaccaatctaattttaatgtggcatttaaagaaatgccactctaaagattgactttgaggatatgccacttcaagaatacatttttttttaaaaaaaatctgataccactttgtaacctacaacacaacaacatatgaggctcttcccattcactgaaactaaatttgaaatcaggtaaaccctgagagttcctaacttgctgtagttatttggcatgaccttttgtaacggtcttcaaaggtacttgcatctgtatttttgggcagcatagtcatgccctttttcttaccaatatgacaggcaaacaattatagataatttattcttctgttagttcaggaaatggcatcaaatacagatgcattgcttagagtgaagataaagcaacatttctgtctcccatattgacatgtaaatataaccagagatactaattataaccacacaagtttcaaagagacaaagacatcaccacagcctaacagaataaactatatcaactggtaaaaaagacttcagcagctagcaatttgtagactttcctgctacattgctctagcctcatgctctcagatgcaaccctccatcctttcctccctgatatatctacttgactagttcactcgttctttttctggaaaacagaccacatgttttttcagttatacgcatagaacattatcttgtgtacgatgaggcagctgcccctgtaccaaacacatgagccatacttgtccttagtgagaatgatccctctaataaaatattcttaattttcagtggcaattcaccatttcgaatgatcttgtatgaaaaagttgtcagcagaatttattaaaaaccagatatataaaatgaactgaaaacggtttatttggattcagattccatcttccaaccccctcattaaaaaagttgatgttggagcatcccaacagaaggtgctaccaggcattgtagtctccatttatcaacgggagaacaataaacgagaatagccacaggataaagtggtttccagctaaattacatggatctgttcgatatatttttaaatttcacattacatggtgattaaccttgcaaattcaatctttgttatcaatcaatattaggaactaattattgcgatcagatagaaccacaaagacatctgggccggtacaatttctactacattccatgagagcacacaatgtgacatttacaaagataaatattgtaaatgccgtaatatcaacactagagtgaacatgtatttcaaaatttggcaataattgcctgagaatttcaagcatagctcagagcaaagaagaaagtgaaactatttgcttccatgcttatcataattttcttgaacacaaaatctcatggtccgtgtctttattttgtccatctctctgatattggctttgtattattttgttcatctttctgatgttggctttatatatgaaattacacttagtagctttttgaaacaaattacacttgatatctggtgtgcattctaaagctaagattaactcctagtataactgaatttatattacctaccactggtttatacatcatggactagaggacaatcccaatcgaattgcagaactataagtagtcagttttatattttctacttttaactttagaattgaccacgaagtctatgctgctaatcagcagtgcactataagcatagtgattaagggacagtcagttaaaataatccatttctgttatgactactacttggctaaattttcttctgtgaatcctacatggcgtatgagaactatgcaaatacaactgttagtgtgaatttgaatctgcagtacaggttcagtgtacatgttctgaatatgttgagggccatgtaacaacaatacaacataactctgtatttgcagatttcacaatctggctgagtttgacgatgggaaaaaaagttgccggaaacggctggatggtcataacaggcgtcgaagaaagccacagcatgatgcattgaaccctaggagtttccttccgtatcatcaaggtttgtacattgcaactactgagttatatatgttgaaaaattgtagtgatccttttcctggctgtttcttgattacatttcgatactgtattaccgttactgtatgtagaattggttagctgttcattctctgtctgcagttataacaaactacatctttacctacttatattgtcacaggaaataatgtacatattatgtatcttttaggtctggcagaaaaaggcatgcttactgtgcttgaagaattgaacattgcttcgatatgcttgttaggttgttagaagctgaaaataatcgatgtcaaatggaacccaatcatgctcagtctttccccattagcttattagaaaatttctagtaaaccatagcacaataatactaagtcaagatgagtagatttcgatggacctctattaaactaagatttttctcatgttcattcactagagctatcaactttttcttgaattgcttgcacaagaaatgtatccaatatattctcttgactaaaactattttgtctttgcagcgaatcagttttcagtctacccgcaaacatttccgatagctgatcagaacgccgacgccttaatgcgtccgcttgatcgtcaccctcccttctccatctcattctcagggaccttccgggaaccgaagcagttcccctttatgcaagatggcgggagcggcctcggcgcagcgcgccacgatctcctgcggcccttctcttccccagaagatggagccaacattaccacaacccgcagcgcatgcaacggcgtcccccacgggctggacccggagtgtgctctctctcttctgtcatcgtcgctgcatccctcccccgctgccggcatctccagcgcaacagctccaccgcagttcgccccctcttctttcagcagaatcgccgcctcgtcgcaagccgtaaccaccgcattcgcatcagatggaggatcagttgccggtgaccatgtcttggttcctgctgtcacatatgaagatccttcccaagcaatgccattctcttggcaggtgtagagcagaggctgtgattttgctgttcctgcagagttgctggtgaaaatgactgaggctttttttttgattgtgtgagcctgcagaattcaggctggtgaaaattgtagataaataacagctcaggtcctctggttgatggtggtggtggtggtggtggttgtgcagattatttatcaactaattgtgccacgtcagtattcttctacatatctgtgattattgttcttgaggtgtacatatgtatgcattgtttagcatatctgtgattgttttggtcgagtcatcggagaaagaggcctctgtccctcatcttggacaccaggcgacattgttatcaatgggccgggttgtgggtggcctattttgcattgcaattgcatgtaggaactccttgcaggaaaaagtccacattgagtccctcaatataggttgaatctgattcttatccctgaagtgcaaaaccgggtatgataataacttccctaattgttaaaactggtagaaaaatgatttctagagtaatattgatgatggtattggctgatgtgatatgtaatatgtaatatgttaaccacgataaaaaaacgcttagaaatctaggaagatggggatattctacagagcctgcatgtcagtcgtatggggcccatatgtcatcctcactcttcctcctatctatcctttttcctctcgctcctcttctctacagcaataaggaccccaacagggccctcgatttagcgccgctgacgggttcgttagtcttatggatctttgtggtaacacctaatgcagttgcagtgcaaagctcgggtcaacttagttggcggctccagaaacctactccacacttcaaaatttcaaaacgccgaaaactcaatatacatatgcaaaattttcttaaataattcactaaaactaccttttctttttagtttaagaattaaaaagtacaacataaatagtctaataggtcatgtctatatagtggatttgggccagaaccacctcctagaacccacccattgtagttgagccttcttcccgaccccttgtacgacaatctccctacactgcgttgatcactcgccatatatatatatatatatatatatatatatatatatatatatatatatatatatatatatatatatatatatatatatagcatgtctcttttttcctgttagttaggaaagaaagccgatataaacagctccatattagcgaattgcctctgactactcttcccaggctggtcaaactataggattaccattcacttagtcaacttattggacagacgggtcaaccacttgaccgaggagagtaaggttcgtcaccacagtcccagccatacatataagaatccgactaatccgataaatatagcactagcacttcatcttccagcacctcatccactcggaccaaggactctctctatggctctagaagtcctgtcggctgacataagacggaacccccagtggtttgaaggcacgtagccacagtgtctaagattgagcagggggtacggtttcggaaatgacatattgaataggtctatatatatatatatatatatatatatatatatatcctggtgattaatcagatacaacaaaatggatttaattagtgttcttgcttgcagcgagatttgcaggagatgatggatagatcgatcttacggttcgtcaatgaaaggttgatgatggtgctccggccgctcatggtgttgtagaaccgcctgttgtcctagagggatcgaaatacccggttttgtggttgatggatacgaatcagacccgagagagtctaattggactttttccttccttgcatatggcgaggtgtattgacattgaaggcctagaaggcccaaattgtagtatgggcccagaagtgaaagcctggcccagtttagaaattgttgagggcaatttaagctggaaaacttggatggaacatataccgaagatcatgcagaatggtattgacatatctgtacaaaatactttcaaaatccctgaaaaaagattttcataatagagtgatttatatatctaactaacccgtcaacaacgagacgcgcttatgtagcttcgttaatcttaagatgtaatggtctagttaattcttggacatgcatatataagggtataggatgcatacacgcactcatatgggtgattgtgcacattggcgtctgcagttgtaatctatttcaaaaaataatattgttttcagccaagaattaatataaaaatgattcttaatcccggagggcatggagcgtgcaaaaataatcttgctatcaaaatacattcatttcttgagaggaattggtggctcgagttggccgttggtttcagctagagcaatgctaaccattggagattaacagtttaattaagcaagcaggaggttcaccaccgacatgagatcaacaaatcaaacgtggcagggccaatattaaattagagtagcagagaacagattggcatgcttctctgcaactcgatccgggtttgaattgatatgatggacattccaacaacttcatttctttagtttatggagtatgtctctttttgaaagagaaaaaaatattttgtgtccctacgttctcttctcaatcactggacgcctcagagtttatagaggatataatcatgagttttcgtattaattaatccccacatgccaattgtacgagtagccgttagatttcttaggaacaaccatacttaggctctgttcgtttcctgtagttcccaactcccccatcttattttccgcgcgcacgcttttcaaactgctaaacggtgtgttttttacaaaaagtttatatacaaaagttgcttaaaaaaattatattgatccatttttgaaaaaaaaattagcaaataattaattaatcatgtgctaatggactgtttcgtttttcgtaccggagggatgggttcccaacttaaccaaaagaacagagcctaagtataatttataagcaggggcggaggcaagatttcaccgagagtaggactgagctatgctgtttcaaaattttccactgagtttctatctaaattttggtattttgccattgaaattctttgccacgtgtggggcccaagcccaagctgcccccacacgtggctccgcccctgactgtaagtaattagttagccttctcaccgaaatcaaagccctcgctaggaagaaattccgttagcctcaagaaaaaaggggaagaagaaattctgtttgagaaaaattgtagggctggaattaccaaagcacaagaaagaacagtttcacccaaatttgaaaagaaaaaaaaactgaattttcaaataaatttaaacaaatcaaacgaaatttcaaatggaaaaaaattaccctagtaaccaatttttgtttcctcaaatgtgaaaccaaaattttaatatttgagtgaagttcaaaaattttgaagaattcataggtggatctgaaattaacagaatcacatataagaaaatggtatttttcaccggaatttttaataacaccttttgactgaattaatttaaaccaaatttgattaaatgaaaaccaccacatttttaagcaaattatacaaaagttcaaatttagttgttttttaagtatatgtcaaagtgggtaatttttacttcctttcaaaagaagttgacataactaaaattattttgttgctgtaattgtttttttttgtggggaggcttatcaattatagttactggcgagggcaatattacatttcaaaaaatatatatgtttggtacatagattaatgtataaaagcagcatttaaagatggaacaaaatttaactagggacacaggaagaattggacggaaaggcgacagggcgtaaggaagtttctctttgttaaaagtcaggcatccatgtcattcttttcgttgagatgtggacatagtagccacttcccctgctatatttgtatagtactcccttcgtccctaaatataagggattttggttgaatatgacataatttgtcatatccaaccaaaatcctttatatttagggacagagggagtagacaactatacatgcttgatgaagatatatctagtgcttgggcgatcccactctagtagtttaattaggccctataaataatggattaagattctgagaaacggttggttgatagttagttttttagaaaactaggtttcacagtttctgagtttaatttattctctagactctatattttatattttaagaatctgagtgaaaatcttgcattgtttgcgggagctgaagactttaagagaaattacagctgctagaagctctctcaaacagagaattagactcatttctgcgggatatcgcacttagtcatggagtaggtactactacaattacatcgaactaaggaacatactgtgaatggtgttatttcgcactttccatgcaagatgtgaatcatcaagaaagcgacggccaaaagcaaataaaacccaacaaagctaactttcttgcaacaaaacactgcttaattacgaaaagaaaattcatacttcaaagttcaaacctgtgactacgaaccaacaaacaaaagctaggccattgatcggtgctaatcaagcttatgtgtgcagcatattagcgcagtagctagactagctaggtttatgttctatacgtgttccacactgatacaattccaaattaatctcgtctgcagagtttggtagtagatgccatcccagcataatatactataaaatccatccatgtgtgtgcctgcagctagactcaattaaagaattaattccacattacaaaatttaagaacatttggatggtacaccatggtgtagtagtacatactgtactgtgctagctcgaacactgcatttcaaatgggctgagaaatagtgcaagtgaatggtaagtacaattcttaattaatttgtgctcaaggttgggtgaaacatcaacaccgggaatagtttctatatgcaagtttcgtacaatgttgattaaatacaagatgaaagaaagaaaaaaaaacatattctcatttgcccatcctccttggaaaaaaagttaaccccagctcaaaatataccatctatttccctcgaaatgcagaaggaaaattaaatccaaggtaaataaccaaattccagaaacctgaagcaaacattgaaaagagaaaacaaaaaaaaacaaatcagaataattaaccacatttttcatatgaacttatcatgagtaattaaccatcttaagctacaagctcaagtaagtttacattatataaactaaaactcagagaacagtagtaatcaaattgctagctagcccaaattaagaaaatcatatatatatataataccattcttgcataaatgctagtaattaatttagctgatcgatgaacatttcacatgccagagccagcatggtacctcctagctagctagctagctagccgaggtacatgtggacgttgacggcgaggaggaagatggcgatgagcgcgaagtagatgatggagtggacgaggatggagaggccgctggtctggaagttgccgaactccacgatcctccccttccccgggatctggaacagcagccccggcgacagcaggatgaacagcaccagccctatgaacaccggcccccaatccgccatcgatcgcctactctctctctagctacctacctttctctctctagttcttgatctctctctctctctctctctctctactgacagaagagaagaatgagttgtgatccttcttcacacggttgcagggaagatatgcagatgtgattcttgtactaagtaggtctctctctttcacacacacactcagcttggaagacttggagtctctctccttttgttgtggtaggaccaatggcagtggggagggggtgtatatatggccttttggagtgagggaataagtagaggagagggcaaatggggttgtggggatagcaaagggaggatgatcctctatggaagtttgtttgattggtcatggtgtgggtttgtttttgctcttggcaattgatggattgatggtgttggttttattttattagaggggtacggtggtgctatatgtatctcgcgcgcatgtgtttgttatgtatatatatatatatcgaatataataaaatacacttatatggatacgtcactatctttcattaaggttacacatgtacaatgttatctcgcatatatatatatatatatatatatatatatatatctaagattaattagtcgtgtaactaggacactctgttatgctttgctatgtgcgatattattcgtttttgtttaaatttacgtagtatatgtgccgttttagtttcgattgtggcattttagttgcatgaatcttacatacgtggaaagatggtggatcaatcgtgctattttgtcgtcttcaatatgggtactatcttgagtgattgatattggtagtttgtttgtcctgtcagtttgcaatcggatgtaacaatgcatcgactttcactttagttgttcccctctcgatcgagttatatgaactcttcataattcatcatttatgtgatgagtcttgtgtgtgaccactaaaagaagttgactacatctgtgtcagctatttcagattgtcagtcgtttgtactagagtttttaagtaaattattctagttcatctagtttttttaaaaaaattaaagttaagaggtatatattgacaaggctaatgcatttattgtattattatctacaaatattttagtagaatatccatcaatacacatgtccaatatttgctggttaaaatactaaggatattctaaaatcaatccatttgtcgaatgttagaaatcaatcagattttttctaccattacatttacatccaacggactacaaaagaaaataataaatacatatttacttacagattatttttatcaaaattatagtgcacttatatgttatattaactgaatttacaaatgtaattttagttatataggactgtagttttatattacaatgtaaatattattttatctatacagccaaattctcctccatgctcaattggctaagcgttgtacatggtaagcatccgatcgtgagattgaatcctaccaccccaaggtttggtggtaagctgcctcagtttttctggatgttgttagcatgaatctcaccataaattggagggttgaaaatcaagtgatttccaacgaaaaatctgttgacaaagatttagcaaaatcgaaaaaaaaaatcactactttgttgaactctctataaatatgaaataaaattaaggctttctaatcaaagacaagaacatataaagtacacatataacaaaacacacattctaattatcgtaccagttgatctacagtagcacagtactaaccactttgggtttatcaaccaattgatctgaacacaccaccaattaactactccttgagcacccaatcatattgagccatagaagatcacaacaaggtgatgtggaagggaaggtgatactcagtgctcaactgtagctatggctatagcagatggaatcaaaagcagttgatgacagattccaaacccagtcatatggtcaccaccccatcttcttcctctgccattccatgcaagcaacaaccatgtcttcttttttttttccccttttttttttcttcacacaagaccctgtggctacttgccctcgtcctcacgtgttgtcctctacctctcattggtgaaaagcatggaataaaggtttcagaaagagaagaaagaagggccaaaagaaactactcatggtataatggtggtttgattcaactctctgaagaaattttgcatttgcatgaggatggttgttgcagtgtctgtttcagtgctgagcctgcagatttggtcagatggtgcaagaggacaatgctgaacttaattgcctacatggtttgttaggctcctcgtgatgatcacaccgagtgtgtacgtgttagtttttggaatgtattagacaactaattaatgggattgcccttccatgccaggcagactggtagccacggcaaaatgggtcattaatcctatgagcattttgtgcatattctgctaattaatcccattaatgttgaattatatatgctctctttcataagtagtttggcttgctactttttgttagagaacacacatgggtcatgtttggtggccacaatttttggaccagggacgacgagacgtctagtttactgattcttattttaagcatatctaaacatatatagataatttgcatcatatcatgtctatcactttatgtatagtttattaggtcctcccttttcggtcgtttgtgggtgaaagaatatttatgtgttcacaagcttggtttggatctcatcaagtacctcttctttttctttttaaacgaagattagcacatgtaattcagtataacttggagtatacggtttttggatctattgctgcctaagtgaaagatgatggaatgagttccttttgtgtgaaaagactgaagaaacttgtacaggagaataaagcaagtggtagctttttttttttgtgaccttatcaaatgttttactccatgaatagatttatcaggacttctcctttcaactagattaattaatttccatttttttgaccttataaaatgttttactccatggatctgtttacctgggtttctatttcaaccagattaattaacttccatttttgaaagattatgaaaataactattgaagtaattttaagcgcatcgaaaataaggactaataattggtgcagacattccaggccaataggacgcattgtatacgaagctggctaggatgtctcaatatgcttaatcaaaacagatttctgttttttcttttttgcggtgaaaacagaattctgttggaatacctaaatttcacaaacaggaattcggattcaaaaaaagaaaattctgtaattgacaatagaccaacattatttcctttccttatgtaaatctaagttgcaaagtggggttgacaggatgaagcggacagcaaaatgcgcagctcaaacatacaaacatattggtaatacacattcttttgaagagaagattctcaagagctttacttagtgtagtaaaacaagcaccaattaataactgaaccacttttagtttgatttcaatagcaaaatgaagtttaatgaaagggataaccttgctagtcaacgacagactattgatctacatggaaatgacgaactagctagctagctctagatagtgatggcatacatccacaatcctgatcgagcaggggcccatacaattttcctcaaattatggtgaaacatgcagtgactttgtttctgcgcaatctcttataagcaactacctaaattaaaacttttaggtggtttattgtttttctccggcgtctgatagtttgtcaaaggttgctgataaaccaatgcaggtttgtgcgcgggtgctattggctcagttccagcttaaaagccttgatgatttcaaatgtcacaatttgatttttttagttacttttaggagcttctaatctgtcattatcctgatctcttttcatgattgcaacgaagacaatgtaaaaaaaaagtctacctgaaattattccaaagaatcaaatcttaaagttagcctccaaacctgagcccaatcatgcatcaagctcttcatctacaacaaaatagaaaaaagaacacttggatggaattgagacctgtgttctggtctccctaaaatatggtatgtgccttgtcatctcatgacaccaaacatgcaagtcatacacaaagcatgagagaaaataatttttgtgcaaataattcctttgcagctaacatacatggggaccaagtaggtgcaacagtatacagaagcttcctgcatgtgtgttaggtgcatgggctgcatcaacagtataattggccattgtccctgtgtgcttggggtgacaagctagaggtatggctttgaacggctacatatgcatatatataatatatatatgtatgatgttgaacagttgataattccagccaattatttgttgtttggatgcaagtttggggtttggtcctcatgtgcactgttttgcatctgtggaagatagctgcactctactgtgttgtggatataggatggaggagagctcactcattccaagaagggagaaatgggttggtgtgcttttcaatttacataacacatgttctttttagcttattcaccgtattattgaaataatgaaatttattagttgttggatccacactttctgaaatatgtttttttttaaaaaaaacaattttctctactatactattgtttagacgatttattttaagctattgttaagtttatttcttaaaatatctaattatctctataatcaaatcgatactttcctaaaataacctgctcaacaatctaggttaaacagggatatgctgagttggatactttttttttcttttttaactcatatactatggcatgctagatcatctctagatgtaaaaattccatggaaaacagttcagttttattgaaattaatagtgaaaaatggtcaatcatttcaaatggacattgggtcctagcaaaagtacatggttttctttggactgcaccaccactacagaagatacggatgattatgtcttcgaaaaacaaaacctattcagaagacttatgattgcacacccatgtacaaacatgtctttatacataatttattagttgtcttattgttttttctaaaggacacactgtgtgttaggagacgtattcgcggctgtacatttaagtatggtgttgcatatgtagccatgcgcatgtaattgaaaaacacttgaggcctaaactgatgtaattaaggccaggcccaacacatgacagtgggcttcttgggcgttgttcacttgggcccaaatacgcatcactctcccctaccacaggttataattgggcagggcaacgaattcctagcttaattaattctgcgattaataaataatccaactcattaatgataaacgagcaaatttaattggccagcgaactcggagacgcgcgaaccatcgcaatggccggccgccggtcgtcgccgccgcggcggacgatgtcgatgggtagcggctccctcccccgccgccccaccgccgcagccggcggcgctggctccatgcttcccgggctctcccggtcaatgtacgaagaagaatttggttgagtcgatcggcggcgcgaatgcatgcgacgttgttaattctcatggggcgccatggatttgacgcaggacgatgggcggcggcggcgtcggcggcgagcggacggtgaggcggctgcggctgtcgaaggcgctgacggtgccggagagcacgacggtgctggaggcgtgccggcggatggcggcgcgccgggccgacgccgcgctgctcaccgactccaacgccctcctctgcggcatcctcaccgacaaggtcacgcaccataattatttttggcaaaatttacgttcaatatatgagaaattactctactaggttaaaaaatcgagataccatgaaccgtgcaaaaaagaattaaaaaaattgcaatttataaaatttagaacaaatgtcacaaatctagaatgtcctagagcaaattttgtctaaattttcccattattgtgaaaaatacggtgccacgttttttcttacgtaattactttctctctatcatata

SEQ ID NO: 76008 - DNA, 4691 bp, Oryza sativa
cactacttcactcattcactcgcaagtcgcaaccctttttatttctctttgagctacattgctatggattatacacgctccgtggcttttttgtttccgtccgataccagcatcattgtaatcattttcagtcgcgagaaaaaaaacctgaatttatctctaaataatccaatactattcgacaatacgtaagacaaacagtacggtccgtttctaaatatcactcggattggtcgatggctatcggagccactttcacccaggatttataatcccaatagctacgaatgactcgaaatatatccagatttattggatcaagttcaagataccaaccaccccgtttttcggtttttgtcaagttcaaaagaacccaaactgaaatttagttttttctttgtcaagatttgttataattttatcggtttatgggcggtttttgatctggtatcagaagtgtgaacccctacgcatgggcagacaaacggggtggagcgctacgaattgccgtcgagtaaaaccatcgtctctcgtaccgtgcgcgacgacggagatcagggcggacggcagctgccttgcaatgcggatcgatcggaaagtgggtgctgctggctgctgcgtggatgcaatgatagagggaagagcgtcagcgtcccagcttttcggtcgcagtcgcaggctcgcagcagcggcagccgggcaggtcgcgaggcgagagagagcacatgcgtgcgcccgtgccggtggcgtcgtcctcctcgccgcgctaccttttttcttcgcggagatgggaggggagggatagctagctaggcgacaggcggaatattagcccactgttcgtgcgcctctcgcgcactcgcggaccagcgagcgggggcacacatgcgtccgtggccgagagagattgagatcagtggcagcagatcactgttgttaaattaaacgccatgcaagatgcaacagtgagagtgtgacacaatcatcgccatcggtttatttggttggagtttactagtaaaagcatatcggttttgttaggtttgttaggttctgatcgggagggaaaggcccgtttattcgatcgatctgaagtccacatctactagtagcagtactagtaataatttcccataaaaaaagtactagtagtaatttgccattttttgttttaaataaaagtacgtaatttgccattttagtattttcgttgctcgtgctgtcatgggcggagccatttggactagccatccaatctgggcctctaggttacacggcccaattgctcggcccgtgcgcgaggcgaccgcaatgcacacacgttacacgtttcacgacttcaccccggcgtccgggatgcacgtacgtacctgtacacagcacacgtaaagcaaaccgtactctttcttgaaattaaacacgacggcatacaaccgtactctattatagtagtatatatcgtttctatatatatatgttctagttctttttaagtcaaacttaaaaggtttttttcatctctctactgcctctacattattaatatgttaatcccgcgcagccatccaaccgatatctagatataccacatgaaacaaattaaccacccaatcccatgagcctgtgtttccgctagtctctgccagggaaggtctttaggaaaatcaaggtgcttttgctaggacactgctccttcaagggtgttgcgccggtctggcttttttttcttttgtttttgttgttgaactctttgtactcatcgtatcgtttctagtaatggaaatgtgggctctcacaggctcacagccctagttaaaaaaaaaaaatcccatgagcaccgaggccgtctgccatgccgtcatcgacaacgagctccaaggcgtagcccgaagctgcgctgctactgcgcggtgtgcacggagccattagagtgggtggcgatcggcccgtgcggccaccgcagcgtttgcgcgaggtgcatcgttgacatccgcttcgtcagcaaggacaggcgctgccgcctgtgcagagccccctgtcccttcctcgtcgtcgtcaggggagactcactgtagagaaatcatctttgtgtggagattatgggtaccccatacccacacggcatggttatccgactagttataggggataacttatatatatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctaccccgttttattattgccgaaatcaagtttcgacagttggcgcgccaggtaggggtaaacgccgagtttcctgacgacgagtgcgatggaatcaactttatgagttgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatgcataggagacggctgcagccacgccgatgccttcctgccgtcctgcgtcgtgctgatggacaccaacgccgcccgcgactgcgacctccgcctcctccgctccgtctcagaattaatctctcttggtattttctgctgtttgcatgtaacgccgcggcactactcttgccgactggtgtttccgtctgcatggctggcctattaagccgccgctgttgggcgtctacgacttcaccaccggcctgcctccgtcgccgccgactggtgtccccgcctatacggtcggttggtcacaccaccgttgatgggcatcgtcatcttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggtctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgtctccgcctacacggctggcctattatgccgccgctgttgggcgtctacgacttcaccgccggcctgcctccgtcgccgccgagtggtgcctccgcctacacggctggcctattatgccgccgctgttgggcgtctacgtcttcaccgaccggccgcctcgaccgccgccgactggtgtctctgcctacacggctggtctattatgctgccgctgttgggcgtctacgacttcaccgccagctggccttcgccgccgccgactggtgtctctgcctacacggctggtctattatgccgccgctgttgggcgtctacgacttcaccgccagcctgcctccgtcgccgccgagtggtgctccgcctacacggctggtctattatgctgccgctgttgggcgtctacgacttcaccgccggcctgcctccgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttctattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttatcaatattttaaaatacttgattttttctcgagtattatatttatatcagatactactcatcctatatgtttgttctgcaggatccagatccagatatgcataaaagggattcatggcttt

SEQ ID NO: 76009 - DNA, 4258 bp, Oryza sativa
cactaaatggaagtcaacatacctgctcatatgatctaaggtaggaatagtattcatttgtcatataaaaagcaagggttatcagattcaagttctgcatcgataaagcatcctgcttaaagaatccatatgcaaaattctaataatccaaatgatgcttcatatgcaaaactctaagctttagaattgagacagtattttcccagcacaagcaacactaataattcatggaaagagtagtccagaatcaacaaagattactatggtctattatcaatagattgcttgtcaatggacaattattgtctgctgcagtgaaaggaaaaggaaaccatccatgcaccatgcatcatatagatatcaccattgtaaatactttttcttgtgagtaggtgatttgaatatagcagtgatctgaaatgcagatctaccaaacttctgaagtaaagtgaatgcaagtaaattagtttgacactcaaattgcaaatataatatgatggggttgacagtaccttctgatgagattgccaacgaacatcatccagaacataattttgaagtaattggaagatgaatttggatttaatgacacatcaagaatcatctgttagaatctttagtatttccagagtgacacaatgcttcattcagtataaccaaaaggctgttgaagagtagtacaaaattccacaagaattgaattggtatactagttacatcatttcaaatgaatgctacacaagttaccagcctccaatcactgccaaaaacttgggattggttaagaacacaacccatcatggatctcctattctccttcccgtcttctctcgtgaatccgccatagcatgaggagtggggaatccaaatgcttgcaaagttctttcaccatcaaaatcaaccattcaaacacaatgcattgtatagtcatggcgtgcgatccaccaccagtcattcttcgccgaaagcggacactgcccacctcacttattccccagtatgagcagatatacctatgactctgagaaattcttcatcacctgatgactgaattgctacccaccatcatctcaagctcctcaatcgagccgccctcatcatccaagatctccatgctcgatgatcggcaagtgaagtagaacacgacactcatcatcgagtcgatgagcatcacgaaggagtacatgaggacaagcaatggcccctcccagagccttgatgagccatcaccatagctcagtgtcttcaccctgtgctcaaacagcccctccacgaaggcgaggccaatggtggatccaagaaagatgagcaagccgacatgcgtctgcccgcgcatcagctgcactgaccggcgcagcgcgctgactccggcgatgtcctcaagaacggcgatgacaccgccgaggttgcacactatgatggtgtgcgcgtacgccacggagaaggcaagaacggtgaggaggccggcgcagacgacgatgtcgggcgggtagagcatgaacttgagcgtggaacacgcggtgacgaggagagcgaggaaggaggagaggcaggcgatgacggcggcgcacgcgagcgcgtacgtggcggcgaggcgcggccacgcgcggcgcgcgaggagggagagctccgcgccggcgaggagcggcttgcccgcgtagacggccgcgaccgcgtacgcggcggcggcgcgggcggcgaggaggagcgtgaacgtcgccgggaacgacacgacggacgcgacgagggtggcggcgaggtggtgcgccagctgcctgacgaaatgcgtgagcgggagccccgacgccgccgcagcggcgagcagcctccgcgcgagcgggagcacggcggcgccctacaacgcggcggctgacagcaggaggcaccccgacgccgggcagagcaggaagaagagcaccgacgtgaacgcgtgcgggtcccccgcagcacccgcaccgtctcccgcaggatctccagcgcgttcatcggcggcaaccgcaccacccctcctccccctcctcccccccgcgccatcctcgccgccgccacaccaccctctctcacttcttggactcgccgcctccgccgccaaacgcgacgttcctccccggtcagatccaacgcaacggctcgagctccaccaaaccccgtcgcccaatgcgaggctcccgtggccgccctccgagttggttccagtgagcagaggcgagatcttggagagcggcaatggcgtgggaggaggaggaggtcgaggaggaagagaagtttcttggagcagagatcgaggtgggttttttgtgaagggagacggcgacgccgcgagctcgcgaggcgagggggagggtctgactaccgacagttcacatgtggtactgacatttggggcccaccaagttgaggtagtttaggtttgttaggatgacatgcgggtcccaccaagtggaggtagtttatgtcagttaggatgacatgtggggccccctggaaacccatccctccggtacggaaaacgaagcagtccattagcacgtgattaattaattatttgctaatttttttttcaaaaatggatcaatataatttttttaagcaactttcgtatataaactttttacaaaaaaaacacaccgtttagccgttcgaaaagcgtgcgcgcggaaaatgagatgggggagttgggaactcacagtgaagcttccacgggcacgcttgcatatgatttttcttgggtcgtgcttctgcaaattcctcttgtcgtaggttccattaaagatttgaagttgataatagcgcattgacaatgagttatatgttcgttttgtcaacctactaatgacaatgtgagattgtgattcatgtttgtactattgccatttggtttattggttgccaaagtaggaagaaacaaatactatccatcaccattaagaccattttcgaatgcaaattataggaggacaagcgaaactcaattttgttgaaacgagatccttcgcagtgacatactatcacgcctaacatgtaggatccactttctcatgggaaactcatgagcatatatgtcagcgactctaaggcttcgttcgttcctgggcgatctgggggattgagggagaaaagcatctcgttttctgcacgcacgctttccaaactaataaacggtgtgttttttacaaaaaaaaatttcctataaaaaatttgctttaaaaaatcatattaatctatttttaaaatttaaaataattaatactcaattaatcatgagctaatggctcacctcgttttacgtatcttcccaatctcctcgatcaccttctcctcaaactcaccctaagtgcataaacttcccaatctcctcaatcaccttttcctcaaactcaccctaagtgcataaactgtattctcctcaatcaccttctcctcaaactcaccctaagggcatgtacaacggtgtgtaataacggtctctcttcgtttccatgtaagtaaaattgatgacgtggaagagagagagtggagtaaagggaaacatggttgctacgcatgacaacgggtcagagtcgactcttaacgtttattaaaggaaattttgttgcatggaggtggagaaaaggaaagaatggtactaaaaaaaatattttggtgcattaatggttaagagtttttgttatcttaactattgtaggagaatagtctctaagtgatatgtattaacaaagagaccattctaagctctacctttatacatgccctaagcgtataaactgtactgtagaggaggataccaataaggtgcattaggacacattatgtcgtaatcgtccgagtcatgatcaaggctcagatcaaattattacgatagtacgtgtttcacgaattatcctctaacttaagtaatgtgtttttagagtcactgacatgttcagtgactcaaagtgatttgactttgagcataggatctcaatcggtgttttgctccacaaaaaactctgaaaccttgttgctatgtgttccctgtactctctccgtcccaaaataaaccaacattatacgtgatgtaatacattctattactacgaatctagacatacacatgtccagattcgtaatattagtatgtgtcacatcacgtatgagggttttttttttttattttaggatggaagaagtatacaacaactacagtaacccaggtatattgagttgcatcaatacagagaaaagagggtcaaacaaggccgagcaggaaggaacaaaa

SEQ ID NO: 76010 - DNA, 4366 bp, Oryza sativa
aaaattagcaccatagcgtatgacgcagattccatatatccccatcatgcaaaccccgcagatcctggatatatcctgtactgccagacagcccgttgatgctctcaacgattttcacccgttgttgcccgggactttttgaattaccctattcaaatcagattcaaccaatcggaacacactgtcaacatgaatcatgaacagtgtcgagccatgaacagtaccaccgtgaacagtaccgggttgcaaccaaaaccgacccagacactgctttctttgtcggtgaaaactccaactgccaccaccgagtacaccacggcgaccacgctgtctctgctcaccgataacgccgtgtcgcctctcctgcaagcagctgcaccgctgcatgttccaacagagtcaccgctacctccgatctgaactagccggtaaccgccgcctcctcaccggagccggcccgcatcgaactcgccggcacctgcacaacgactacaccaagtcatgctcctgccacccgacgttcgtcgccccaaatcactgccgccaagaggtcccagtccgatctccttttgctttgatgatttggttcgattggaatatctgcaatcccgtggattaattcctgttgctgagtcctgggaatttgttgtccgattttaagtccaaaccgaaaccctcttccttttccctttcgtgtgtgtccaactaggcctcctctcctggactacttgccacaaacgccgccgtgaacgaacaggatacaactcctgtccgtgttcaactccaacactgtggctccgtcctgattggagtcctgtgcaaccatgactcctcccgagcctgcttcctcttggcgttgcttctatcaatgccgctagcctggtctcaacgtgcggtgcacgcacaccatcgcgacatggacttccaagccttaacgtatctcacggcttctgcaccttcgcttctgcacttccggccaactccgctaatgacgcatgccatcagtttgtaaccaatgcatacgattgtgcaaagcctctcggttgaactgacatttccacgatacagtcagcccaatttgccgatctggtcgtcctcagcccgatccgcacgtacgccgccctcgaagcaattctgttgcacaccttgtcgaagacacatccaaaacagcctctagcatccacgcgtggcatgcgccaccgttgcggctccacctcgagcccgcaacccgctccgacctccgattgaccacctgtcaatatagtcgcgagccgaagccgacaaatcacatgccgtcttcccagccgccgaacgacccgagcgctacgtctagccgtctccctgtcgaacgcaactcatcgaaagacccgggacacccggcccagagtgttcgattccaccgatcgagaacgccgatcgcctccagcttcaatcaacccgagcgtgcggccgcacgtctccctgtcgagagtagctcaccagaaagttcgagccacctgcccgaagtgtctgacccaccgattgattcgccaatcgcttccgccgccaccaacccgagcaccacgtctggtcatctccctattgaagtagccatcgaacggtttagaccgccgcctgaagtgtccgattccactgatcaaaattccgttgatcgccgccgtgctccactttgcgtccatgtctgtccctggacaccctgtgtattcgtcgcagcgtggagcacctctctcgtacctctaccatggatctcccgcaggctttgataccacttgttataaaactggccccgaaatcacattggaaaccaaacgcggaagaaaacgccataggagatccaaacacgatgacgacaccgaggcacgatatttgataacggagttcagccgaggcctacatctccggggcactgattacgggcgctcctccccgattcagcatatacagcgtatcagagttacaacgactcacggccggtcgccgccggcagctgctccctctcgctatgctaagtcgtcatgcggttacaacaggcacgcccctctatttatgagagatcgtaggacagagtccgactcttactctagtcctatacctagtacaactccaagtcctaaactgtaaccgactacgtacacatattcgacacaaactctaacatcttccacgtggcggcaggaggatcgatcacccatgcacccgcgcggcgcgacacaaacgtactccaacatcactaacatactccaacatcgacagggtcgcccaacatcgtaacgctggcacgtcgtcgtcccctcccacggtgcaccacagccgctgccgcgccggactcgacatgctaaaatgcttttatgtgttggcgtctagagtagtggtagtggttaggggtagatagaaagctcgtgactcgttagctctgcttggctcggctcggctcggctcgtttgaattttctaacgagccgagctgacattttagcttgtcagagataacgagccagctcgagctagctcgtgagccttaatgagctaggactccatcacagcccaaaagcccaatacaacaaaaaggcccaagcccaagacactgcaaaccctagtcctcactcaattccccactctcccccagccaccgccgccgccgggagatcgagcgcccgtcgccgccggtatctgcctctcccccgccagctcccgccgctgccggtctcctcctctcccccgccagctcccgtcgccgacggtctcctcctctcccccgccagtgcccgccgatgttagatcgggcgcccgccgccaccggtctccgccaatccccccacgcccgccgccgccgggagatcgagcgcccaccgctgccgatctccgcctctcccccagcgatccagcgcccactgccgctggcgcccgcccccagcacccgacgctgccggcgagctcgagctcgtcccctccaagtgctggcggagctgcgtagagttcatcccctccactgttgagctccttcctatggtcgccggcgagctagagctcatttcctccgccgttaagctcctcccctcctccccgtgctcgccggctacgtctcttgccctagctcgcgagcttaacgagctggctcgagcttgttgacgagccgagccgagctagttttctagctcattaagataacgagccgagccgagctagctcgttattctaacgagccagaccgagccgagccagctcgacatccacccttagcagtggtcctatacgagtatgcgactcgtactcctaattgtctccatatggtagtggtccctagtgggcagccaaacgtctctcattcttttgcagccttaccactgttgcaggtagagcgtcctccttgaccaagcatctctctcggcgtttctcacccaccacaaaaatcgcttctttccttcctccctcatagagaaatttttatttttactactacttagtatatgcacaataattagtactaccaatagtactgttttagttgtttttttattggagaacattaagtgctctatattcgtcattatgggccggctgataaagtttttttaaataaaacgaaaacgattttgctaaacatctcccgcgtgatttttttccacatttgacgtacatttgacgtttttttgccacatgatctttgcacaaggcatagaagcccacgaacagcccagcagcccatcatcatgcctaaccctgattgctaactccaatcccggtccactcactgccccacacgaccacgcccgcactcgttccccgttcacatcacatcgcacacacgccacgccgcttggatccgggtccgtggccagcacccgcaccgccgcagcacgcgatgcatttgataaaaaaaaatatgtaagtaaatatgtacttattattttctttaaaatataaaattacagttctatataactaaatttatatttgtaaattcagttgatttgacatgtaagtgcactgtaattttgataaaaatattgtgtaagtaaatatgtacttattattttctttaaaatataaaattacagtcttatataactaaaattacatatgtaaatttagttgatatgacatgtaagtgcactgtaattttgataaaaatattgtgtaagtaaatttgcattagttattttatttcaaatataaaattacagtcctatataactaaaattacatatgtaaatttagttgatatgacatgtaagtgcactgtaattttgataaaaatattgtgtaagtaaatttgtattagttattttattttgtagtccgttggatgcaaatccaagagaagaaaaaaatctgggtgattttttctcaaaaatcacccgagtgat

SEQ ID NO: 76011 - DNA, 2060 bp, Oryza sativa
caaacatttgacactgaaacccataacaacccttaaaatggatggggggagtagccaggaaagtaaggaaacaatcctcatgggttcaataattcctatagttcaacaaatattttaactcatcactcattcagtcattatttcattcctcatggagatcatctcaagaataactcgcttaggtccaatgttggagatcggcccctccaatcctctatcattccccagtccaaatcccctctccaaatcatgcctttatccaccaaactctattctcatctgtcccctcaatgccgcctcttcctcgccccgtcggcctcctccccacccactagccagcctgcccaaagaagagtgagagacaggagggagataggaggggaaagagagagtgatgacgtggtcaccctgacatgtggaacccatgtggtttccatgctgacttaactgccacattgaacaaaaccatctaaggacctcccatttttgttagttgaaggatgacatatatccgtggtttcggtatgattttgtaatccgatgacaaggtaagggacctcatatatactttttctctcggtgcatcctgcgcggctgcacccacgtgctacctctgctttccggcctagcccgtaaacctaaagggccgcctctactcccattggatatagggcgggccaagagcgagagtgtacgagtacgagaagtagagttttccacttctccttttcccttgtactccctccgtcccaaaataagtgcagttttacactatcacattcaacgtttgaccattcatcttatttaattttttttatgattactatttttattgctattagatgataaaacgtgaatagtactttatgtgtgactaaatattttcaaaattttcataaattttttaaataagacggacgatcaaacgttgggcacgaatatctacggctgcacttatttttgggaaggaggtagtacgagaggaaagcaaaagcacagaactgggcaacatatactactacgggacaaacttgcaattgaccagttctcattcacgaggacagacaagagatagagcgcgcgcgcgcaaagaacatatagatgcagattatttttcccttagtttttagttagctaaatttttaaagtgttaaacagtatgtttcgtgtgtatatatatatatatatatatatatatagttttaaaatagtaaataaatcaatttcaaaatatgtaataattaaaacttaattaattatacgttaatgaatacgaactggccatatcatagtagagtgatagcaacatattccaacatccaggtgtgaaaaaaaaatccaatgtcggcacctaatactaccagtaagcgagtttaagttaactactggagtacttagtactaatcctacataggactataggagtgcctgtaattattactaggacgagtattgaggagaatatcaagtggtttctgtgtgttttgttttcaaaggggaataaagttattcttcttttaaagttgatcttgtactttctaaaagctgaatccaaaagatagttgatgagatcgagtagcagcgagccaaccctgactagtaactccggagaggaaggccaagaatccaatcatgtgtctcgtctcgtctcactctcgcctccaatcatgtttggttataaaactggccccaaaatcacattggaaaccaaacgcggaagaaaataccataggagatccaaacacgatgacgacaccgaggcacgatatttaataacggagttcagccgaggcctacatctccggggcactgattacgggcgctcctccccgatccagcatatacagcgtatcagagttacaacgactcacggccggtcgccgccggcagccgctacctctcgctatgctaagtcgccatgcggttacaacaggcacgcccctttattttatgagagatcctaggacagagtccgactcttactctagtcctatacctagtacaactccaagtcctaaactgtaaccgactacgtacacataatcgcacaaactctaaca

SEQ ID NO: 76012 - DNA, 4080 bp, Oryza sativa
gaggattggaggggccgatctccaacattggacctaagcgagttattcttgagatgatctccatgaggaatgaaataatgactgaatgagtgatgagttaaaatatttgttgaactataggaattattgaaaccatgaggattgtttccttactttccttgctactccctccatccattttaagtgttgttatgggtttcagtgtcaaatgtttgactatctgtcttatttgaaaaaaatgtgtaatgtttttttaaaaaatcatgcataaagtactacttatgtttatcatctaaaaacaacaaaaatagtaataacagaaaaattttaaatgtcaaacgttggacactaaagtctacaactacacttaaaatgagacagatgaagtagcatgcaattgattcccctcattgtccttggcaaaggtattataattctctctcgcttcctagagtcctaatagtaagaactagtatccttgtccattagatttaatgaaattaacggctgcgcgtgtgcgagctccaacttttttcttgacgtccacgactgccgtgccgatgtgtgaagccatgagagcaagtttaatatagtatagccaactattagcttcaaattatctatagttgatttaatagccaatttatacaataattatctataaatatatactacactattactatatggtcccacatgttatacatacattgtgtcttggagtccgtcagcaatgtaggtgtcgtccgattcatcatcttcgtcaggtatgtcatcgtcatcaggttcaggcatggatgtagcacgcacctcctcaattacagtagcatcaccactaataccttctgacggagcgtggggctcctcaccgggagaccgcgtaggcccccctttgccggttcggccggaggcgctaagtgaggttcttcgccctcgatctgaggaacgtctgcgagagaggaagtgcacaagacacgggcgacgtagacaggttcgggccgctgagaagcgtaacaccctactcctgtgttctggtggatctgtgcgtgagggaatacagagagctcgagagcgagcgagagttcaggctctagagcccttttttctttcctccttttaggcctgggcctcctttttatctgtcaggggtcaccataggggcctctagctgcctaagaagggaaacatgctttttacaatgagggctagtctacagccggaagtgacttctgacaagcagagcccgcgcctcctgccccgctcgcctgcttttccggtggacgcccatttcaaccttcatttaatggccagcgacttccttgccatacttgcgctgaagcctggaatggatctgaccgggactgacataccaactccaggagttagcacgccggctccggctagggacgagagtcaggaagctctcatcattccgacgggacggggcgaggcgtgtgacaggccgcctgttgccacctaacccgcgatctaaccggtctgtgaccggtcacacaccgcgactggtcacggaccggataagcgtgcgctgcgccgcatgaatgcggcgtggtgcgctcgtccaacctgctataaatgcggttaggtgagccccgctgggctcacctaacccacacacggggcgccaaaaccacagggggtcggggcgccccagccctcggggccgaaacgggagcggcccgacccctcggggagacagagggaggggtggccacgtcaccctcgggcccgacccccccgagggggtcaggccacgtgggtgaccgcggctacccaagcctctagtcacgatacccccggctccatgtcaccaacaccttcaatgtcagaccttctccagtttgtgaaatcgtcatgtcggtgttgtacattcatctgctccactcctacaacaagtgagtcaacatcagcatggtcaacattattatcaccgtcttccctttcaggcatggcaaacaggttccgaggtttcattctaagaacactgcaccaattatttttctttgcgcatttcacataacacacctgttgagcttgtgacgccagtatgtaaggctcgtctttaaagcgaaaccgagtggtgtcaatatcaataatcccatattgatctttactgtaccctctggatttgttcgtggttgctcccggaacatcaaaccagtcgcactcaaacaacaagacttctttgtcgttggggaaatcaagggcgatgatttttttaatcactccgtaccagtccatgccttcgccctgaacaacaacaccactgttctgtgtggttaggtttttctctacattggttgtgcggaagagaaatccattgatggagcacctgttagctacatgaactcgatgatctggaccacgagatagagaatatacatcttcatctgtttttccatctgcatgaagaatgttcatctgcactcagaaaaatttcgatcatatgatcagtcacattttcaattagtttgatgaaattaataaaaaaacactcactttatgctcaaaccatgatacaaattgttccttgtgccttttatcaacattacccctgttgggttttttttcaatttctccatatgctcactgcaacaacattgaaaatattagcagaatgatgagttccttagtcactctgcactcataacagacataaatatatcttactttacccatggcatggcctcatcacatttggatattatgtagtgcctcatcctatgcaagtctgaataagatgcagtctcgatatgaaatttgttcttactgtactgcatgctcccaaaaatacttaggccagcaggtggtgcactgacttggctattttcttgacgttctggcctattcacctttgtactaacatctttgaagaaccgagcacagaaagtaaggcactcctccgatatatatccctttgctattgatccttctggacacgctttgttcctcacatagcctttaagggtacataggtacctctcaatgggatacatccatctataacaaacagggcctccaattctagcctccaaagcaatatgaactggtaagtgcatcataatatcaaaaaatgatggagggaatatcatctcaagccgacaaagggtctctccaatcgaattgcatagtttttcaatttcagtcacctcaagctcctttgaacatagttcgttaaaaaacctgctgagctcgattaatgggatcacaacatcttcaggcaaaatatggcgtaccaccaatggtaaaaatttttgtaataaaacatggtagtcatgacttttaagtccactaaccttccaaccattttcatcaacacatctcctgatatttgaggcataaccatctggcatcttgacatgttgtagaaatctgcacagaatttccttttgacttggacttaacgtgtacaaggctgccggcaaagtgtattttcctatatggaccaataaattttgatccttcctaatacccaattcttgcaaatcaagtcgagccttctcactatccttagatttacctgttaaatcaagtaaagtacctagcaagctctcacatatgttcttctcagtatgcatcacatctagattatgccgtataagcaatgattcccagtatggaagataaaaaaaaatactcttcttcctcctgttgtgccatctagtatcttcatctcgttgcttcctcttccttgacgtcatgccaaatttgacttgctcaaaactctcgtactgcttcaatacttcgtcaccattgagtgccactggaggccccctcatttcaaccttgttattgaagctaaccttgttctttcgccacctgtggtatgaagccaaaaagcggcgatggcctatatagagtgcttcttgccgtattttaaccacaagtattcagtatcattgtgcaataaggacacgcaaacttgccttttgtgctccaacctgataacatggcatacacaggaaaaccgtttattgtctagagcagatttgcacgtagcgtaaaattctttttcaccttggcatcccatgtttcaactccttcagtccacaactgtttaag

SEQ ID NO: 76013 - DNA, 8298 bp, Oryza sativa
  unsure (1)..(8298): unsure at all n locations
taccggtgctcggcctgcttgatcaccttctcggcgacatcgggcatcttgcagacggagcagacgacgtcggtgatgaaggtcagcgtgtgggggtgttaagaattggttgggctgtaaatgggctgggttgctatgtttccaatcagggcccaagtcagctcatgatgcatcacatatcaacagcagagcacgtgaggactatcgaacagaacagaacaggcaacggcggcggctggcctcaaggcagctggacgaacggcggccgtgacctagcagcactctaaagagacatacacttgtactacggaagagggagatattatgcgcaggaaggcgaaatggctaccgggcgaacgttcgccaacttataatctcgcgaatcactcggaaaggaggattagaggacgtgtgatggagcgatatccgttcttcctttctaattttccttttatttacccgattttccgggtaatatttccttctttttagatttccttttttttccctagtcctttctatagttttattaacggaaacttttctatatcaattattcacgtggaaactttccacatataaactttacgtatataaaagttcaatatatagactttttatataaaaaaatctttatatggagttaaaactttatatataaaagatttatatctagaaagttcatatatataaaatctatatgtagaaagttttcacggaaataattttttaaacaattctgcatatgaactttatatagaatttatatatgcaactagaaagtttggtttataaatttcaatgaaaataaaaaaaaaatatgttaatcaacgctggatatttttggaaaaaaacagaaccttattatcaaagcaaacctcgtaaccgaaaaaggagaaagtacgtgtagatttggttttttaacagaagatcaacgctaatcatgattaggggcgtaattagacgtattaggcatggagaacgatggaaacttatcggttcgtgagattgtcttgtcgcgaacattcgtgggctagacccacccgcaggaaggcggaggaaaacaagaaagaaattgctagactcgtagctcttgaggggcttgagcttatatacagatgaaagtgagaagaaaaagttctcaagtaaaatgtatgcaacattcttttagagattccatccacttttttcccggcatatacttcaacgtttcaccgaagttccatataattaagaagattaacagcacgaaacgtagcaggcaaaaacagagaattgagttaattaattaactaaccccaaccaaacaacagagagaatagtagatcctggatcactgctaaaaatgtatccagataaggtgcaacagcattttatcttgttgcagtcaattcacaccagaatcgatcgaagcaaattagaggcaatcccatactggcaacccaacaaaatctcatgaacagtaaaaactcggtcgagcaaagagaaatatttgcaaaaccgaatctcttggattggaatactagatatcttaaaggtgctagattaaccggcctcccagcgatttggctactgttgaccaaccgccttgcgacacgttgctgttggctgggcgtcttgcgggccgtccgattctgcgtctgggcttcatccatccgtccgtgcctccctgttggtcgtccttgccgaggcgtcgatttggtggccgctgagcctcccacgtcgcccattcctcctctctcgccgtctcgcgcaatcgcactcgcacacacgcgccgcctgaattaaatttaaaaatatactgttcattcaatttttttcccataaatatccgggatacaaaactttttgtgtaaatataccgtcgatctcgcacaaccgttgcgtgaaaccgaggtgggtgtgacgccatgggcggtatctcgcggcgaaggcacgagagcgcgcggtttcgcgcaatggaagagcgagaccggggggnctttttgaancagacagcgaaactgtccaccggctccatcaattagtgcttaattacttaattagcaattaactaataataattatcaactaattatcctaattaataattaattaattgctatcaagataattagtccctaattgaatcagcatggcaccggtctcgctcagtgcttgcgcgagaccgttctgtctcgctgtaccattttccgcgagaccgcgcggtctcgcgccttcgtcacgcgataccgtccacgacgttattccccgtcattctcgcgcaacggttgtgcgagatcgacgctatatttacgcaaaaaattttacatcctaaatatttataagaaaaaattgaataaacagtatattttcaaatttaattccgcgccgcctcacctcctccctcgcgcgcaccgcctcgcccttctcctctcctcgcatgtgccgtcatcgccgccgtcgccgcagctccacgctcttctagccatcttcgctgcgctggaagatccagccacccggacaagagtggtgctggccgtcgcttccctcttcccccctttcatctccaatcgcccaccgcttccctctccttcacgctctccactccgcttggtgcccgatctggttcgagggcggctggagctgatggtctaggcctccccaccggtggatctggctgcccttgcttcgggctccggcatcggggatggtgctcgtgctccctcgacttctccgtgcacccctaaccctatcctctgcacgatgcggtggcggcgggagggcgggtgaggcgcatgtcaaatccaccaccggtgctcccctctttattctctttccctctgtggcggcggtgacgggggacctacgggggcagcggaacccgtcgcgcatccgccgccgatgcccctccccttagggcggcgtcggaccggccgccggcgcgggactgtcgtctgccctcccctgcctcgcgcgagtccatggacatcgcatagccacgggagccaagggcgatacatccaaagaacagctggtatgccaggtacgtgcatcactgcgtctcctctggttcgagggctgtctaagctgatggtctaggcctccccaccggtggatttggctacccttgctccgggctctggcgccggggatggtgctcgtgctccctctcgacttgtccgtacaccctttaccctatcctctgcacgatgcggtggcggcgggagggcggagagaagcagctatgccgcattagctcttcgctggtttcagaaactcaacttgttccaggtatagttccaggtgctccgtgctcgtcaggactgaaagagattatagatcttatttggtgattcgcaggtatgataggctttctcccacttttgttttcctgtcatgacatagaattagtgaagagaaaaataatgcatggcggataaatgattgcaacttgcaaggcagcatgctgaacatgcacagctcagctctctcttgcctaggaaattcttggactaggagatgtgtttacggtgcagttggcacatgcgttcagttgtcaacgcacctaaactcttcacctttcgtctggatcaaatgaaggattgaaaatatgtgactcttcctatcttaattccatcggttggctagctccttctagccaacatatttttaaaaaaaaaaaattcttggactggcgttcccagccttgagtacactgaatcgcatagaaagtactcatctcatattttcatgtcatgtagcatcaaatcctctctatgactttatggatctacggtttttgtttaggtttcctgttggtacttaattagagttgtttcttgcatattttacttcagattcagtcaagatttgaagagatcttatgtgataattaacaggtctgatgaccttgctcccagttttgtttttgtgtaatccgtttactgaaaagtaatgcatggtggatgaattgttgcaagaaagcatgctaaatacgcactgtactgtgcagaagttctgcagtgcaggacattcctgccgctagtcgtgccttggacagccagagctctcgaattctcagccttaagtacattggatcacatacaaggtactcacctcatgccatgtatcatcaatcctctttatggacctggagttaggtgcaccttatcagcttaagctctcaaggttggcctgctcctcatcagctttctatcttctatatatgctgtgcatgttaatttcgatggtttgtctcgtgcaggtctggcttcttggagtccatatgggcctcgtgccattctctctttgcactgaggtctgctgagcgcctggatgcttatagcatactctctctctctctctctacttgtcaacactgaaatatgttttctcgggacctgacgagccccaagactatgatcttacgaattccaatgaattttgggatgaaattcgcaggggactggtgggcctttctgccccgactcaagtttctgttagccttttactctttatactcatcctgttgattgtgctgacatgcttagcctcttcacaccaggttgacaaggattctttagtgaggaagcaggctttgtacatcttgagaatatcacttgacatctttccctcatctgagaatgatgccgctcagcaatgctccaggaggaggtccgccgctctgcctgctcaagacaaaccaaatactgcaatgacaaagagagaggtgggctcagaaagaggctagatcccttggcatcagagaaacgagccaatcagatgaaaactgctcaagtcgtaagaccggtcgaaagttttcctgttactctatgagatgcttcaggagtatggaacacatttagttgaggcggcttagacgcaccaggtcagttggttcctatgtgcttttttttaagacctgtatatctgtatatctaagtgtcaacgcaatatataccaggaacagcattcatagcacgcaatgaagtaaccacatgcacgttcgattagatgggttgataaatttaactattattcccaggtaatgctgctttttgagtccaaaccgataaatgactgaataatcctatttgttgatgttagccattctcagctcatatgttgtgttatcctactttattactctctccgtcccataatataagggattttgagattttgtttgtattgtttgaccactcgtcttattcaaaaattttgtgcaaatataaaaaaggaaaaattgtgcttaaagtactttggataataaagtaagtcataaaaaaaataataattccaaaattttttgaataagacgagtggtcaaacagtgaaagcaaaaactcgaaatcccttatattatgggacggtgggagtagtacattatttgttcccttttggttcatgcgttttgccttgggtttgatctttagctaccccagcttgcttgggactaaaggcttatgcaaatttttgtccgtgattattacctcctatcaagttttatccttgggcaggcgtttcactatttatgtttgcctcttctgaaacattgaatttgaagttgaaattctaaaggatgctagactgccacatcaaaaatttacaattttcgtctattttnnccccccttggntngcccccaaacccaaaaaagttgatcatgagtgcgctacaaagggtgattatacttgatttgttaccttgttcaatacacctgagttgctcttacttctttgaaaaggaaaaagtgagatactaagaagaaacttagcatcatgagattcttattcttgtttgcaccgttctcttctaagttctaattcttttatactactcctaggagttacattgaacttctcatccttaccctgctctagggtttgatgtgtgctcacatagtatacttatagtgatttatatgtatcattgctaaacaatacccatatgatggtgtaattcaaaggtttgatataaatcttggttgcccactaaataactaatatgatttctttataaaacattaacaaatcacaactgccttggtcttatgttattctagagcacaaacactttttttagggtttagtatgtcacaggagcatggcaaaacgatggtgatgcgtaccaataatcattcctgttcttacaaatttccatatattcttcttttatattcattctatttggtttgatgttctgactgttcgattaagactgctttgtaaagaaattattatgtgagttatattttccaacgtaggtacagccctttcatgtttgcacgaccaagcagccattcatgctactgtgcttcttttgtggattgaaataggataagaaggatatgactacacagctagtggtaaaccatctaccactccatctatgagagacattatccacctatacttcaaatacaattttctcttaaactattcatccgatctacgatccgattgcaccgttgtgtttgtaacaattaaatctttataacaagatctcacatgattatattctgatgaaaaattataaattactttttaatatatctaaattacttttagatttcactaaattacttcttagacatgtaaaagtaaattcaatgaagtctaaagtagtaacttataacaaaaagaaagtaactttaatgaatgttttttttaattggatgtgactacacggtagtggtagctagtttgtactccatctagtatctcctttcaacttgaaaaatataatagtatcttcttttctcattctacatgaaaaacaaaaacaaaaggaaaaaacaatcgatgattaaacagatttatagagagttacttttgaaccatgcaaaagttacttccaattaacattgaagttacttttaaaaattgttaaacttatgtgtgttgatctgtgctgattaaatttaatttctagataaagtcatatttttatacgaatgtacttataatgtcgtgacaaaattacttccgttttattttaagttacttttataatatatgtaaattacttttagagactattaaatttacatttatatgtctaagaagtaatttagtcaactctataagtaacttatatatatatatatgataaaagtaaattacatatataataaaagtaatttacaaatataaacattttttcatcgtaatataatcatgtaagatcttgttgtgaagatttaattgtaacgaacacaatggtgtaatcggattgtaaatcgaataagtaatttgagagaaaactttgtttgaagaggaaaaagacgtacacgtatattaaaaaagcatgcatgtagtaccatgttgtttgaagatgaaaatgacgtacatgtatattaaaaaagcatgcatgtagtaccatgtagtagctggacttctccacatttctccgtatttaggcgtcgctagttaaggtaaaatcgagaggcctctccaaatagattttacgggataagaagcttgcacatggacttatagtggggtcagtactgtatgaatgggttcttactacaattattttcccccctctgtgtcttattttatgtatattggtgctctatgaaataatataatgtaccatgtaatcgataaatcatcattgacatatcaaagtgcatctatgtatgcgctatatttctctaatctttcctgtaatatttattgttctctctaatgttttttttttgccacgcagcgtagcgcgcgaacccattctagtatagtaatcccacctaggatccaacatggctacgatggagtgggcagagtaatcgagagagagggcaagcatagtattagcagtaatctgtaagaagattaattagcacaccaaggaaagacacaggaacaattaatagtacgagtagtagcaaaatattcgcttgcatcaaacgatccagtagttcaacgattgaaaaggatacaccggtgcatagatgcacgaacgcaaggtacgcaacgccagccgattcgatctgaacctactagagaacctacacctgaagatgccaggatcgacatgctgttccctcatcactccagagttacatggataataaagctagaacactaaaatactgatagacgatagacacctatgtctgatgataactaaggacccgaaagttagctaggaaactactgaagaaccactagaactggacgatacatggtaggccctccgcaccgcacgtcacctcttgacgctttgtccaaccacagaacctcgagctcctcttcttggcggcaacgcgcggacgtagagacgacctactactcggaggcagtcaagcca

SEQ ID NO: 76014 - DNA, 13965 bp, Oryza sativa
taggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctacctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacactaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttccgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcaactgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttttcgccagcacggctggcctattatgccgccgttgttgggcgtttacgtcttcaccgaccggccgcctcgtccgccgccgactggtgtttccgcctgcacggctggcctattatgccgccgttgttgggcgtctacgtcttcaccgaccggcttgccttcgccgcctccgactggtgtttccgcctgcacggctggcctattatgctgccgttggtgggcgtctacgtcttcaccgaccggccaccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctacatgattctaccagtgttgattagccttatcttcttcaccgccggtcatctcgtctgctgttgactagtgccctcgcctctacgtctggtttatacagctaccactactgatggacatcatcgttttctgccgccgactcgtgttatgccgccgtcgactggtgcttttatcttcacaactgcgtcttcactaccagtttgcttctgttgccgccgactcgtgttcacttcatcacggcgatgcaactttgtcatcatggtagagcgacttcatatttattatcttcggcaccggcaaactctattgctgctacttcgcaagttttactacttcaccaaccacgacgtctttgtgaacctcgacatctcggcatgcaatgccatgttattttactacaacaagtggctctccaatattcaggatttctacttggacatcttcaacacataccttcaatcaagtaatgactattcgacgacaagaagctacagttctcgactctatgttcagttgtttcccaactaatcaaagagtcgggggctacacaaatacaaggctcaaaatttgacaaattttatgtcaagctgaagaaatcaattcatcaaccaacgagtcaactccaggagtcattatcttcatctttgcttcggaacagacattctacttcaacaacttcaaatatttcggtttagacgagttgggcaataacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagcatactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcgcctccatggttatgcaacttcattacatttgattggtggcatctttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaaggctggaccaattattattccccgtaagggctatcaaccgaatacttgcgccagtcgggattcaattattatatttattttggagtatcccataagggataatcattcagatcagaagctattcatatgagctacacttggtctatattacccggaagatttattacttgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgtcccgctgacttttttatataagtcaaggtgctgtttgggtttttaagcaattgattggatacaatatcattgctttttgccacgtaagtgtgtatttttattgaccaatattatggcttaggctgattatatattatggtcattttccaggcggttggtaaatcctttatgagtttatttactcggattttacaccacatatgccatatatttccgggtgtggtgaaaccatgtgtcttttagggacttaagcacatctgttaaagcagtgtgcgcatggcgtatgcccaatactttggaaatttctttattcacagcattcaagcttctttatagttgttttgctatgtgaactttcaaaaatgttgtcaactttaggttgtacgcattatattttgccaagcagtcggtatatcacttggatcatattattcggggattcacaccgcatatgctatatgttgatatcaagtcacttggttgattacaattatcaaaaccactcggttggttagattatttattccttgactatatgtttggttggttcaattaaccacatagtcgggggctacacctattaggtgcatctattcgatgcacctgactttatttttcagccctccacagtcttcaaatttggtaaaagtacccgggagaccatggcgaagatgattgaagcactcggctttggagtaatctagttcgagagaagattatattttcgactgtgaaggtctcaggggctactgtggagattatgggtaccccatacccacacggcatggttatccgactagttataggggataacttatatatatgaaatatgtaacagatcatgacttgggtattacgtttccttgtatattacggaacggcctaaagtcctggtttgataagattgtaaagtagagttaggaaaccgataccgtattggataaggtttctatcttgtaatcctgccccccattctatataaggtgggcaggaggccctctagagggcatgagacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaattcatgtttcgacactatccgacctactagagtcgttctgaccgagcctagccggtctgactgcaggtcactcggcagtgaccgttagccctaaaaacagcctgataatgcttctgtaaaaacttgatttctcttaaaccaaccgttggatcgaattgcaaacttgacagaataaactagacaaaccaaggaacaattccaccggagggatttgcaaagtaataaacggtttaagagaaaacatcctcgaaagtcagctgtctcggaattttagcaaatctaaactaaacctaaaacttaaacaaattcaaatctaacaagaatcaatcaccaaaactttccaaatctgatctataaagtattagaaagattttgaatagattaacttgaacaaaatcgtagcaaaacgaacaatcacaagctaatgccaaaaccaaacataaacgtaaaacttacaaaactggaatagatcgtctatgccttgatgattaaatatgatatttattgttcaagtatattgttcacaaggtgcagccacaacacctcttacaagtttctcatgaaaccctctctaatctttcaaacttggcttaccctcaaggcatagcctctctctctatttataccgacaacatcctacacaaaataggaatataattcctagttccacttagactctaacctcaattaccaaatcacctaaaacctgcggccacacctgccgctatagatggccatatggcccgaggcccacggcccggcacgaagcccgcaattttggcccggcccaagcacggctcggcccgactagggtcgtgcccgtgccggcccggcccgacagccgggccgtgcctgggctgcaccctcggcacggtgggccggcccggcacggcccgatcaaataaaaaaaatatagggacaaaaaatagacttatataatcgtataaggcatggcccaagaaaataggtatacaaaatagacttattttccagccatttaaacacaacccacagagttgagggaccaaaaatagacttatttccagccatttaaacacagcccacagagttgagggatcaaaaatagacttatttccagccatttaaacacagcccacagagttgagggaccaaatataaactctttctgtgaggcagcacaatagcccatcgtgccttcgggccggcccggcacggcccgactagtattgggccgtgcctgggccgtgtatgccgcccgtgggctggcacggcacggcccggtgcatcggtcgggccgtgccggcccgacaagcctcggcccaggcacggccgggcttgggccgtgccgtgccgggcggcccagatggccatctatacctgccgcagaaaaccagtcggattcccaccaaatctgaccttgtcacgacatcagtctagccgagcctgcttcacctcgtctactgccgccgctgcacatgtaggccatcctcctgacgacctgctcctgagccgactcggcttgccacatccaccgagccaacacacatgtatcaacagacatgcatgaataccacacgtatatgcagacacactacgcacacatgcccatactgcatgatacagacatacagtaccatcgctacagtacatcgagtactgtagcaccatatcctcctcaccaatttctcaaccaatttccttcgcgaacaccgcgcacacctcgtgaagcccattacgaagatctctcccacacggtatccatccaccgtatgtcatctcgtatccaacttcgtcacccggcatccttgaccgtctggatctcaactcctccctgagtctagtcccgatccccaccgttgaccgaatttgacctccaagaatcctaactctagtcacattctcacatggtatcccgaccacactagacctctactcctccccaagcatagtccctgtcctcaccatgcattgaccaaagctaacctcaagtcacctgcacacaatcagacaaaacaaccgttcttgagtacatatatcacaacctgacccacattagtcaaatatactcacaccaacatctatatatcttttcaaaaccaattcatcgaataaatcatttttcaaagccaattatttatcacataatattaataatattaatcatgacaatgattttacagcatagctagagatcggttggatgactgtgctagagtaacagattaatctagaggcagtaaagagatggaaaaaaccatttgagtttgacttaaaagaaccatattcatacactccgtagtatatacagaagcagtatatagagtacggttgtattgtatgccgtcaagtttcaagaaaagagcatggttgccttacgtgtgctgtgtacacatacgtacatctcggacgccggattgaagtcgtgaagacgtgtcacgtgtccgtgaacgcgccgccgcagtgtcgtcctgctcggctgctcctctcttcatcacggccacgcggacgacatcgacgggcgcaataccgtgagatattgaactatatgccacttttagacgtggcaattaactatttgccactgaacccacatgtcatagacacatatggacccacatgtcattgagataggtgtggcaaatagttaattgtcaaatctataagtagcaaatagttaaaagccccaataccgtcagagggcttcggaaggaccgcccggcacccgtccgcctcctctacctcctctggctttgggccacagccgtggcgcaaatattgtggaagtggtcaaccgcaacctcgatcgtctacccctgtgttagagcaggtataataactggcgataggggttccacttaaaatttttcggtgacgtggagtggaggagagagtagggggagagagagaacgaatttgtcgcccggctctacgcatgacccgaggtcgtgggcctgcatacccacttcgcacgcgtccgtcgggacggcgccctcgtcaccacggtcgttgcctgcgtccgccaccatcgtcctctggcgccgccgccgtcacttgcggccaccgccgtcgtccgcctacgtcgaccaactgccctcgtccggctcgactggcatcgtcgcgtcgtcatcctcatccccctgtggctgccgcctgccaccgtcgccctcatccccctgtggccctcgccgtcgtgccgtcgcttgcatcctcagtcgtggctctcgtccaccgcagtcgcagccatcatcgccacccacgtccgcgcagttgtggctctcgtccaccccggccatccccgtcgccattgcttgcatcctcggccgtggctctcgtccaccgcggccgcagccatctcgtcgcctgcaaccgccgcagctgtggccgttgtccaccccggccactgccgttgcgccgtcaccatcacttgcgtccacctcggtcatggccctcgcccctgcggccgccgttgccgtagctctcgtcccgccgccatcgacgttgctgctgctctcatcccgtcgccgccactgctctcatcccgcatccgtcgcacaacctagctgtctttgtctcccgcgttatctacagggtcatcagcccaccagcttcgtcccgttcctctcaggcgtatcctcacagccgccgtcgttcggcccaactgttgacgtctcccgtgtccgccgtatggatgccctcgttctacacagccactagcgtctcctgtacgaccgtatgcccatctccatctccctcacccgatgggaagacaaacacaggaacggacggatggggtaggaggaagaagagaatgagataagagaagatggtgggtcccccgaagatagtaaaataattgtgttacagtgtttctattgtagatattagctatactacttactatagatgacatggttattttttttggagctggcagcgggttgtattataaaccttgctcttaagaggcaatatatcctatgcacacatgctctcacatgtacacacatgcacaccaactaacaaatgtcactaaaaaatctagaaaaattcatacatgtattttcaatagtattatacttagggttaaaatcttaacttcaaattcattatattttatccataacgaaaaaaaaaatctgacagttttaaggttataattttgtcagaattttatttttttgttactctttatgtagaatgaatttgaagatgtgactttgcacatagatgtaatactattagaagtacatgtatgaatttttttagatttttttatgataatttttagttggtgtacacggtgtgtacacgcaaaggcctgtgtgcataggatacgctcccgtgttgggatcctgcaatgggcctgcctagctaagtgcatatgagctagtttaaccactcttcaagcccagcccaagaaagcactcttagttaatgtcaaggaagattggccaacatcaatatatatacagctgtagaggatgaggaggacatcgaagaaacatgcaacggcggcggctggcctcggcggctagacgaacggtggcggtagcttggttcggtcaaacctcgtcgatctctctatccttcctcttctcctctatcatagaaacttctagtacttgtctccttagcagcttcttcttcttcttcttcttcttcttcttcttcttcttcttcttcttcttcttcaattccaccatcaaacactgagagttgagtgaatattgttgtgattcgaattagggattcgggttgctaacaatctggtatcagagctgtcgattcgtgggatttctagcatggagtcgatgggggagtattgcagcaacgccccatgcaagtggttgccagatttgggcaagggtggtgctcatggcaccaatgcccacaacatgttcgatggaatgcctagccaacctgagatgtccaaggaagatcagaggatatctgaccctattcccattaattccaccatgaacaaagaggaaaaatggctagacgatgctctagattggatattggagaagtttgaataaatggaggccaagtgcatgcaagaggaaaagatcaatcagatatttcaaaagttggaggagatcgaggttcgtaggagcaaggctttcgaggaaatgattgtagctatcagggcaaccaccgctatcatcaagggtgcatcatctccaacacccatggcaccacctcctccagcgcccaccaactgtttgatggaatgacccaacaacaacatcagttgggtggcaacgaattcaagtctcattggtgaggtgctttatctgacagctacctgggagctaggagacagaaaggacatggaccaagctccctacattgtcaccaaggacctccccaaggtcacgcccaccaagtgttcaacgctatgttctagctccgacatcaagcctgatcttatcgtggatgtggtgcttacgtgtgccaccactgctgtagcctccagggagtttgtattggctgatggtaccatcgataccatcaacattagcaccccagttgttccaaagagatgcacaccaagtgttcgacgttgggccttgacatcaagggagactctaaccaagttgtgctcgcgttccagaccatgatgggtatatctaaggttgttccatcatctgttcagccagtggagaatttctcatcaagaacagtcaccgacataaagctggatacaccaatgctcaacacgtgttcgttgaaatgccccagtagtgataagaggccgctgatagagcatactgagagaaatccatggccacctccttggtcagctggagtgactagaaggtggaggtgtggcatgtaccttggtccgtattcaatttcttttggaaaagagtatattttttgaaagaaatttgaaaagagtatattggaaaccaccatggcctccacctaataggaatgatattatgcacctcctgactaattcacacacatttgtaaattagagaaggcaaatttggctaaatttaaagcaagggaatgtgaaatattattagtgactgagctgtcttaatctgatgagcctattcaagttgggtgctgggaacattttgcatgcgctgcaaatttcagttggcaaggtaccaactaactacaatgcaaggcaattacatgatcttgtcagttatcctctcaagacaaggttttctgtagtgacaagaattgaatgccaaacacactgcacattgggactagcaaatggtaagattaaacatgagtgtttttgtgatgatgagagatggcttcatattttggtactcctaccattgattatggctacatggaaggttgacaacagtgcaattctaactagaaatgttgtccggatggcttttccttttgtgcaactccaaacaaggcaaggaaagatggaggatgatgtcaatatggacataaattcttcaactcaagctgtcaattctctgttctgttgcaaatcatctattaggagttcctcaacttgttcttccatggtacaaattcatgccagtaaattgaaaccctgtgatacactcactacaaggttttcgggctaatgccacaaaattttgggcaacaacgtggttttcgttgcaatacataggggttattgctaccgaagtctaatttggttgcgataggggggcatattaccactaattgcgtagtgttgcgattgtaatttgtttttgttgcaataagtaggaagtatcgcaacgaataaatttgcgttgtaagtagggtgacaatattgccgcgctttttgttatcgttgcaatagttatccatgccgcaacgaatttggagcgttgttattagagtcatgtatatagcaacacgaaactacattttgcaaatgagtcagtaggtattgcaacgtaaacctgaatcgttgcaaattagaatataggtattgcaacgcaaacctaaatcattgcaatcattcttagatattgcaacaaacaccggaaatcgttgcaactaacaaggttctctcgcaaaaatattttgtcattgctatagtttaacgaatcgttgcaataagtgagattggtggtgccacctgcagattgttcatgggcctttgtattgttaaactttaagttgtttacatcattgtggctcgggtcggggtcatgaattacgtaattaagtcgacccggccaactagatgggttgaatcgtgtaaaaaaacaggtacgattaaccctacccttagtagtcgatagatagataaccatgatcatagactagctggcgccgacgaccctattatatcttacacaatcgccggcgacgctgaagcactcgacgctggcgagaccacaccctgtccctatctcccaactcgatatctcgacgccgtccgaatcgatccctatatttatatatattcaggtacctcttcgatcacgagtgcaatgaaaactgttgattctttattttctatatatctatgtaattaaaatgagttagcaaagaatttttttagattaatggaagaagcttggaaagaattatacccagggtgcaaggaggctaccaaggtatctttcattgtcaggctatttcagattaagtgcatgtatagtatcagcaacaatgccatggagcaaatacttcacttattctgtcttttgctccctgagggacattgtgtcccaaatactttggataaagttcgtaaggtactccaagatcttaggttggactaccaaaagattcatgcttgtgtcaatgattgtgtgttacttcgtggagagtatgataagatgaacacatgtcccacatgtggggagagtaggtggaaaaatatagattcaggagaactcggggaagggagtggcattggaggagcaaagaaaaaggccttcgtcctcgtaaaatacttaggtattttccacttattcctcgacttcaaagattatatatgaatgagaccacatcgacctatatgcgttggcacaaggaagaattggttgatgatgggaaagtgcggcacccagcaaactcattggcatggaagcacgtagatgaaaagttcagggatcggtttgcatctgatccatgcaatgttaggcttggacttgcatcagacggcttcaatccatttgggatgttgaatgtgacttacactacatggtcggtgatcctaattccttataatctgcctccttggttgtgcttgaaacaatcttattggatgatgtcgatgctggtacctgggcctagatctccagggatgaacattgacgtatatttgcagccgctgatcgatgagcttaaacagttgtggactgaaggagttgaaacatgggatgccaaggtgaaaaagaattttacgctacgtgcaaatctgctctagacaataaacggttttcctgtgtatgccatgttatcaggttggagcacaaaaggcaagtttgcgtgtccttattgtcacaatgatactgaatacttgtggttaaaatacggcaagaagcactctatataggccatcgccgctttttggcttcataccacaggtggcgaaagaacaaggttagcttcaataacaaggttgaaatgagggggcctccagtggcactcaatggtgacgaagtattgaagcagtacgagagttttgagcaagtcaaatttggcatgacgtcaaggaagagg

SEQ ID NO: 76015 - DNA, 23297 bp, Oryza sativa
gatataacatctgtagcccccgactcactactcaatggaagaccaattggtgtagtgaggcagaggaaaaggaaaaatatcatataaagaataaaataaatgatgacttagctttgtaatattccccttggtgatggcggaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgatggaggcaggccggcggtgaagtcgtagacgcccaacagcggcggcataataggccagctgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtagtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggtaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcgtacgagacctaaagtggatggatgcagagacaaaggatttagacaggttcaggccctctcaatgagaggtaataccctactcctgtttggggatttgaatccgccgggtgtagtatagatctgacgatcaggttgtctcatgccctctagagggcctcctgcccaccttatatagaatggggggcaggattacaagatagaaaccttatccaatacggtatcggtttcctaactctactttacaatcttatcaaaccaggactttaggccgttccgtaatatacaaggaaacgtaatacccaagtcatgatctgttacatatttcatatatataagttatcccctataactagtcggataaccatgccgtgtgggtatggggtacccataatctccacagatagactggattacgtgtgttccattggtttttaaggttggggtgtgttttgatctattaagattcaattatttgacttccgctgatgtaatctaccattcaacatctctctcatagacttggttacttgtgttcgatccaacatataccacgtgaaacaaccacccaatactatgagcaccaaggcagtgtgccatgtcgtcgtcgacatcgagctccaagacgtagcccgcggcggcactgctgctactactaccaactgctgcgcggtgtgtgtggagccattagagtgggtggcgatcgggccatgcggccaccgctgtgtttgcgcgagatgcattgtccaggtccgcttcgtcagcgaggacaggcgctgtcacgtgtgcagagccccctgtcctctcgtcgtcgtcatcaaggggcactgcatcaacggcgccgatatcctcgctgagctgccatcatcaccgtccatgataactagacagggtagagtggacaacttctggttcaacgtcgacacggcggcctacttcgccgatgagcagcaattcaaggtggcgaggattgcttgcgttaaaaagtccttttataagcccaaggtacgtcctttaaattgttgttgagatagtaattaatgaaagattaatcactaattaatctttgtttagcacttctgctaactaataatatggaaaagttaatcacttcgatttgtggtcttgttatacaaaatatacgataaataaatgaaatttatgaacctttacagtataataaacgccattactgcacatcctttacaaaataaataaaataaattttccgaatctttaatttacaaattacaaatacacaaaggttatctaatttatgcgtggccaaacttcatgacattatttttttttgtctgtttgtaggagtggtggtatttcctactcgtctatgttccttttatgtttgcaggagaagccataggcgcgacgtgtgctggaagaacgagtcatatgtggttgaaagtgataatctatctcgtgtcaacatgtgttgcactgttgtttgctagttatttttggttcatggcacggttttcaagtcaggctgtaaaatcatgagtatactagtacatatacgtgcaatgcacgtttttctctatatattactattaggatgcaaaataatcaccttcaaaaataagtatattcctataaaatcataggagaaaggtatattttaatattttttttcctcaattctgtatgcgtcattcaaattccccagcgacgctgatggtttagctgactttggtttcgtagtttaccttgttcattttgtggcattttactcttctttaccaactatagttgatattggtgtaataaggagcaaattggtatggccaagggaatcattttttagcacggtatggccaaggaactggtcgaggaagattggtttagcattcagaagcctgaacacgtaggaactcaggtctttctgaaactgatacattctgctttccactgatgtcagtatcctattatcctatatacgttgtggtgctgatggattagttgatttttgatttcttagtttaccttgttcattttgtgatatttcactctattgtttctcaattatactattatagttgttctgtgcgacaaaagattcatgcagaaaagatcgaattatttgcgtagaaaaatagaaactcgaaggattctagaacgtcatacagtaaaaaaatgaacggtaagtcagattgattctactgaaagtcatatggtaaaaatatgattctactaaaagtcatttggtaaaaacatgaacagtaaaaatatgaacgtcataaggtaaaaacatgaacgtcatacgtagcaccggaactgaaagcttttgctactcagtaatattcccgtaggatgacctacaaatcaattactagcaatcaaccaatcgtgcaatgagcatagccatatgtacgatgactaccctctctacccattaacaagcaagaaagtctttctagtttctacgaacaactgggcaactggcgagcgtagtaacgaggtctttgaggcagggtactggtagcagagacacaagattcacataccagcagcaccaacgaatcacaagctaaccagaaaaaaccgcatgtatcgctctaagtttctttggaggtgacccggcatcccttggagtgatccagctccagcagcaaagcgacgatcacaccgggactcgtcttcccctgaacctagtgatcagctgcaaatttgtaaacaggaacaaccataagaacagagactatgaatctacgacgacaagcagggagtttaagcacatccggtggtgacttatagccgtaccgaagtcacaagagggtggtggaatatccaaccgaaggtggggctcttttgcaggtaaacagcagcagttggccagaagcctctgtgatgaaaattcagaagcacacacagtcagattcggatacagactccaggtgttccatttcacaatgcacatgacctagagacaggtgattattatgatcatgtttcagaatggaaacaccatagagtttactgacctgaagagcttgacgaagccgtatgcctctgccagcatgccaaagaacggccaaccaataaggaccaggaagaagccaattccaaaagcaatcgagccctgtacaatgaggtagatttttcatatcataatggacctctaatagaactgggaactgaaatagcacagtcttcatgatgaatggagtttgcaatggtacagaccttgtgattcttaggcttggtgaagaactgcacggttgacttcggtccaatggtcagtgaaacaccagacacaaacagaatctgcaacatggcatacgcacaccaattagtgatcaggatgaggttacagtgaagcatcaatcaggattcagccattcaggaaagtgaatcttacgtttcctattgcaaggaaccccttgtcaaacagcatgatgatcccaagaaacgagaacagaactccgaacccagataagcccagcccaatctctgttgaaaacaaaagtgatgaaatggttgagctagtgagatgcatacacattgtacaatacgtcaatacctcacagttgcaagaaaaaaatgtaaaaagttaaattaggcaggtaaattgaagaacgtgtattgtattatttagctactattagatggacctcctgttcaaaaacatgacgcgttgcgaatttgatataaaacatatgaaatgataaactgacaatatgctatctcagctatggacgaccatgaccgaaatttcatctagttctgaaaatatcgacacctgaaactttcccaacctgaatagatttcaagttgctaaccggaacttatttgctcagaaatttaacttcggtgtgcagagaggcagtgctaattatttgccatatacaatagtagcacaacaaattgcttctacttaaaaaaaacagtaatggaaaattcaccacagtccacagtaaccaaggacattatgtttgtaaacaaaacttgaagcgaaactccggaaatttggcgaggtttgtctcaccaaacaaacaccgattaccggtgatttgaacccaggagtcacagattcgatcggacatagtttttttttttcagcattttaaactatcaaacacgaccaatcatgctgcaaaaatgacagcatttcgcaaggctatcgacaggggaacagattagcgcatgatcgagcacgcaaagctacaaggagacacgcggcatatgcatcttccaccaaacaactcgtagagaacagcgggaaaacgtgaaagcaaatactggagtactacgttcccatctcccaccaaacggttcataaatcgcacgggaaaaaaacggaaagcgacgcaaacgcgggccaaatcctacaccaaaccgctcacaaatcgcgcgaaaaatcaaagggagaagaggaggaggaggagggtggttgtcgagtcgcgtactcttgagttcactcatctcgaaggaaaccatcccacccgccgctgagttcaacttcaacccgcgccgtcaccgtctgcaagagcaaaacaaagcacccaaaaaaaaagttaatcgaactactcgcgcggaatgccgctgcggcgaatcgcgatcaaccagcgcgatcgagcaggacgacggtttcccgagcgatcagagcgcacgcacctctccctcccggatggatcgccgcgcactcgagcgaggacgcggagcaactggcgagagaggaaggcgaggagagcagagagcagagagagaggcgaggaagagattttgattttcgaatgggggcgccgtttgcctcgaactcgctcgccgaccagggtcttattgcaccgggtggtggtgacgtggccgggtcggcgcgggcgaggaggtcggaagcttcgatcggacgcgccgggttccgagtttccgacccgacccgggcggaggcggcggcgttggcgacggttgcgttggtgtgtccgcgcctactggaatcttccgggatgccgagtgacttgctcgtgaagtttaggaccaggattagagatttcttaggcctgaggcattttgcgattgatcgatgagggcacctggccaatggcttcagtccacgtggaccactttcttttttttttgcttgtttggaggacgacgccttttcccacgtgtgcttagctccggcaatggaatctgggtgatggactatcttcgtttatgcttatgcttatcattcaaaatttgaatttttaactttaaatttaaagctgattttaaggtttttttcatcgaagtttatttttcagtctttatttttagatcgctgagaacacatatataaaagttttatttacaaattactttccgtttataaatatgtcgtttcgctaaaataagcgaaacggtggctccgctgaaatctaaagtaacacctgaactgtcacctctaatgattagtaacagcgacagaagagtcgaccaatttggttttcgttcacggtcaccgggagatactccctcccccaaaatactccctaaaaaaatagagctatatattcgtattttatggataaagcagaaaaaatacaatataataactcgggaaataaacagtcacgccaagcgtctacaacacgaacacccaatactaggaataaacaggttgcaacatccaaacgcactattctccatccacgtgaagtactaagtactcttttcgtccccatatataataacctagaataaaattggttaggacatatcctaagttgctatattttgaaatgaagggagtagatggtagttatgtgcctaatacaggcttatttcatttaatccctttatgaggtaataacaagccctttgagagttaccacggaggtaaccactgcagtaagtggaatagctaatgcaaatatgcaattgtcttgttttatcatgagctcacacttgtggaaaaacatggcagaaatgaccggaatgccattcaacacaacataacaactgaagatttcaagtgttatatcttgctcagcacagctgagaacttttagaggccttcaggcatccagatcagcacctttaaatgagcaatgagagattggtgactgaaggacagatgtgaccaaaaatgtgtttttcagagtaatatatatatatatgcactgcataaatctaaaaatagccaaaccaaaagaacgcacacagctatttgagctaccaaacatgtgaagtgagaacaacttcgacatgactgctggcatttttccttttcctttttttctttcttcttttcaaataccatgttcttcatgaatatgacacagcaccaggtaggcaggtagtacaatgaaagaatggaccttcaagtaaatataagcagtgcatgcaaataagatgtagccatcatcagtatttacaggtgctgatactacatactagtcccattgcagcaaacaattctttaagcaatgcaactgcttgaaagtctatcagaatatcatgaaaatggataccctacactcctacagacagggaaaattcataatatcaagtaatttaactcagatcatccaaagtaaatacaagcagaataaataccattgtgctttatggactctagctgaaattcataacagatagtcaggcccacagaattggttccttttccaatctagtaatgcaatctaggtccatgtggtgaaattcattttgctggtggtacgttccacatttcagacagcacaaaaatgggtgaaaagaatagcagagggtaaaaaaaaagagatggcaaactgtagttttcatccaggacaaaccataagcccaaaactgtcttataatttcaaatcctcattatgtaatctaactttgcaaatgagagtaacaatcccctggagagagaaatgtactatgccttcatgtccttgcagtttgatattcttcattgaaatgccacccgctgcatagcttaacatccaatgctcgttgaatcaacttcgataaacacctcttccaatttatgaaggaccacgtaacttgttataagatttcataggcctgtttagatcattaagattgaactaggtagttccctttcttctgctaccagtctacaactacagatccagataccaaaccaaatcatagtaagaagtaagaactggcagagttcaagtacccaggtttaaattaaatgcacaataatactgcatactcctggaactctggaaccactagtattacatttcaactgcattcagctaaataatcagaacatatgagctcatgcaaccatgcacaaacagattcaagaatagccttatacatatcacatatgcgagggcaaacatgcacctatgatatagcttaaacatttgtaacaaggtaccaggttcaagtaacaaacatcaattcatcatctcaagcacacattcctaatacttatataaaggtactagtgatcataagcggaggaaatcatgaataatctccaaggaaatgccaaaatagcagcagttctttggtggatctaagcgcagggccaaaccaaacaccttactcctccgctggagcaggagcagcagcagcctccgactcggacgcggccccctccgcgggcgccgccgctgccggagacggagcggcgcgggacttggcgagctcgaggaggcggcggctgacctccttggagtacgcctgcagcacctcgatcccgtcctcgacggaggccggggcggcggcggcggacgacgactcggtgacggcggcgtaggcctcggcctcgaccgcggcggcggcgcgcccggcctcggcctccgggacggccccgtagcgctgggagaggatgctgggcgcgaccagcgtctgcacgaggcggcgcaccacggcgtcccgcgtgcgctgcgacgggggccagatgctgagcgacgggagcagcgcctccgcggccttggcggctggtgccgcggaagctgcggcggcggcggagcctccctccgcggccgacgcgtgctggctcccctcggcggcggcggcgctgggggcgtcctccgccatggctgcgggtaagtgggagatggagaggggagagatctgtggcgtggagaggggagagaccgagagagagaaaagaggctgtgccggtcggagacttggagggtggggttcgatttggttcgcttcgcttctagaagatctccggaaggtgaacgcgcatttcgagatgggcttaagttgggccatggatgggatgggcctggcccaatatgcagaccttacaggaagaaaggaagcccagtatcatgccaggctggacttgggctgatactaccttgaactgtgctactactccctccgtctcatcttaagtctagtttcaaatttccgtgttcaatctttgatcgtccgtcttatttaaatttttttaaaaaacaagttacacataaaatattactcatattttatcatctaataacaataaaaatactagtctaaaaaatctcaaataagatcaaatgttggatatggaaattcacaactgcgcttaaaatcggatggagggagtacacttttcttctctctctcgttttccaatagcattggttttttctttgatcacgtatacttttgtgttgtttccgttggaggcagcccaaaagaattatcggtctatcaagtggagtgtagttcaaaggagacccaaactttgcaataccgtagctccctgatctgccgttttactgttgttcggtttcattaggaaggacacttagttaaccttcatttcaataaggatggctctttgctctcagttcttatcattcggcgatgtaacgggatttaatcccatcaactttgtccttgctttataaaagtttatgtgtttcaaaaaagaaaaagaagataatgcagcattggcaagctgaaaaccccagtgattctcaatgcattatctccactgataatgcaacagtgacataccgtcactctaatcacgtactactactacaagcataataagattcagcaaacaaaacttgtgacaggaccaggcattcatgtgttcctgtctcctctccgctctccagcagcagtggacacaatccaacacgcacaagtgcacaaaacaactcccagcgttagctgcccgatgcaaatggaaagctgagccctcggtgcagcaagcagaggaactgcccgtgctggttgtttggttcggtaaaagttgagaaaaaagaagctgcaggcaatggcagggcaaaatggccatggcagtgcagcagcatgcagggcataggctttggagctcaaggcctttctcttgtggaaagccgtgtcccctgtttcccgggccaattcacctgctcccaattactactaatcatctgtcgctaacctccaattctgcactaactaacccccttctaaaagtaatgacacgccaaaaaggttgcgtcatttgggactcagatgcctcaatttctgaagattaatgtatatgatcagtttgttactagccaatttctgaagcttagcgtgtatatgttctttgtgtttttcagaatgtgacagaaagaagaagcagatgaaatgatgaatcttctgctactgtgtttctttctttctctgcttctgattttttttcaaagatggcactgctactgctaggagtagcatgcagtttgtcttttcgagtcatgcggtgcaaagttgacaaaatggcaaatgattgtgcattagctcctacacctcatcactagggcagaaaagggcttttcacctttgaatttttttgactgttgctctaatcaccattactaatcttcaatgtgccaatgtgagcaccactttgccaagttgttaagcttaaacatcccagtaataaaactctctctctgctgctgctctctaatcagtaaccagtagtacactggtagtagtacttcagttctgatagatagactgatactgctactctgcattagaagattcagacaagtgcagcttctctgatagatacagtaaactctgtccctccatgcaggagatggccagccaaaggctactgctcctcctcgccgtcctgctcctgacattgctcgccgcgacgacggcggtcgtcgggggacacggcggtgacgacgtcgccggcgccgaagaagcgaagccgccggacgacgacggggcggcggcgaagctcgacgtgcgggcgaggaggtggccgcggttcccggcgacggacgggcagctggtccgtggcagcgcgcggcgagtgcccaactcgtcggaccctctccacaaccgctgatgtgattacggcattctctgccgattgccactctgttcttagcgtttcttgcgttagattctccatgttttttgtcataacatcggttatgatgtagatcatggcactatgtttgttcagagaattgaaatgcgtatagaagtacatgattttgatttttttttatctagcttcgattggcacctcgagtgtttgtaatcagaaattaatcaagatttttgcgtgttttgtccgcttttgcattcgattttctttgatgaactgaactgccctgacatggtggagcccacatgtaagtctccatccttcctctatcactgcgtcaaaacgtcgaacaccttgcgcgcgccaccgccaccgcaaccgccgccgcaatgtccgtcaccgccggggtcgccctcgccgtcgccgacgcggtgtgggcggagatcaggtccgcgggccaagcctccgacgagcacctatccatgtgagtaaaaccaagcgcccgccgcctcgctccctcctcttccttgacctcggttgcttcgaaacagcctcgaggccttgttcggcaagaacatggtgcgcgcctgcaagatcctcgacgagggcggcgtccgccgcgtcaccggcgcgcccagcggccgctcgctcttccttgtcagctcccccatctctcgattcctcctgttcttcttcgtgtcacagccaaaagtgagtgagtgaggatttgcctgacctagggttttgcgtctcggcgattcaggtgatgggggagtcgaggaggaaggaggagtacatctgcttcccagagcacctctgcacctgctactccttcttctacgacatcgtcggccgcggcgagcagctctgcgtaagtgtggcattctgacctgctgctgttactgcatctgaatccgtacatctttcaatcaggcacactgaatttcatggacacaagaaacggataacctataaacacaaaagaaacatggcaccattgcaattgcaattatcagctactactgaagtactgagtactgaaatgctttttttttactgttttattttgactggttactgaaatgcttgttgatctcttttgcatagtaattgctttaattttgtttcttcatggcgctattacaattgcaactatcagcccgcggctactgaatattgagatgcttgttgatctctttttcatggactagttgcttttgtttcttcatatggtgctatcgcagttgcaattatcagctcgtgactactgagtactggaatgcttgttgatctctcttttcatggagtaattgcttttgtttcttcatcgcgctattgcaattgcaattatcggctcgtgactactgagtattgagatgttcgttgatctctttttcatggactaattgctttttttttcttcagtgcaagcaccagttagcagcccgacttgcggaggccgtcagtaagcaccaggacattgaggtaaccgatgaggagttggcccacatgcttgctaaactctgaaagtttcagaatttcggtacttcagcaatgcacatgaagtttgggacgaattgatttttaagaaggattctaacactagtaccgttgtgcaaaatgactgatctcagtgcaaagaactgaatgatgcttgctatataatatcagctagatgagttatcctcgaatattaggcgttctcatgtagctgacaggtataatgtgaggcgtcatggttttatcattttgttgttatgcttgttgttgtattgaatgttaattagcttcaagaatgaggggaaatgtgtgatattcttcattcttgtgaagagatttataaatttgttcctttgttactgagttaccctgttgccctcctttttagttactatcttatcttattttagacaaattgttccttctctctagtattgctttagtaacaggggaaatatgaaaaggtattacacaatgccgcgtgattatgaacttttagttttttctaacaatattacacgtattgagaattctgactgtatggatcttcatgaatagatatcataataacaacatacgtagtacaaagatatgaatgctaaatcaggagatcctaattgtccaagtcttaggccacaggtttcacagtacttaagcaagtacgttgtactagttagtttcagaattgaacatttcatgcaaacaacatttacgactagcttaagaataaatactgatgataataaatactagtacaaagtataaataacattttgatggccgtctatgattttataaatcctggatacaatagcgctgcaatccgcagctcttttatatttgctactaattgattagcttcgatacaatttaaaaaccatataatatccaagcatctaaactagatagctttaaagagtatgtgacatattttggtctgtttattcttatgcctttcttttttaaaaaaagaaaaaagaaaaaaaaaaggatgcttgttcttcagctttcagcagaggattttaatgctatgcacttgattctcagcaatgaaagaatatggattcttcatctttccgtgtacactttcatcagtatgtcgctgaataacaatttcgttctttcacattccttttcatgggtacatttatatgctaggaagaaagaaaaaaagaaagaaaggcaggagctccgccagtgccactagaatccatgtcattactagtcacagcagtactatggtatacacaagagtggaggtatcagccattgtatgatcaatataactggtgttgtgataggctcctaatatcaactctgatagtgcagagcattctgtcaattttcttgtgaaagatgataatttattgaccggaatgcatgatgtgcatatacagtttggcttacctgaagaacaacagtaatgacctttcatgatactctgtcctgttcatctgcagttttactttgctcctcctgatcaggcataacaaccaaaaaaccaagtactggtatccatgattgctgcttctgctaggctaaaagtaacaactgaaaacaagccacgggattcgatattagcatcgcaatttttgtgaatatgaacatgtattatttcctaacatattcttcttggcactccaaaaaagatcaaaataaattgctggtgtttaatccggccaattgcatggagacattctgaagtaaaatcacatcgaaagactgaatttgcaaccaacaaaatggacagcagtggcgatgaacaaaacccaaacctaacccaaccatggccgatagtgcgttagacggctgggctcccgttcctcgcatgggccatataatgggctttcgtgatggatgatgggccaaacaagcctaaataggacaggcagcagcgtgcagcgagtagcgaagcagcgctagttttagtaccacctcgccaattcgagccgcagccaggcgggaggaacgctataaaatagggcgaggttgcaccattgtaacccatatctttctcagccttttggctatttggctattggctaagggtgtgattagttcgcgaaaagaaaatattaaacgtgggaactaaacaagattaactgttctcatcagtttaactaatatctgatgtgtgggccatatgctcacttcgatattaaatttattatttgtgggggagggcttcgatattaaatttattatttgtgggggagggctcatcacagtggcaagcccttgccactggggccctcgcgcgtcgctcaggcgttgcactgctgcccgggcctggcgcacccaaccaaaataagttgaaatttatttaatttaactagcaaatatgaaatatgactgctttacaacgggatttcgttgcactctattattatatgtttttatctttttagtgcaaaagaaaaaagataaaaggcatatgtaatttttagtgcaaaaggaaaaaggtaaaaggcagcaatggaaaagaaacacgcaccttgtagtatcgaaataaaatatgttcgaattttagaaataatttaatatttaaggaaataataattattttgacatgaaaaaatctactgaatctattgagtgattaaataattgattataatttcctagcaattttaaatggcttaaaatagttccaaacaaatttttgtagattttttaaaaattaaatcagttgctctgaaaaataaactgattagggccttagtaagtttccgggacaacttgagggaccaaaactgaacttatctgtgcgaagcgttcacatgtcccaattgtgtggcggcccgggaacggcagcccgatgcgggagaattcgcagccgtccgatctgatcgacggtcacgattgatccgtacatatgtataaaaagccgtcaaccctaaccctaaccctaaatcatttcccctcccccctctctctctcacgactgcatcggcggcgcgcgcggcgccttttcccctccgccgctccccctctccctccccaccggctacgccattccccttccgccgctccccctctccctccccactgccgccgccgctccccttccccctccctcaaccggcgccgccgctccccttcccctcccctcatcggcggggacgttccacctccctctctccctcccgtctcttctcccttcggcggcggtggaaacggccgatggccgcggtggtggcggcggcggcggtagctcgctccgccccctctcgccttcctcccacagcggatccgtcggcgtcgacatagaggcggtgggccggacggcgtggaggcggccggcaggagacttctccccctctctctctgtgcggcggctgcgggagggccggtgacggtggtggcgggtcggacccagacggcgtggaggcggccggccggacctcgtctccgccagatccggcggcactgtggccaggacggcgtggaggcggcgggccaggcgtcgcctcctccagatccggtggcatgggggcgctcggcccgacggggcgagagggcggcgtggaggcgggcggtgatggcgtcggcggccgccgatttttttttttttttgcaattttttccatcgttattgctaacctaatcggattatgtcggtgatataggtccggggtatcaagtttagagggaggaggctgcccccaatgccacgtggccctcccccgagaggagtcaggcccgaggtggggtggcggccactccttccccaaagactagtcagaggaggctgccccccgatgccacatggtcctccccgaggggagtcaggcccgaggttggatggcggccactccttcccagagactggatggaggaggctgcactccaatgccacgtggccctcccccgaggggggtcgggcccgagatagggcggcggccactccctggccgagactagagggagaaggccgccccaggctccacgtggctctcccccgaggggggatcgggcccgaggtcgggcggcggacgccccctcacgtgactaggggtcgggctcccccgaccacctctctaggtcaccacgtatggtgggttaggtgtccgcctctaggtgcccacctacccgcatttatggcgtcccgagcggtcgcgccacgccgtgcggcgtgcagtgcactcaaccggtctgtgaccggtcgaatgaccgatgggactggctagtgcgcctgtgcgctgctcgtgtgtcaggcggcgtgtagcctgacatgtcccatcaaatagtgatggtgagaggttctcatcctcttatcccagccggagtcggtcctcccgctctggtcaaagcaaggctcccgtttcccggtgtaataggagcccagaagtcttcacccattaaatggtgactgacaggggcacccctcgtgtcaggcggcaagatttgacaggcccaatcatcaagacgacgtgtgcttagcttcccaaccacagagacaagacatgcatttaatgcaaagattataatacttctccaccggagctaggttaggttgttgtgcccatgtggtaaccccttgaggtataaaaggagggccaggcctagtggtggagggggaacttccgagcgaactagcgcttgggtctcgcaaccccaagcacttgtgttctacattcaatcaatcatgcacaggagtagggcattacgcttcttagcggcccgaacctgtataaacctcttttgtctcatcgtcttgggggggctaaccccctcaagatcacacagctctgctcaccaagccctcgaatctcacccgctgcccccggccgaactcacaaaggggggcctcacggttccctgatggaggagttcattctccgacatctggcgcgccaggtaggggacacgttcgtgatttttgaggttctttcgagcgccggcgtggtgagtgtcgcgccgccgctactggggaaggcgcagtatcctcaggagtgtcgcgccaccccaggcagggggcaaggccccccacatccccaccaggtaagcttggctaccaggtctttgtggcgagtcttcggaatgtccgagggcccccaaagctccagccctgcctcaccgagaaatacgacgatggcaccgaccccttcgagtccctccagatctgcacgacgatcatagaggcggcgtggggtgacgaccgggtcaaggcgagtttcttccccattccctccagggccaagcgcggggatcgctcatgaacctgccacttgcctcggtctactcctgggaggactcttgcagttgagctccgggtgccgtcgaagcccagaaccccctgtgctggctcttccgtagcggctagctttggtcccgctggctggctacggtgcccggcccggctcaactaatcgtcctttcaagcttcaagtattttcagtttttcaattcatcagcttaatatagcttgaagtcttatatttattttccccctgttcttttctcatggccctgcgacgctcgcgtgttacgcatttgtttgctccctcggtggtaagagcccaacctctctcccatgtacatgaacgattcttcgctaagtgtgggggctaagttttctagccttatcctagccttaagttgagccccgggtgccgtcgacgcccgggaccccctgtgctggctcttccgtagcggttggctttggtctcgccggctggctacgatacccggcctggctcaactgtggacggggattgctggctctagagttttcggctctcacactcatgcgaaagtaattgtccatatagaaggaaaagagattggaaggaggccaccgaaagaaaagagcaaacagaatgtgtagcgtggggacataggctcgtgggaacctgatctcgtttgctaagtggtcacaggcttcccaagatggttcggaacccatggtggggggccctcttcgagctaaggaaaataagttcacaacctaaggtacgggctagcgagtcgccctcaggctgggatgaaaaaggcacatgggtcctagtgccagcaaagaaagaataagagatcgggcccacatatcatcagactagaaaagtggcgtcaaccctgaccacctggggaaggttttggtcagggctaacgccgggggctactgtcgatgatatgggcccaggggtatcaagtttagagggaggaggctaccccccgatgccacgtggcccttctcccgagaggagtcaggcccgaggtggggtgcgggccactccttccccaaagactagtcggaggagggtgcccccggatgccacgtagccctcccccgaggggagtcaggcttgaggtaggacggcggccactccttcccagagactggatggaggagactgccctccaaatgccacgtggccctctcccgaggggggtcggtaccgaggtaggcgggcggccactccctggccgagactagagggagaaggccgccccaggcgccacgtggctcccccccgagggggatcgggcccgaggtcgggcggcggccgccccctcccgtgactagggtcgggctcccccgaccccctctctaggtcaccacgtacggtgggttagatgtccgtctccaggtgcccacttacccgcatttatggcgtcccgagcggtcgcgccacgccacatttaatgcggcgtgcagtgcactcaaccggtctgtgaccggtcaaatgaccgatgggactggctagtgcgcctgtgcgctgctcgtgtgtcaggcgacgtgcagcctgacatgtcccatcaaatagtgatggtgagaggttcttatcctcttatcccagccggagtcagtcctcccgctctggtcaaagcaagactcccgtttcccggtgtaataggagcccagaagtcttcacccattaaatggtgactgacaggggcacccctcgtgtcaggcggcaagatttgacaggccccataatcaagacgacgtgtgcttggcttgccaaccacagagacaagacatgcatttaatgcaaagattataatacttctccaccggagctaggttaggttgttgggcccatgtggtaaccccttgaggtataaaaggaggtccaggcctagtggtggaggggggacttccgagcgaactggcgcttgggtctcgcaaccccaaacacttgtgttctacattcaatcaatcatgcacaggagtagggtattacgcttcttagcggcccgaatctgtataaacctcttttttctcatcgtcttgggggggctaacccccctcaagatcacacagctccgctcaccaagccctcgaatctcacccgctgcctccggccgaactcacaaaggggggcctcacggttccctggtggaggagttcattctccgacagattgcatatggacgaaaaatcggatgaaattagacgtgacgaccggaaaaatacgaatatttatattagttatagataacagcattttgaacacttgcttgttcaaaattttaattttttttagttgattcgccttgggcctttgtctccgtattcgaaactttcgaacttctgcagttacatgggctttgggccgagtaggtcggcccatgtttacgaccggtcaccatttatttcaagctcgctctctctttgctgcagctatcgcacaagcttctagcttcgatagctgttcagataaatgataaacaaacgccttcttaaaaaaaattgataaataccataatattctactccctccattttataatccgtttgactatttttacaaacttcttcaacttcgaccaaattcatagaaaaataaagtaacattttttttacaaaacaaacatattatcaaaatatattcattttttagtataataaaactaatttagtgttgtaaatgttgctaactttttataaatttaatcaaattaaaaaactttgactaagaaaaaaattaaacgacttatagtataaaacggaagagtagtattctatatttttttgtcttaaaaaatgataaacgccttgatattttagtattctatcctcttttgtgtgctactgttacagtgctctcatcttccattgttgttcttgctcttccattttgaaacattgagacctgaatgcctgataaaatatttgataatttttcgtgggagctcatgtctcacctattccttgtccctctgtgactcgatcagcttgttcttatgctttcaccaacggattctaatgctatgcgcagtatgcactttgcctcacagcagtagaagaatagattcttgaatgaaccaatcaaagaatgcgtcatttttattagaatcctctgtcagagtgtcactagaatccatgtcttcacaattcacaactagcagtggtgctatatgacatgcacaataatagagctaccagccattgtatggtcaattcaaccggtgtcctgcaatctacgggagcaagtgtcttgcgtgtaatttcgctgtgaaacagcttttatcgatgagttgaacttcatattctaaatcattcaaaacggtagcctatgccctatggataatcgtaattatgaattccttcatgatagattgatatccaagttggcattcgtttgtcgttccaactatatattaacattgttgttatggttctcaatcattatattaaagactaactatagttcaaacattttcctcttcaacatgcatgagtttgttcgcttctgaaattacctcaccatagaaaacatatgacaaaaaaactgaagatcatatttgccaaaatgcatacttaaatatatataatgaactatctgtacactacaaacttataaccgcaggctcaagtcaagatcttcctccgtgcgcttcttctgctcctgagagcttgctttgaagctcccaggccagactgaccctctaccatgttcaaccgcaaaaggcacccagctgctactcatctggcctccatggaatttcgccacgacaacaccatcagcagaagaatagccacggttcaccttcaggatcgtggcgtgagggttaaccctcatgtggtgaagaaacgacgacggtgcagtcggggagagcccaaccatgagatgctgctgctggaagccgtgcgacttcctcggcgcgcacctctccctcttgtgggcgttctggtgcccacccagcgcctgcgagctgaagaacttcctcatgcagtagttgcaggagaaggttctatgcggcgccgccacggccggcttcggattcgactcgggaagcttacctgcttctgctgtcagtgcatcgacgacacccagctttagccatggaatcgaggtggtgtgatcatcctcggcagctcggtttgctgccttgtgttgcaccacttcaggtgatctctccattcctgtctctctttgtgtgtgtgtattaggagtagaagaaagagtggattgctctcaaggtttgtgctattgtggtagcttcttctttgctataaaaagaagctgggggtgtgtgcaagtggcaataattcaaggggaaagagcaagtgatcagcagtttgaagtggaccaggatattctagtttgcacacctatctatacttttttttgttttgagaaacctatacttcttttttttttttttttgcctagctagctatcaattttcctatagtggtggccagcatgctcccctcttaacaaagattttcttatttatacctgttctaccctttttttttctagttcttgatatttgataagagtaaatatttcataaggtgtgcctctcatgtatactgtccggttacaataaagttcagtttcttgtccagctcatccctgcatcctcatcaagtctgaacctgctttggataacagttctgtacctctctatccagtactacagttcagtatcctcatacagttccatggtttgtcattttcctgttcttttgcaccaatcatatgggaagctactgtttgtgtgtctgtagtgtccttgtcaatagaagtacaagaatatatgtatagaaagaaggacatcctttaactgaacaaaaaaaaagtcacataaagaaaccttgacttcaattctgttatgcgttgcaagtgaagttgtcttcctcttttgc

SEQ ID NO: 76016 - DNA, 29573 bp, Oryza sativa
gagctgacttgggccctgattggaaacatagcaacccagcccatttacagcccaaccaattcttaacacccccacacgctgaccttcatcaccgacgtcgtctgctccgtctgcaagatgcccgatgtcgccgagaaggtgatcaagcaggccgagcaccggtacgggcgtacggcgtgtcgcggaccgggaggtgctgcgagctgctggtcgtaggatactgccgcgtggagatgttctctgacgcttgcaggcctgcagggtatggaacgggatggagaggcgcgggctcgagccggccgccacggcatacaaggagatcgtggtgacgttgttcaagaataaccttgtcgcggacgccatgaaggtgttcgacggaatgcggttgaggggcccgggcagtggtgtcatggctgtgcaaggaagagagaatgtggggcgcgcagatggtgttcgctgaaatggtgaagataggtgtggaggtggacggagaggtgatgggggatttggtgtatggactagctgcatgaaacttgcaaccaagcagagaaaacatataatttggggccaaatcattgtttccattgcaaacaagagatagatggagcagttcaaagtcactgaatgactgcaaataaacgatcaagcaactcaaaactctgttccttgttggacaggatgcacggactcaagataaaactattcgatctgaatctaccacagacaccatcaagatacaggaacctacaacgacgactacagctattattctatcaaaatgcgccaatatgactcaggcctcaggcagcgccgacctcctgcttctatgctttagctgttcaccttcgtcttgctcttcttcaccttcgccttctcttcctcttcttcgccttcctcttcatcgtcttcctctttatttgcctctgcatctttgttttctttatctccaccttcattgccttcgcgttgcttcttcttgcggtgcaaaaggtccttttgcttcggtgagccctgtgaatgaaaaaggaaaaggaaaaaaaagagtcagatagagattacaaaatggatcaaaaacaaagaatgtgaagaagaagaagaagaagaagaagaagaagaagaatcctcacccagatgaggatgaaggtgaaaaagaccaccacgacagccgccatggcaaaagcaacccgctccttgacaaatactccatccgtttcgaaatgtttgacgccgttgacttttttaaatatgtttgaccgttcgtcttatttaaaaaatttaagtaattattacatcttttcttatcatttgatttattgttaaatatatttttatgtaggcatataattttacatattttacaaaagtttttaaataagacgaacggtcaaacatgtgctaaaaagtcaacggtgtcaaacatttcaaaacggagggagtattttatacctcgagaggcacaagaactgcaagaagtaggaaagggtgcatagagcgaaaccggtcggaacgaagcaagaggccaccttggtaagttgaaacacatcacggggacgcttgaggcagagatggccaatgatcgcgatgtgaaagaagatgacgggggtgaactgaagccaggtggatgcgtagtcggggtcatctccggtctcccagcggtcgggaccgtggaagttggttggggtgccggcgacgtggtcaggccttggcctgatcagcgacatcttcgctgcacgcccgctgaggctgtaggcgatggcgacggagtagccgagggtggaagtgacgaaagtagatgcgaacacaaatttggtctgccaagaacaaaaaaacaacaagtagcttgaatcagaaaacgccgagactgcctggatgggttatagcagcaagaaagaagaataactcgccttggtcatgatgtgaccttccatggcgtgatcttgctctgcatgaagagaactctatagttgtgattggttgagaggagagtgtaggtagagaaatagcttcattttaggataagttactgtgctagaaatagctacatttttggataggggtagtagctggtatatatgcatattttctgctttcatttgtttacagaacacctgcttagttcgttattggttcatagagctgttaaaacagttccgtgcgcatttgtaatgattcagggtgatagcaggaggaccggaggaggcttgtgcatgtattatcaactattaggatgaatctgagatatgttttccaagcttcaaaatgataatatagcgacattagttaagctgatctttagcaatgtatgagtctatctgaaggcagcataattcagttttatgtatggtaggagttttagaatccatttcagtgtgataattctctcctgtacctttcttttaagcacatattcagattatttgtaatatgatgtgcactaacgtgaatattaagtattggtgtcaatgttcaatggggaaccaatctttcatgtaatatattcactcgcgcatggcaaagccacgcgtgttttctagtgttttctaaatgttaactgcagttaaaaaaaaaactctattcttatagttcatctaatggaagaataccttagccagggaaactggatccttgctcacaaatgcacaaggtagaaatactggattaggtggtactgatttactgtactccagaagttcttgcagctgcgatgaattctatggaaagtaaattaaaaacatgtaagaatcaaatccctgaataaggcgttcagatttttttgagcacaaggtgccattgccagcaaaagcaataactacaaaagatgtaccaaaagcaagtaagcaaattcctatattgctagttagcatgagcaagcagatgcccaaaaaatagctcaccaacactaatttttcgtgctgaacgagtagagcttttgttatgaagtttatggctatagagtttaatgacctctgagaataacttagtttccatgtcttggcatgactagatttagtgcccatattttgacatgactaattgatgtcaaacttaatcaattaattaatcgaagttagtttttttttgtccaaaaacaaaatcaaagacagattcctctgcattgagtacaaagaaaagaaataacaaaatgcaagttctgagctaggtactgacctttggcaccatatgcttgctgatcaaatactttatttaagtcaacctgacagcgtacagactgcaccactgtaacaagagcgttgacttcaagaatctgcctttccaaatcctcaagattgtcttctactaagtcaactttattcaatatcacaacatcctgttaaggaaagtttgacgctttctgttattatggttgtttgcattttggaattcatcagcaggacaaatttcagcacagcagaatcaacacaaaggattccaaattttgtagcaaagacaaaatggtacaaatatgataacaccaaggaccaagttaccgaaaatgcaatttgatgaaatgcttcagggaatgatgatgactttttgtgctcatcaatttgcagcctgaaggcttttgcatcaataacctgatcagtaaaaaataaatataagaaaaatgtccaatatacagtccttcaaacttttatccaaagagtaacagtaaggagcaaagaagcaggcacattttccgaacttgtgatacagccagactaacaaataagaacataaggttgaactaaccataacgatagagtaaaatttaattgatgactccaactggtcgtctagccacagaatagggacaagaggtgacaagaggtgcaggatcagccaatcctattgtctctagtaatatgtaatccattctgcagcacatagaatgattcctaacaaattaggataataatcttcaatccgtaccgtcgtaatttacaaggcactatagtataataaactagtaatattattaaaaaaaaccaatatttttttaatgaaagatcaaagtaagagcatgatccactttattgcatcagtgcatagcgtacacaggtaagtgcatcaaagttttgaatcaaatttttagtatttccagaagaactagaacaaacaagcaatcacatcaactaacgaaaaaatgccacagggtaaacatagttttagagctaaaaccagaatgtcggtagcaaatcagaacatgccactaaggctttgtacagaaaatatgagggaagaaaacataatagtaggaccatatgttgtatgctacatatccatgcaaaacagcaatattcgtacttacctttcctttgtctgcacaagctgctcaagtgcttgaaccaggctgtgtttcaccgtgcaacaaacatatccatttgccagctctacccactcttcaacaagcgcgccaccttgccccttattgatcattgctctttcaagtccaatttcctctctgaactcattcaataccactgcaattctcttcccatgttgcgcactcagaatgtagttgactaactgaaaagtgatgcgcgggagataagctatcccataacataccaattaattgaacttacaaactgaaatttcacagaacacttggttaataagtacaggtgctgctaggaaaatggtaaggtgagacatagtagaagcaatgtcaacataagctaaatagtaaatgaccaactgacagaaggactaatggtctgatgttagaattttttttgaacgtaatctgatgttagaatttcaaatcaagatacggaccaagatagatcaaacaaggaattctgttgtgagataagaaatatcctaaaaatatggcttcattctgctaaaaagcacaggataaaattgtaaacacatgtataaatcctaaatatatcatcaactgtgtaaaaggttatccatgaccatgagtacctcagtaacgttaagtttttttgttcaagaaactagtaactcaacagttggggatataacattcaactacaggtcaaaattgatagctaactagctcggtcgacgaatcatttcttatactactacaactacaaataaattgaaaatgagctcctatgagaaacagagccctcgaaacgaaagttctactcacaagaccgctcttaaatagatacggggactgctccaaccaacacagcatgaggcaaactacctaaacttaagaaaaaaaaaacagcaagagctatggcgacaggaaacccgatcggatcaaacttccagtcacaagtgcccccaggctccagtcctccaggaatcttccattgagcaatctcgtgagtcgtatcctacttagcgccagcaatctttcggcctcaattctccgagcagagtgttttccagaagtggcagtgggtgcggaagcggtaaaggcgtagcctacggagaaaacctcaccgtggacttgccggcgccgaggtagacggtgatgagtgatgacggtgacccctataggcgatgacgcggagggaccgggcggcggaggactgtgcagcgtctccggcgaggggagggcactcgtcgtcgttctccatggccgccgccgccgccgccgagagagttcgagaactacggaagggttggtgttttgaggccgtatagaaaaggaaaaagtgcactggaggtccctcaacttgtcatcgggacaatgaaacgtcttcgaaccataaaactagatatgtgaggtccccttaactgtataaaaccggtcacccgaaatcaagaccgtaaaactagatatgtgaggtccccttaactgtataaaaccagtcacccgagatccttcagtggttttgaccccgattttagtctacatggcagctgagccagcatgggacccacatgagccccacatgtcagcgggccacgtcaactctctttcccctttcttttttctcttctttttcttacttattcacagcaacctagttcggaataattaattatttgccactcttacgtgctaaatgatttaccactagatccatatgtcataaacacatgcgggcccacgtatcataatgtggcaaataattaattaccacatttttaaagtggccaaaagttaaatgtccctaggtagttcgctcaccgacgttcatgcgccggcagcctaggctcggcgacggcgacgagcggcaccttccggcgtgtggacagcccgaccagctcctccatgctcacgtcctccgccgccacgcgaacccctgcagcaagctcgccacgcccagcgccaccatcttcttcgccaggttggtcgccggataaatctgccgccctgactcgaacggcagcagctcgaagtgctgcccgtgcacgtccactacgtcgtcgcagctgccggcgccggggaggaagcgctccggcaggaacgcgtcggggcggtcgagccacgacgccgggtcgcgtgcgatggcccacaagttcaccagcacgcgcgtgccggcggggacgtcgtagccagcgaccaccgtgttctccctggcgtggtgcgggacgagcagcggggcgcggtcgagctcgtcggttacgcctgttcatgacgatgaactggaacctcggctgagtattcctactagacaaaaccacccccgaagcaatcagatccctaaatcacaggctcacacggtatcaaaaccccaaccaaaaccctaaacaatcacctcttcacaacgaagagcaatccctccacatccttccgcctctgaaacataaaaaagaaaaagaaaaaacacagcgcatgagtgagctcacaggatcaccaaccaagcaaacaaccgaatcggatccgcgaggagggagggaggagggattgctcactcattggttgaggtcgatgttaggatgtccttgacggcggggtcgaggcgctgcagcacggtgaggttgagcagccgcgtgccctcggcgtccatcgtcaggtttggggtcacctccccccaaacctcaattggatgaactccatcatcatcgtcgtcgtcgttggctgcggctgcggaggcggcgacatgccggcatcccgcgtaggcttgggcggtggcaggcgctggatctgagggagcgcagcaatcaagttgggaatcgcggcaaagagagagatgacgtggacagtatgacatgagggcccacgtgggtcccacgtaggcttaaaaccattgaaggatttcgggtgaccagttttgtatagttaagggaccccgcatatctagttttgtgatttaaggacgtttttttatctcgacaacaagtggagggaccttcggtgtactttttcctatagaaaaccgtatgagaaacccagttgtccgatctacatctgacggctcaaaaaagcccaatctgatggcccaaaatgcctcctcgttaacacttggcccatatcatttgaatcccagtatgaagatttctgtcttctcagactcagtttaggccacacactgacaaatctgaagtctttcaggacaatcatttttttttccttttgagaatcaagagcttaatatgaattaatcaagttacatttgaaattcagtccctaattcttctgggataaactacttcctctaagtttctgttaaattcaatcatatgttcgaaatggagcctcagataagataagagaagtaaatttgtatgttacaaaaattagcattttgatgtgtttgctgaaagcatgcccaaaataaacctaaaaaaatatttctaaaattctgccccagctaccgcacatcgtaggacaatcgctctcccatgcacgaactttttgggatcaacgaaatgggagcccatggtcctcctaacttgtggagagggagaaacatgggattggggtttcttttctaaagaaattttaaaaaatctggattgatggcctactggatccatttttccctaaaaagtctaatatcgtaggatttatattattcttcttctaccttatagttcaccaactatagttctatacaaacctcattcatcatctatctatcctatacatcaccaactgcagtactacaaacctcattcatcatctatcttatatacctatagttcaccaactgtagtcgtacaaacatcaaatctaacagcctatctacgttgcctatttggcacagctccagctccaacaccacggccacctctcttagagctagagtctagctaaacagtttcagcttcatcagaaatgggagtggagttgggtggaacactctcacaaaataaactagagagatgtagttgggtttagactacttcataacttcactccagacctaactgctggagcagaatttaggagttaaaagttctgccaaacagacgaataatgaaagaggtggagctgttggagctctacaaaatgatgcgttctcccaagtcccggccgccccacaccgccgccatccactcctcctcctctctgcgccgcctcccacatccacgtttgagagcgcaggttctccggggtccgcggcggccaagcattgtctcccacgggcggccgggccagcgcacaaatccggcggccgaagcagcagcagaaggtcgcggcaaaacctccgcgtcgcgtccccgcaacgagggagcacgcgaccgcgggacgagcagcagccgatcagcccgccgccgcagaaggttgccaacttgccaagacggcagccggcgaggcctcccgctccaccatcctgtccgggtcggcggaccgcggacaggccgtgctgcacgttcttcgcttcgccggccaaggcggccaagcaggtattcctcctctatttcttccgccttactcttctttatctgaatcaccacccagttctttatttctgtcgacaattcttgcgcatctcatgctccgatttagtcgcagcaggaatccaagaattcttccagcgaggcatcccgctccggggctacaccaccggcgaggccgtcctcctcagtggagatgggtagaagacgatcacgccggtaaagcctcctctccccagtccattttcgtccttagcataatatgaaatcgaaagaaagaagaacgaattcacatgctctgcttgcacattttgacgcaccaaaatacctgcattgtttacacccaaattttagcaaaatttgtttcatatgaaccacaaattcacattcagcatctgaatcacatctctgtgattgcctggacacctctgttactggcgattgatgttttattcagcttctctgcatgtcattgtcatttggcaatctgccattctgaaacctgaacatttttgtgttcattcaaaaaaaacctgaacattttgtacctttcaggagctagaggttgagtatcgagtgaggagagagagatacccaggccgagtttgcttgccagcggcgagctggtggtgcgcacctgcaagtgtggtgtccacaaggagttcagcttccaccattcccactgagattgacaaggtcattgctatctgaaatactcctgtactcgaagctctgagattgagaaggtcattgctgtctgaactacttctttagttgcctgctttgtttaacttggctacatagttgaggtacactgcaaataaaatgctttatatccaataatttgtaggataagaaacacattccagattcacataataataaggatatagaccctccatgcatttgttgattctttttaaacccaagaagtagcaagaagtgacctgatagggcagccgtacggcataaatatatagttctgtttgtggttttgaattatcaacatttataactgataattatcatgcaaactaaaaatttgagaaaaatatgcgcatgctgaatttcttaatgagatcacagtaatcttcctttgaaagaaaaaactattttgaaacatgcatattgcccgcacttgcttttaattactgtgagtttcaggtacaaaaggtcctaaccttcacaatatatattgcccacacccttgtttttcttaaatgaacagtatgtgttgtttgttaattttatctgatcagtatgtattgtttgtcacgtgatacactgagttaagaaagtcattgctagcggtgctgctttttggtagctatatttttctgacttctaagtacaaccatatttttttcagggctgcaagcctgcaacaatgatggatttttttttccattcagacccatatcttagcattcggctggtgtttgtgggtagaaattattgctgaacagttctttaccagcattctctaacagctatttacatgcatagttaaaccatttgtatcaaggaagttttgctaaattttagtaattgttcagttagccttttgcttaccataattccttccaagaaaggcctctgggtgtattcataattcatcctaaaaaaatgagagttccttatttaagtctcaatgtagaagtaaagctacgccttattcagctggctggcttacttttcgctacagaaattgagattaagatgatgcaattgcattctattaccgtctcaataggtttccaatagaccatccaattctatcagttaaagcctattgttatgcctatggtgttatactgtgcatttgttatgattgtgccatttttaatgttcttaacatgtggtcctgcaagggagttgtggccatgccaaatcctaggagacatagagcctagctgcagcggcatagtggtagtgacacaataaatttatgaactgttttcatgctctcccacaggattactaacatccaaaatgatgcttctttcatatttggacatatagcaatggttagaaagctatctggcttcggttatttgcgcaacttaggagtttactgctacttcagctcagaattgttgggtaagatctcataagatagaagttcccctatcattttcatgtaccattgccaccgaatataagcagcctcttctcaatcatggtggactaaatgcctaaagcaaatattatctacatgaagtctctcggtagattttctgaactgcacaacacgacagcatgcttgcttacgccccattgtgttttaataattatattttatatctgacattccctttttttcgtcaggctttaacatcaaatgctttgttgttgctgccagcgtgaaatttcagctaatcaaaggaaattgtcagcgagttccttctggtggctacgggtccgaatactcagcatgtaagccaattttcctattctctcgaaatttccctttgctttatgaaacagatgccatgttctgtaaaatgtttcattctaaccagatagaagcactatgaattgtgtaattgtgtggagaacatgacctaaaatgttaaaatggtgtaaatatggtataaacatttgtcctactgctgctaatatgatgtacacatgatctaataaagcactacccatgtgcagcaattaggcaattgtactcaaactttatagcacatggtatatgcaattcagatgtctctataggcaggaccatcttctcttacgactttcagaagaaataatacctatatactcaccctgcactccttttaaaacacaagccacagctattgacactgcccttttctagagggtagggaaggaaaaacgagtagtgatcacaaccacctgctattgacactagatcactggcatcatttcttttgatgggaaaatcatcaaaagatgccttagaacagaacagaaacaaaagattccagttattttatccatcttttcacctattcttgtctttgcctcagtccttttttctggtactgaaagatctctggtgccatattcttttaatatgtaaaatcattagatgcctcattcaaatctgaagatcattcacatcttaatcatattgcagaggatatgatcaagaaatttgtgaatggcttgtcttcctttatccattttccatttattgcacattgcatcatcgcatcctcttttttgtgtacggtcatgttgtagttgattttgctgcctattatgctgattggtttctctacaggtttttgccatttcacctggtggataaagacacagggctatttatctttgacaaatagctatcatagactagcagttgctcaaaaaaaaatttctaaggttgtacattctgttgctggttgaaaactcaatatcagaatggttgaaccatggcattctgaccattctttttctttgggcttattttttattttgacttgctgcattgtggagagtcttgaaaattatttttaagggctggagggtcttgaattgaactaaagaaagcttgaatctttcgctgcacacaccagtgagttttttattggaaagacataattagatatagttttgcattacatgttttattgcttgaattgcactgctgtgatcactgcatttataataatgataactgcatatgttttcttcagtcacccatttgtttgccattattctttctttttgcgcgaatcctaaatagatcataatttttatgtgtactacaataaattttggatggacaatacaagtttgttgttcttttgcacaaccacattgagtttgtgtatatttttcccataggaacacatgggctcccaactagtatgcagaagagggcttccaaaaggtgattatggcctcggattgtctatcctatcatccagagaatttggtcgggaacacgggattgatccatggcgggagcggggagcccttgttgctgacatgaagaagcgtgcaacctaccttcctggagtgctccttttcacatgttaatcgactgtctaatgtagcatcacacaatttggcttgctgtccggagcttttaatgtctttggttctataaccctagaatgtatccgggaagtgccccgttctaatgctagctaatcaatagctgcgattatcctttttttaaaaaaaaaaaaagcatatacatgatcattcggcaatctttgatattacagactttgaagttgatctagccatgtaaatgtacggacgccacgagttcacacaattcggcaggattgaattaattttgctcaagaagtagagcactttctcccttcatttttatttactcacagtgctcatcttgagcggaatctcgatggacatctagagagctgggaagacctggatttagctaggatataactataatataaagattaagactcatcgtactctatcatctaagatgaaaacagttgtgaacttatgcaacctaaatccacagggacacggtgaaacagttcaaatagcgagtgcctgactaccttcacacatacagggaatttgattatttaagcaagcagcagaacaaacatactgagagatcagtccatgcatctctgaaacaaaatgcagtatctaatgtagctcacatcctaatccaagcgaagaggtatcccaaaacctgcagctcatgaaaaaatgacgaacaagggaaatatggccgatcgagtggagcacagagaattgagaaatgctgcaaatcttgggctgttgcccaaccaaaatgaacaacatgcgaacaagttcagagagaaaccaaaacaataatcgtctagctgcatgaaacttgcaactaagcagaaaaaacagataatttggggcacaaaatatagatctcattgcaagcaggcgatagatggagcagttcaaagttactgaatgactgcaaataaacgatccagctgttcaaaactctgtttcttgttggacaggatgcacggactgaagataaaactacctgatctgaatctaccacagacaccatcaagatacaggaacctacgaacgagaacgacaactacagctattattccatcaaaaagcgcctcaggcggatgacctccttcccatactcggcggcggaatgtgaactctggttcatcaacgtcctcctacggttcttggacgcggttgtttccatctccacctccattgccgccgcgttgcctcatctcgcggtgcataaggtccttttgcttcggtgggccctgtgaatgaaaaaggaaaggggaaaaaatagttagatagatagagattacaaaatggatcaaaaacaaggaaggtgaagaaggaggaggatcctcacccagatgaggatgaaggtgaaaaggaccaccatgacggtcgctatggcaaagcaacccacaccttgacaagtatcttatacctcgagaggcacaagaactgcaagaagtaggaaacggtgcacagagcgaaaccggtcgggacgaagcaagaggccaccttggtgagctgaaacacatcacggggacgcttgaggcagagatggccgatgatcgcaatgtgaaagaagatgacggtggcgaactgaaggcaggtggatgcgtagtcgggggtcatctcccgtctcccagcggtcgggaccgcggaagttggttggtgtgccggcgacgtggtcagccctcggcctgatcagcgacatcttcgctgcacgcccgctgaggctgtaggcgatggcgacggagtagccgagggtggatgcggcgaaggtagaggcgaacacaaatttggtctgccaagaacaacaaaaaaaacaagtagcttgaatcagaagaacgcgagactggctggatgggttatagtgtaacttaccctggccataatgtgattttccatggcgtgatcttgctctgcaggaagagaacaccataagattaacagtggtgatgcaggaaagcgaaacgacatcgagatgaaaaaaagaaaactttttacccatcgcgcgcgcgtccggaccccggagggaggtggagcacgacgccggcgacgaggagcagcagcagcgacgagcccaacccttggacgacccgcgcgtcgcggcggaaaggacgagagggagtgggggtggaggaggaggcggagagggtggaggcggatgaatataaagagcagcgggtgttttgcttttttttgaatgaaacctgagaaagtgttttggctttcgcggtttctttcgccctctgcacgacgaccacctggtctctccctacgactaccctacgactacgagacaggttaggctgacgagcgggacccacagcgaagcgcaggttgcgtgggagggacgcacctcccactgacgagcgggacccacacggagctctgtacccaccctgtctctgttcgggtggaatacaccatacccatgttactctatacttttttgcttttttgaacccttccttgcgcattatgacggttccatttgttcacttgatggtccgatttaaccacgtcgacgcgaacggtcagttgttctgatcgaggcaaagaggaacaacttaagaggtggcaacgggttgggtcgggtagagcgaatccatacctgacttgagaccacatgcccgcaaggtctatgggaaaaaaaatctcatgctcgtgcccatacccgtcgagcgtaggtaccccatcgggcttgcctgctatttgataaaaacaaaacaacgaacacacagaaaatagggaaaccctgtattttattaatcacgattcattaacatgaatgtttacaaatatatgagggctcccgcaggagttcgtcttttgccttcgcgaggaatacttaatagaaaggtatgctgactagagattgcgtgtagtctgctgattcccggcgcctagcaatgaggcggccggttaattacatctacaggagagagcctatggaacacctccaattaagctgcgcttgtgatcgtcgtcttcaaaattgattgctcgccgaaggttgaagttggtgcagagatttaatgataactgtgatataggtggctttgtttcgccgaaacctggtcacaatatattatcaccatgtccatacatgagtcaggtatcataacaaaggggatgacttttgcctcgtcggtgcccatttatatatgccagcctttattagatgtggatatatcgttacttttgcctcattggaacctagtaacatgtatccgttcctatctgtttggacatgttaataatatcatgacaccggcctcataaatactcggccataatttttaacttacaaagatcacgaatagctcccatgtgtgtgcatggtatcaaaatatattttgtaaaacatcggttagattgtccaatcaccaatgaaagttggacatatccagcgccgttgttatcggtatcatagtaacaaatagatgatccaatctccaatgagggccggacatctagttttgagcatagaaaatatatcaaatagtgttcagataatccgatcgccaatgaggaccaaaccagccttataccatcgattgtataaatggagtttgatgataaccgtgcttcggctctcattgatctggctttaatcatcgagatcaagatagattaaaaacatgcagatgttgcgatcgccaataaggaccgaacatctattgtgtttaatctagaaaattaatatttattcaatgtgctcaccatccagcgcaaatatcctgaatggcggtatgttgtcgataaatgactcgacttgatgaaggacgccggctgcggtgtttaattctctccgtagcggcgccggtttgctatcaccgggcgacttcaatctcctctcctgattttcctaatctactaagaagaatgggatgaatgaaaatgggcagatgggtgtctcctgtggcgtcctcggcgtcccccgctctagataggttctgcttcttatataggcagcggcgacggaaacggcctccgaatttccagcgccccgtgctaatcttcgtgataagccgacgcagagacgagccaatccgtcgacgtgtactgcagtctggagataattatgtgattaacatgtctaatgacagtgggccccatatgtttaatcgccacagccaatgaccatgcatgctcacgtaataacgatagcacttgcttatttcttttgttttaatagttccaatcttttgaatcgtatatcggatttaaaatccatttgaaccatcactttctattcaaattatacaacaaaacgagtccaatatcgaatatattcggacaccgtgacatttaaaatttctggacccacatgtcatatagatacgtctcgtatatattcagtaaaattatgctataaataatattctcatataaaattaaatgcccaataatttattatttcttctatgaatttttagcacaaaaattcatcaaacacctgcgccaccaccgccatcgtacactgccgcatgcgcccttggccccgtgcgtcgctgtgtcaccacccgccgcctgctcatgtgcgccgtcgcgtcgccatccaccgctgtgccgccagtcaccgtctgcgcccgtccgctgccagctgccgtgcgcagtggcgccgcgagcctccgccagccgctgcctgcgtccttgtggccaggcactaccacgtcgcgccggcaccgccgctgcgccgtggggattggggtacaagaggggagtggggaattaggttaggattttattagctgactatatatgttgtgtctctagttagtgggccaaatggtttaagagaaaagggtacgaggaacaagagatgagctaaaattagctaatacatatgtatcgaatcaggcatgggttacacttgagcaaaaaacaatacccggttgctgtctgtcacgttctcgggtatgcccacgggcaaaatataacacccatgcccatgctcatcaggccgggtaaattgccatccataggttccttatcttgtcaccgaattacaaaatcatctcttaaccaaaaaacggggtacatgtgatccctcaacttataaaactaggtcactctgggtccttattggtattgacctcagttttgtccgatgtggtggctgaatgaacgtgggaacccacgtgtcagggtgaccatgtcatcaccccccctctctctacctttcttctctcccttgctccactctctcgcttttctccttgtttcggcgggccagccagcggtgcgaggcgggaaagaagaaggtccggcagccgacaacgacgacggtgacgcaagagaagaggagccgaggcagggaagcacaacctggagctctaggtcgacgtgcttcttggcgttgagcatcgccgataggagctgctcgaaccggtccaggaacaccgcccactcctcacgcgctcaacaccttgaacgacatgctttttcgcacgacaccacatccggcggcaccttgatccgccatagagaagctccactcttggcgatgccattgccgcggaggaggaggaggtgcgatgggagcctagcagtggtgacggggacgtcgcccatgctgaactgggtactctcgtcgtcggagtcattgtagtggtgattcttgcgaggggatgtgccggcggcggtggtggaagaggactcgtaggcgttcttgtagagggacgcgagcgccctgagcccctcctccatcgccaagaactcgtgggtcatcatgtcactgatgtcggcgatggctgctccgagcatagcaacgtggcatcccgaaacgggtcgagcgccaccgacgtactgcagctcgacgccagagaatggcaacgacgactgcaggccgtgcagccgacgtgctacctccgcacctcgtgccggcctgctccgcgcctgcgctcaccgccaagaagcgcgtcggcctgaagcccaccaggccatgctctcctatctcggctcctcttctcccacgtcatcgtcgctgccgctggacctccttctctaccgccttttcccgccagcccgccggcccagacgaggagaaaaatgagagagtggaggaagggagaggagagggtagagataaagggggtgatgacttggtcatcctgacatgtggagcgcctatgtatgtcccacactgattcaggcaccacgtcagataaaaccggggtcaataccatctaaggatctagagtgacccggtttataaattgaggatgctatatatctgatttttcagtcgagagatgattttgtaattcggtgacaagatgagagacctattatgtacattttctagacaaagatccttctctccctccacttctctttccctctgggccaacccgagcccatcccttgcgctcggcccagatcccagccaggccgacgccctcccccttctctcttccctttctagctgcgccagcccaattaagagcacgttgcccgaccgggacgctgctggtatgcgaatcttgtgtctctgctaccagtgccctgcctcaagacctcgttactacgctcgccagttgcccagttcgtagaaactagaaagactttcttgcttgttaatgggtagagagggtagtcatcgtacatatggctatgttcactgcatgattggttgattgctagtaattgatttgtaggtcagtcctatgggaatatcactgagtactgagggtgtgtttagttcacgttaaaattggaagttttgttgaaattggaatgatataacggaaaagttgaaagtttatgtgtgtgttttgatgtgatggaaaagttgaaagtttgaagaaatagtttggaactaaacatggcctgagtagcaaaagctcatatttgtaccatatgactttcagtagaatcaatctgacttatcgttcatgtttttactgtatgacgttctaggatccttcgagtttctatttttctacgcaaataatttgatcttttctgcatgaatctgttgtcgcacagaacaactataatagtataattgagatacaatagagtgaaatatcacaaaatgaacaaggtaaactaagaaatcaaaaatcaactaatccatcagcatcgcaaagtatataggataataggatactgacatcagtggaaagcagaatgtatcagtttcagaaagacctgagttcctccgtgttcaggcttctgaatgctaaaccaatcttccttggccataccgtgctaaaaaatgattcacttggccataccaatttgcgccgtattacaccaatatcaagttatcaactatagttgtggtaaagaagagtaaaatgtcacaaaatgaacaaggtaaactacgaaaccaaagtcagctaatccatcagcgtcgctggggaatttgaatgacgcatgcagaattgagtccaccagtctagagtaaccgacataaacaacactttggatgtattcatagtttaataaattatctacgaactatatacataacatacatattgaacccttaaggtcagtttgtctagtaggaggttttgctgtctaaccgtgtaaacatcaggcctatgcgatgcagctaaactattatcaagctacaagtgatgatcctccagacttaaaagtgtacactgttctgtaactacatgacacatttggtacgacaatgcaacgaaacctcttctgcagtgaaaaaataatcacggggtcctgataattttaattgcttcccctccacttctcatgtcactcattaaagcaatttgatgcagaagttgggcaatcctctgcaaaaggcaaaacaaggatctaatgagagaacatcaatgcataaactgtcttgtgaatatttactgttgctcaatgcacgcctgaacataatactacgtagcttacatgacacaagactaacatctatatatatgagtacaaagatatactacttttctccaatttagacaagattttttgtgttttgaacataatttccccatgtaaaaacattgcctcataagacgatgactaaaaaattgttgagaactaatgcatattgtaataattagaaatgcaaaacactaaagggcaaagacaaattagagcaagaaactatccaatttatatttttagaattcaagtacaatgtgcagcatccaatttctttcactcaacctaatgcatgaaaagtataacaaattgatggattttcaattcaaggctacttgacaatggtacaccatcagtacctacactaacaaagagtagccaattaacattctccaacctcaagaaacagtatcagtatgtgaaaagaacatcaagaggatacaacatgttatggcgaaactatcaaaagacactaatttaaagaacatcaagaggatacgacaagtgaaaagaacatcattgatgggtttcctaacactctaatggtgaaactatcaaaagacactgctggtactactgctacagcatgacagcagtaaaacaaaacatttccataatatctcaaatcttctctatgatcaccacaaagagttataactcattcactgaactgtatactgaaattccagtgatacatgtaactaaacagaatagcaagtagcaactgtacaaatgttgccaattactgatcgtattccctaaaaagttgaaaccttaactataggaaaaccaaatatttaaccctgttctcattctgtatgttccgaatcaacctctgcgatgatagaacatgatactcgcttactgaaccgtatacccaaattccagtgatacaacatgtaactgtacaaattttgccaattacagatcgtattccctaaaaaatgatcatcttaacttcagaaaaaaaaatcaatttcttgatgaccacagtaacaagctcgaattatcacatcgttgtttaacttctaaagttccgatagatattgcgcacggatcatacttggaagatgtagttgaatatctacaagacatctaaaacccacatgttcctcgcctcatcacccaattctctagcgtaattgttcatgataccagaataccgacgatgaaattaaaccagaaaacctatagaattatatagagattcaaaccttatccttctcctgcgagagcagcacgagcaggtccctctccctcctgtcccgccggcgcgcgtagagcagcgctcccaccacaacggccgcgcccgccgccgaccacacggcgggcctcaccgcggggcacccgcacgtcccgtgcaccatcagcccctcccgcacggccccgaccccggccgcccacgctcgcctcgccgccgcgcggcacctcccccacccccacagccactccccatcaccaaattcatcatcatcatcatcatcatcctcctcgccgtcgtcttcctccccttccttcgccgcagcctcctccgcctccccctcgacgccgagcccctcgtggaggcgcggggggaagacgtcgcagtcgtcgaggccgccgtcgtccacggcggcagcgcccacggcgacgacggtggcggtgggcgtcacgagctcccaggcgtcggtgacggcggggccaggcggggaggaagacggcatcgagccgagggatgacgaggagagcgagagggtcagcgtcttgggcttgaggaggaggtgcgggttaggggaggggaggagcagcgggtggagcgccgagtacggcgatgccggcgcggagaacggcggggactgcggcgccgacggcggcggcggcagcgctggcctttgtccatggctgcggttgccgcggctcaccggcggattccgcttcgatttgcagatggtttgtttggatctggatgatctttcatgtggcgctcgagatcgatgacgactgctgctggttttcactccacctgtactgaatggtccgagttgaaaggacagcgatgtgtttaatcccaattcaattgaaatctctagcatgcattcaaatcttatacatatttcacacgaattgcagattattaagaaagaatttgataattttttgaataagacgagtgatcaaacgttgtaagaaaaacttaaaatcccttatattatgggacggagggagtattaatttggaatttcagattaatttggtttgtgtttacatttagtcgcgactaaaatcttttttttaagcgtgttttctcgatatcgatattttgagtctgtttgacacagctctagctccaccccttctggagtttccacctccacagctcaaccaaaactggatggaagtggagctgggtagaggaagtggaccctggatgaactggatggaagtggaccctggggtaccaaacaagccctttatttcaacaaatctactagtagtacaactttcaggttaaagtttgaatctaatttagttgaggtgggccatcaattttgcttataatcaaaatttaaacttgatttggttggggtgcgccaggcccgggcggtagtgcaacgcctgggcgacacgcgagggccccagtggcaagccactgtggtggaccctcccccacaaaaaataaatttaatatcgaagtgaacacatggcccacatatcagatattaaactgataagaacagatactacacttgatcttagccaaaaggccgagaaaggtatgctttgtgacggagccctgcgactcattttatagctcgcgcgaccgcctcatcgagctgaacaagcgaggtggtactaaaccatcgggaggagcaaagcaaacgtggcaacaacgctcgtactgtaagcagtttcccaccaattgggcctcgaaagtttccgtgtggcccatcgtccccggcgcggccgcggcccaactccttcgcgtggaggcggcgaccgcttcagcctcaaagtctcgaacccctccgccgccgccgcctggctgctcggccgctcctccgcttgctctcccttgcttccgagggctccgccgcacggggtcgtcgcggctagagggtgggctcgccgtcgaggaaggcgggggtgtctggctcatcgagaacagtgccgaggggaatccgggttgcgggggcgatggccatggccgcggcggaggcgcgggtgcggcaggagaaggtgaagaagttcgaggacttcgtcgaccggagactgaagccggaccttgtgaacaccatcgcgcagcgggacaaggtgttccagcagcagaagaccttgtaagattcgcttcccgtagaatcttgtatgtaaaacctcaatgattattgtgattccgggttaccgtgttgatgcgatgctgattattatggccgttgatttcggtttttggatggtctcagcttggacttgaaaaggaacatcgaaaatttggagaagaatggagtcaccagtatgcgatccatggtcaatcttggctctgaggtgtacgcccaggcagaagtgtaaaccctcgtcctccctttacatcttcagttctggataagactcaacgagttttgatataacttcactgatgaattgagtcaccatgtgttaacaatatacactgacgcggtatatcggaacagctggatactacattattcaagttaaattttctggaagtgcacatgcagttgatagaccattggcaatgggataatgtggtgtttctacatgactgtgtcgtttccatctaaatagtggaaatagggtgacaatcctggttggaaaaatagtattagcatatggaacatagtataacaaacttattgatttttatttttactggttattctgataaaaaaaatattcttggttattgacacactacataacaagtagacttggagtttgttcatgttgatatttcaaggtctttagcctagctctggagagtttggatagttacagaaaatcagtatgaagtgcagaaaaacttacccttctgtaacatgagtgatatatccgtgatatatcctctttattgttcttgatctttccagatttacctttggttccttactgtgtacctgtggtgacttctgcaggccagatacaagacacatttttgtggatattggtctaggtttccatgtggaatttacttggcaggaagctttgcagtttatatctgtaagagaatcaaggttggcaaggtaactcaattcttagaattggctatgaagatcatgtttttttttgtgtcaaagaagttgaggaataggaatcttgatggttgagggaagttttgatgtgctttatgcttcttttaacacagtatccacaattagcatatatttcatatgtcctgttttgttattgttgaaaaggtggtttgagttttttttcccctcataatgttatttatagttgaaaatgtgggttttgttttttcttcttctcaagagaggacatataaactcaggaacatattatattcttgagtaggttttttataaaaccctgggtatctatatgtatccttttggaggttgacgtttacccaggcatcaaggacgaaaggaatgtatttatttgacattttagtgtgctgatcctgggtgctattggtgtgcatcagatattctgcgcgcactctccaagtctccattgataagttcagaaaattttactaaaatgacctattttcactgtatcatttcttagcattctaaactgctactcttcacacttcactgattcagccaatagatacctactctgtattttcttagatgtgtcaattctcagatgagtttgttcctactgctgtttcaatgatgttatgctaacttggatccaattatgctactctggaagccttccttgtcaattgctgattttgcagtatactatgtttgaccgtagatatataggcctcttgtgtgtgtgtgtgtgtgcctgtgtgggtatataggtagacaggctgggtcttgctcatgtatagtggcaaccactgttgatgttgcatgctccctccgtccccaaaaaatccaacttctgcctatgtctaggttcgtagctagaagttgttgtttttttgacggaggtgtaggatatagttgactcagtctgcgctggatacttggatctaataatactgaagcatcaacatcaatatgatatgtattcaaagatcatagtcatagtgtgtactgtatagtggcaaactttttttgttgcctttatatcatctaatataccgaaccccatattttccgggacaaaaactattacagttgaagattagcagaccttagcaattaatcatattgctttgtgccttgctgctttgatgtgtcaacttcccgttcataaaacacaggttttcaatttgacagatactatgttacaggttttcaatttgacagatactatgttttgtttaggatcgactgcgatattgtcactgcagcatattgtcgttagtcccgatttcttttgaatgtgatctgggcttctttcctatttctctaattttcctttttgggtttcctgtggctacatttgtttgtatgtcaatatgttggtgctgtaattttcccttttatatttacgcttttgttttatttgatgcctgactccctgtagtaaaattcacatactaatcctgtatatttccatgtttgcagacagatagatgagtacactcatctcatcgcaagcataaaagcgcagatcaagttggtatgtaaaaaaactaaactagttgctcactatataggtgatacttggcagtactctggattatagctaacctatatgcaattacccgtgcaggtatgtgaaggtatccgcgaactactcgagctaccagcagagtaaaggtgaaagttggcaatgcaatcgtatgggggtgcttggtagaatgacttgtgcttttgcttttctcacgaaggcatggtcgcccatcttcgaacatgaaagattttacatgtactgttgtgcaaaagatggtttcatacactcatccctgtaataacattcatctaatcagattaactacagtagaatttcgctatgtgaaatcaacgcaaacactgtgaaaacttgttggttgatgcaacttctgatcttccctagattcccaagtcatagtgtacatggcatgccttggaagctcatggcatgttccattttgtcattagattagaacaatgaaaggaagttaggaacatgccattttgcatatagatgtgtcagtcaagacagcagagcaaggaaagtatatattgggctattggcacttcatctggtaaggcataaagcttttgcctttgccgcgaagctgccttattgtcttttccactttccacttgggcctttcaaggaatcaaacaaaacttgccaccttagcttttgttcccttggctccatcatacttaattttgctctcttacattatcaagtgattaggcccgaaggtttcgaagcttttgttccttcctgctcggccttgtttgaccctcttttctctgtattgatgcaactcaatatacctgggttactgtagttgttgtatacctcttccatcctaaaataaacaaacctcatacgtgatgtgacacatactaatattacgaatctggacatgtgtatgtctagattcgtagtaatagaatgtattacatcacgtataatgttggtttattttgggacggagagagtacagggaacacatagcaacaaggtttcagagttttttgtggagcaaaacaccgattgagatcctatgctcaaagtcaaatcactttgagtcactgaacatgtcagtgactctaaaaacacattacttaagttagaggataattcgtgaaacacgtactatcgtaataatttgatctgagccttgatcatgactcggacgattacgacataatgtgtcctaatgcaccttattggtatcctcctctacagtacagtttatacgcttagggcatgtataaaggtagagcttagaatggtctctttgttaatacatatcacttagagactattctcctacaatagttaagataacaaaaactcttaaccattaatgcaccaaaatattttttttagtaccattctttccttttctccacctccatgcaacaaaatttcctttaataaacgttaagagtcgactctgacccgttgtcatgcgtagcaaccatgtttccctttactccactctctctcttccacgtcatcaattttacttacatggaaacgaagagagaccgttattacacaccgttgtacatgcccttagggtgagtttgaggagaaggtgattgaggagaatacagtttatgcacttagggtgagtttgaggaaaaggtgattgaggagattgggaagtttatgcacttagggtgagtttgaggagaaggtgatcgaggagattgggaagatacgcaaaacgaggtgagccattagctcatgattaattgagtattaattattttaaattttaaaaatagattaatatgattttttaaagcaaattttctataggaaatttttgtaaaaaacacaccgtttagtagtttggaaagcgtgcgcgcggaaaatgagttgttatctccctcaatgttacccgaacgaacgtagccttagggtgtgtttgaggagaaggggattggggagattgggaagatacgtaaaacgagatgagtcattagcatatgattaattgagtattaactattttaaacttcaaaaatggattaatatgattttttaaagcaacttttttatagaaatttttttttgtaaaaaacacaccgtttattagtttgagaagcgtgcgtgcagaaaacgagatgcttttctccctcaatcccccagatcgcccaggaacgaacgaagccttagagtcgctgacatatatgctcatgagtttcccatgagaaagtggatcctacatgttaggcgtgatagtatgtcactgcgaaggatctcgtttcaacaaaattgagtttcgcttgtcctcctataatttgcattcgaaaatggtcttaatggtgatggatagtatttgtttcttcctactttgtcaaccaataaaccaaatggcaatagtacaaacatgaatcacaatctcacattgtcattagtaggttgacaaaacgaacatataactcattgtcaatgcactattatcaacttcaaatcttcaatggaaccaacgacaagaggaatttgcagaagcacaacccaagaaaaatcatatgcaagcgtgcccgtggaagcttcactgtgagttcccaactcccccatctcattttccgcgcgcacgcttttcaaacggctaaacggtgtgttttttttgtaaaaagtttatatacgaaagttgcttaaaaaaattatattgatccatttttgaaaaaaaaattagcaaataattaattaatcacgtgctaatggactgcttcgttttccgtaccggagggatgggtttccagggggccccacatgtcatcctaactgacataaactacctccacttggtgggacccgcatgtcatcctaacaaacctaaactacctcaacttggtgggccccaaatgtcagtaccacatgtgaactgtcggtagtcagaccctccccctcgcctcgcgagctcgcggcgtcgccgtctcccttcacaaaaaacccacctcgatctctgctccaagaaacttctcttcctcctcgacctcctcctcctcccacgccattgccgctctccaagatctcgcctctgctcactggaaccaactcggagggcggccacgggagcctcgcattgggcgacggggtttggtggagctcgagccgttgcgttgaatctgaccggggaggaacgtcgcgtttggcggcggaggcggcgagtccaa

SEQ ID NO: 76017 - DNA, 598 bp, Oryza sativa
tattggaagctataggagcaaaacatgtataagtttttggtggctcggaattgatagtgcaacaagttgccggggtgcataagtgttttgatgggtcattaaatagatatttagatcaatgcttagacacattatcaccaatttttatgattttgttattagaacatgttgctagagaaactttaaggcaaatgatttggctcaacaagcatctggttatcatgttaaaaaaaaggagtattcttcatttagaaaaaacggtgcttcaattcaagagtttggacaaaattggcgatgggccgtctgacagacgcaccggggccaatctgaccagggaggaccggtggtctgaccagcctggcatagccggtctaaccagagaccttacctgacctgatcgacctattatggctagtctaaccagattccaacaatcagctaggtggcacgagttcatgaacaagttggaggccgaattaattgtaaattcggacgtttgtccctaggaattagaaaatgattggagtgtccctttgatagattatttgaaatatccaatttttagggttgatcggaaaatttggtgtcaagcttttaa

SEQ ID NO: 76018 - DNA, 1718 bp, Oryza sativa
aataaagtaaactaatcttgcaagataagttgaaacagttgaaaacaggatcacaaattttgcacttttgaataacaggtttcaaaagacataaaataaaagagtgttataaaatcaacatgctaagtttatgatatttcaacatgattgaatgaaaataaataatgttgtaaaacttttgctggtaaatgggccattagtacagtaatagatgtacaataccaacaacacaggaataatgagtaaattttgaatgagaacaattgaagagactataatctgcatgtgccattagcttggtttaattaaaagagaaagagaggagaataattctactttttcaatatttttagagggcttctataggtaaccatttggcataacctagggttaaggaggctctgataccaacttgtcacgcccggaatttctatccaaaactccaaacgcttacatgtgtgtaaaccctcgtccaggaatcagctgaggcacacaataacaaattgataatagagtgcaattattaatctaattaagaggcgaataaaaagtcattacagagatggatagttcctctcaaacaataaagatctaagcagcggaaaataaaataaagagcacaggcgactccatcccacaagcagcttgaccagggctacgcctaatcctccacaccttcagcatcactgtagaactccttctctgatgaatgattgcaagatgagtatatgacatactcaacaagccacgcagcaaatatgcaagtgcaggggataataaaggatggcataatatagtctcatttgcataaatggcattcaataaatacttcagaatttagaaaaacagtaaaggatttaattaaacaatattattcaacgctacacaacatacccgttgcataggcccaacatttctagacaaccattcccggctgcacagttctatctccaaaccaggagctaagcaagttattaccaattacagcatcatttattatggtgagaggtgtgagactaatcacgaaagacattgttagacccgcccataactgcgggcacggctattcggatagtttttactctggctagaggtgtaccactatacccacaagacacaacctcaacatcatgtcaaccatgcgtcgcgatacttgacaagtacccgaatagagattgtgacaataccctccgcataacacaattcaaagtagtgcaccatggactccccagcgacccccgtaggcttatctccgccacttctcagtctggtgccccacaatgaaccacactatacaaaaggtaaagctgttgcccacgctggcttgtggttggcacggttaatgtttcacaaccgaaaattgtgaaccggtccttaattgtcatgagcacgaccatcaaaaccatgtgctcacaacccaccgttaccatgttttagttgacatcttaattaatcatcctatcatgattaaccatcatgagctaccattaatccatcattaagtaataatgaatcattaattatcccattcatatgagctagtgtctctaagcatggctaagcatcctaattactttagccaaaaccatataatgttatagctaatccaattattaaccaggtgacaaagtataggtaatcaataacaaaaggctataacaaaggaaataggtcattcccactcgatgacattcaaaaataaatgcaatagttgaata

SEQ ID NO: 76019 - DNA, 4846 bp, Oryza sativa
ccccaagaatttataaatttgggatttttagggtgtgacagatcttgtcattggcagtgagctttttacttagagcatcggtagttttagcttgcgcaaaaactagatccttcaaggaggattggttagaaaagttaccgttgttattacctcctagataatacgggcgtggctagttccacccttgaccgccttgtggatggtaaccgttgttgttgttgcccatgtacatcgcctcctcataggtttctgggcaatcattcccagaatgacccatgttgccgcagacctcacacgtaacgtgtgagtccaaggccttgatggtgccttgaggccgtttgtcgtggtcgtccaatcgcttcatgagaaggtccagcttggcagcaagtaattccgtctccttgacggtgtgcatgcctcgctgacgggtctggagtcgttcctcgctccaacccatattggagaccatcttctctattaaatcagcggctcctcgaaccaatttagagaagatagctcctccagctgccacgtccaggtgatcgcgggacatgggagtccattgtagaagttctgcatgattagccagttgtcaatcccatgatgaggacaggcggccacatactcttgaagtcgttcccatgcttcaggaatggcctcgtcccttgtctgctggaagaactcttggttttgcccatcgggaagaacttcgagaggaataccgtagaacacttgtcccaggtgttgacagcagcacggttagcgtagaaccactgcttcgctctcctgaggagggaaaccgggaacagccttagcctgacggtgtctggactgacgccctttatggcgtacgtgttacagttctccaggaactgctgtagatgagcattggcatcctcgttaggcttgccgcagaacgggctagcctacgccatagtgatgaggctggacttcaagtcgaaatccatgtctcccatgttgatctgtggtccaatggccacattctcagcagagggagcagcgaactcatggagagtcttgtcagctatagtcttgaaagtcggtggcgctggtacggctggtttctttgtcagtagagttttctgcagagcagtggctcacggcctgacgctctggaagaaagcttctggattttctttgaaattttccggcaagttgaaatcagtcatgtactaccctgctttcacaacaaaagtaaaaacaaccaaggttagcttgcaaagggaaatgattatacaaaggtaattagaaagtattaggtcaggtaatctctattatgaatcttccctggcaacagcgccagaaaagcttgttagtatttcttaatgatattactagaaatataattcccagcaatggcgcagaattactcctggtatattatggttacagagttcatccgcaagcgcacggatataccattgtagcatttcacccgagagttttccaagggtatcgtatttattttatcccgtgggaagatcatgtggagagaagccgcccctgactgccgagttccttacgacagcccgtcatgaccatacaaccggggctaaatacggaggagtaccctccccagggaattaacttaggattatatacgcgcgcggaggaatacccgtactgagctatcaccatcagtggcccacctctcatccgcagcatataactccaaataataatatcccgtaatccagacgcgacgtctaaactaccagatactactctaatatcatcgtcatgacatagagtaattgcgtaagcaaacattatacccgcaccaaagcatctcccatataagctagcaacatattcagtataacatgaacataatttaaagtaggcattaatatacttggaaagtatttcaatatcataaatgtataaagaagagtattctaataatagtacaaagcttacaaaagagaaaaggaaagatactagagccattcccgaactcttccaaaggctttcggactcccgatttctactctatttctattccactagcttaataacactaaactaacttgagagaatatgagagagctcttgcttgaggtgtgtgtgtgatgtaagaatggcaactccttttataggcaggtaatgacggttatatggttggaatggtcggtaatatcctgcaaccgtcattggtgatcaatcccagctgtccatcaaaaccctgcatccatcagcgccacgggaggttaggtcaaacccactggttcggccgaaccaggggccggaccaaccagcccaagtttttgctagtggcctcctccgttgcttcacttcgtagacttgtgaattttggcccaattcatcgtgtcaattctgagttcttggcccattcatacataagtctgatcgtcgacatcgtccgattgatttatcgtctgagttgatttatcgtctgatcatcgacatcgtccaattcgtctgactcattgttattctctgcaaaaggttagtaaacctaatactagtggaatattattattcttacatgtatatgcattgcaagcatcactagttctcctctattttggtaatattaacgatcaaaattgatcgataacgaccgtcaacagccagcgtggcatcgtttagtggagaggtcggagaccggcttggcacagagaggcgcagccgatggcagcggaggccggctcggcgcgagaggcgcgggcggcggagatcgaggccggcttggcgtgagaggcgcggccgatggagggaggccagattggcgcgataggcgcgtccggtggaggaggccggcttagcacgagaggcgcggctgacagtggagaaggctacctaggtgtgaggaggagctggcggtaggtgtggtgcggtcttcggtgcccgaaggctagccggcgggggacgccagtgtaggggtcccacatgtcggcagagcttgtgtggtggtggagcatcggtgtgtcagacgtggattcgcaggtggtgagcggcgagtgaaaacctagtccggccttggccggaccgacaacgatgtcatccccctcctgagggcgttgtcgtgctatctcaccccttaagggtgattgccaggcgaaagcccagtcttagctcctttgagtcccgacggacggcggcggcggtttttccgtcgcctttcttcttgaagacgtcattttggcatcccctagggggcgatctcctctgtgtccctttattggtctagtggcggtcagtcatgcttagtgacagccggtccgatgctagccttcttctgggctggtgtgttggcgatatcggtgtgtgggtggtggtatatttttttcctttttcctggttacgaccttacagggttgtaatcttataatttttttctgctctatcaatataacttcgcacagtttcgtacgggtcgttaaaaagaaagatgatgcatatgcagtctcgatgtggttgtagctgtgataaagaagcttgctgtgcagagttttggtactcgagctcttgcttggtggagatactctctgagccatgtgcaggatgtgattagacaatggatttggtactagtttgctagttgcatggaagagctgagacctgtatatatggtgggcgcatgcagcggcgcgcgtggtattggagttagtctttacttatcggagatactagtctttacttatcggagatagtctttactttatttctttatcgggttgttttcgtttttgttaagattttatattttgtgtcggatcggttgattgacgcgtatgcaattagtataggcaaaatagaaagcaattagcccacgattaattaagttttaactattacaaacttgacaaattgatatatttaattcttttaaaacaacttctatataaaaagtcttcgcacataacacaccgtttaataatttaaaaaacgtgctaacgaaagtcgagataaaatctaaatcttaattaatcagaaaagaatatggccacatagtaagttaattaatttatttttttttgttttagcgactgaaataatatttctaacaaattttttagatggagggggaatatataacagcaggtacaatagcagactataagccagctataaacatattttgagaagataaatgatgagagagaaaagtagtgggttacagccagctgtgcaacatgtgctctaagataaatatatgtatgacacgtgggactaggtattaattgtgtactatatgttataggtaactattggataaattggctattaaattaaatatagataatttagagttagtagttagctatagtattaaacttgctctaaagcgtcttaatcaaaacgatttaattatagatggtttcttgtagcatcgaggtcctagctagttgtaaaaaagatatacagtagcccgtcatcatcaaagaatgcctatataagaccgagctttggtagccagagatctcaaagctatagctacatcatttcctcttagagtagttgccgtccactccaatactgcctgatgggatcctcgggggcaccggagttgacacatgaattgagcaacaatcctcgtgccggcgggagagcaacaagccaacaatcttgggaatcggcacggctgtgccggtgcatgtgtatgagcagaagtcattccctgattattactttgagattaccaatagcaatcacttggtcgatctaaaagccaagtttgcaaacatctgtaagtgcatgcgaaactaccattctgtatctgtcacgatcgatccataaacttaactgccataaaatcatcaaacacacacacacacacatatactatagagggcgcagg

SEQ ID NO: 76020 - DNA, 1662 bp, Oryza sativa
cctgcagccccgttctgtagctgcacggtctttcccgaagtaaacttcagatcgaccgtaccaacaccatgaacaaccgcaagcgaaccgtttcccattaacaaggaggaacctctcccgacctgataagaagaaaacagagaaatgtcagcacatacatgaatattagcaccagtatccacccaccaatcaggtgagtgaaaaatagagagaactgtaggtaatattttaccgtacaccgatgttcctccgccctcgctaatgaccatgttggcagacttcctgtctttgcgctcaggacagtccttggcccaatgcccatacttaccatacacaaagcagtctccctttgcctttcccttgcctttcttcttaaagttggttgcagccttgggtttgacatcagacttgactttcttgttgttgtgggatgcatgagggttcttcttctgtaccatattggcactagaacctccctcaacctttttgccccggacgtcctttgccctcgccttctcctcaacacccaaagagccaataagatcagaaacactgaactcttgtctcttgtgctttagagaagtggcaaagtccgaccaagaaggtggcagtttggcaataatgccacccgccacaaacttgtccggcaactcacagttgttgttctcaagttccttagccagcatctgaatctcatgagcttgttctactacagaacggtcatcgaccatcttgtagtcatagaactgctccatgacatacagctcactgccggtgtcagaaactccgaacttggcctcaagtgcatcccacatgtccttcctagaaggcatgtgcatatacacgtccactatgttgtcagcgagtacactgatcaatgctccacagaacaggcaatccgaagcctcgaaattagcctcctcctcaggagaaagaggtggttcacttcgtttgccccgtgaaacatagaagcattgcatcgctgtcaaccacaatagtacacgtgctttccatctcttatagttagaaccatcaaaagcatgtggtttcagtgcagcagcaaagccaactaccgaaaataacctatcaggtttttggattgttagaaatatggtcataaatcggcatattttaatccaaaatgttaagacaataatcatggcataaacagtgtagggtgatctagtgacaacatgtaacataaccagtagcatactaatggcatcatgcgcattatgaatatcaggaacaagaacatagcagtaacgcagtagcatgctagagacatcatgaatatcaggaacaggaacatagcagtaaagcgctaacaacgggaacaggaacaggagaaggatataccccgagaatggccctccactggattgcgaggcagaattgactccgttggtgttgttgttcgcggcacaggctccagctcctggcgcaccacctccagctccagctcctggtggcgcaccacctccgccatctcctccagcagcagcagcggcgccggctccaggcgcagacatggtgggcgaggacgagcagtcgtgcgggaagcactccccaaaaacctgatcacccgcctacccggtgcagatctcaggcgaaggtgtggttccggaggccctgctccttccgatctctcgtgcgcgcaag

SEQ ID NO: 76021 - DNA, 1550 bp, Oryza sativa
cctgtcattgtaccgttttctctctatttgcaaaggtggtgggctgtcatgatgactgatggtgccatggtgttgtcatccctgacagcacacttgataaattaagtagagagagcattactataatgtgagaaccaacagtattattttcctcgacttctgcaacaagtacattgttttattaagctattctattatctaaagctatttggcggtatctcgcatatgatatggtacgaggagggcaggttatagataccttaatttgtgtgctggtgatgtccctcctattggtttaggacacgtttcgccaccatcccgcaaagtgtggctggtttccggtttactgctttccgaatgataaactgtgtgcgctctattattaaatagagaaaaatctttgtctttcctttgcagttctcgctctatctcttccatgcttttgagttttgtcttatcccttacatagccctaagttttcttttgagcttttctgtatatactcattttgttagttcatctcaattgagcttttctaatgattatattgtctctcactcatagataagaacataatatatctagaagaaaatctttagttataaaacttaaagggagaaagttgagtgaccccgaatttgaacaataaaatttaaattttttaaatgaattgcaataaaatttgatgaaattacaaaagggaaaatgacacatatcatcactgtttctatcttaaactaaaatttgtattttaatttaaaatcaacttcaaacaaatttgaacaaatttctatgaagagatacaagtgaaattatcattgaaaacttcatcaaacataactagaattaatttcaaaatttgaatttttgttttcaaattaatttgggtgtcaaataattctatccctttcgatgttaatttttgagttgaaattgctttcaacacaagacttaggctttttaagttgactgttatatgtagtctaaggaatggctataaaggtgattgaaaacaaaaactaaagggcatgaaagggatgagtaaaaactcaggggcacacaattttctcttaataatatgctagcttagtaagcgagaaatgtaaatacacattttatttttctatttggtggtatctcgcatatgacatgatatgaggagggcaggttataggtacctaaattcgtgtgctagctatgtgcttcccgttggttttatacacattttgccaccatcccacaaaatgtgtctggtttctggtttactgctttccggatgactatctgtgggtgctacaatattaaatgctagcttattaggaggcggaaaatgtaaattggcaaccagtcaattatacatgtgtttgttagctccatggtttgctcttcagctttgctgcaaccaaaatttaaatattttaaaacttaattttagaattgattttaatgtttattcaacacagtttattttcaatattgacttttaagtcgtcaagaacacatatgtaaaagttttactataattttttttgttgctaatgagcattatg

SEQ ID NO: 76022 - DNA, 3124 bp, Oryza sativa
agactccacaccatagcatcggggtctcaagctgggcaagtgccaatgaggaccgatggcatgcacctcatcacatacaatgggaggacaaccaaccccccagatcaagtggagtacctccatctacaagtgaatgtcgctcgagttcctctcgttgggacttgggtgaaatcactaggagaatggatacccttgatatgcagacaggagagatccagtacaacctcacggaacacatagcacagacgcaagaatggtaacaaactgctgatgctcagttcgccaacttcaccaacatgatgcagcaatagcatgatgaccttcaagcgtacttccgcttctaggggttcaatccttatcaaggaccttgagcgaaagacaagcttggggggagactccccccactgaggtaacttgtatcacattgcatatttccctttctaattgcatatttgctttccaattgcattttataaacttgaaaacaatataaaaatttgcaaaatagaaaattccaaaaagataggataggtttgagtcattctagttaagataagctagttctctttagtaaaatgatgaatagttgctctgtgttatatctcttatatatgggttcataggtaagtgctctctcaaaggttaaatataagtagccaacaattatctgcgagcctgaggaaaatgagctgcacttgctaatttgagtctaggttgttgcgagatatgatatagtaaataagagttgcgatgatcctgatcctagtttgacttgaattccggatgttttgtttttttcaaaatgataaaaatgagagttcctcatttgatataaattcctacagagccaaaactgtgctatcatgattgaaccatatagattttggttacttgccattccattgaactttgtcaaactcttgtgacttgtggatacttctcatgctctatgatcaagatcatatacccacatttatgcacatgctaaactcctatactaggagctagcattataccattccattccatttccatactaccataaaaataaattctccatgctttcatgtgctttctttttctaaaaagaaaaaaattcttttggaaaaaaaaatagaaggagggaacggaatggatatgaaaaaataaataaagttatgctctcacaagcatgagcatgatgttgaaaaaaaagtgtagccatgccctctcctaatcaataaaagaaggatttttaggagaagaaagtaagcacaaaggagaagcattttctttattttccttcataaaccatttccaccttatatcacacaatttgcacgatcttgatcttgagtatgtttagttatctgctttagtctaagtttttgacttagtaataaatgtgaatgcaagtatgccatgtttgatccctaccgggctccacatatcaaaccttagagtaggaatcaaaaaggcaaaattggtgaggaattcatattgatacacttagagaaactgagtgaatcatttgaggaacttggctttctttgcaaattcatttgaaaacttccggaatgaaagttgaataaagattgggtaattggtgctctaattgctgttatgtttttcaaccgcccaaggcaaggagaagcagtgtctcatgggaatcaggggtaagggtaagccaccgtgccaaagattatttaatctgagagatagtacatataccttggacctgtacctttgagatatacagcatagtagcaactcctgatcaacaaccaagtttttatttccttttgtccttcactcgggacgagcaaaagttcaagcttggggggttttgttgacgatcgttatcgatcagtttcgaccgtcaatattaccaaaatagaggaaaactagtgatgcttgcaatgcatatacatgttagaataataatattccactagtattaggtttactaaccttttgcagagaataaccataaagtggaggagaatcgacatcaactcagatgataaatcaatcggacgatgtcgacgatcagacttatgtatgaatgggccaagaactcagaattgacactaattgggccgaaattcacaagtctacgaagtgaagcaatggaggaggccgccaaccaaaacttgagcttgttgggccaggcccctggttcggccgaacgaggggattcggctgaacctcccgtggcgccgatgaatgcagggttttgatggacggctgggattgatccccaatgacggttggagggtattaccgaccattccaaccgtcacaaccgtcattacctgcctataaaagaagttaccattctcacttcacacacacacctcaagcaagagctctctcccattctctcaagttagtttagtgttattatgctaatggaataggaataaagtagaaatcgggagtccggaagcctttggaagagtggggattcggccgaacctcccgtggcgccgatggatgcagggctttgatggacggctgggattgatccccaatgacggttggagggtattaccgaccattccaactgtcacaaccgtcattacttgcctataaaaggagttgccattctcacttcacacacacacctcaagcaagagctctctcatattctctcaagcctttggaagagttcgggtatggctctagtagctttccttttctcttttgtaagctttgtactattattagaatactcttctttatacatttatggtattgaaatactgtccgagtatattaatgccaactttacattatgttcatgttatactgaatatgctgctagcttttctgggagatgctttggtgcgggtataatgtttgcttatgcaattactctatgtcataacgatgatattagagtactatctgatagtttagacgtggcatctagattacgggatatctcattatttggggttatatgctgcggatgagaggtgggccgctgatattgatagctcaataagggtattcctccacgcgtgtatatgatcctaagttaattctctagggagggtactcctccatatttagccccggttgtatggtcatgacgggctgtcgtaaggaactcggtagtcaggggtggcttcgcgaagta

SEQ ID NO: 76023 - DNA, 2509 bp, Oryza sativa
atgattatcacaagtaatatataaattattagtcaagttctctctacaagatcatcctatgggataaaataaatacgatacccttggaatactctcggtgaaatgctacaatggtatatccgtgcgcttgcggatgaactctgtaaccataatatactaggagtatttttgcgccattgctgggaattatatttctagtaatgtcgttaagaaacaccaacaccggccagatgcagccgtctcccacgccctcggctagccgtccgaggccgtcatgcttccggtgaccgcagtcacggtcaccaacaccgcagctgctgctgtcaaacgcccaccatcttgccgttgccatcctcacctcgcacccgactccttccccgccgccgacgtcgccaccgcctccacagtcacggctgccgtcgccgctgccaccgacgctagtcaccgcctccgcagacctcttctgtgccatcgccctctgccaccaagcagccagcaaacgccctgacgccgccgccatgtcctccgcccgccgtcgccagccgacgccgccgctcaccgctgccaactgttgcgaccaccaccgcccgccacccctccaccgctatcgcggccaccacacctccgtctccagcgcctccgcgccgtcgtgcccatcgccgccagattcggccacctccgcaccagtcatcgtccggctctaccgccgccagttccggccgtcgtggcatcggcgctgccagaaacctccccgccagatccgcgccggatctggcggcctcgtccactgccgccagtgcctgcaaacctctgccgccatccccccaaataacgccgcccgaacacactaccctgccgccgactaactccccgccagctccggccggacagcgcggatctgggcggtttccgcctcccgacatgagaagttcccctgcccttgtgcggaaagcggagcgaagccccaccgctgccatctatgccatcgcgcggctttgccgacggccgctcgggtggcggcgaggtggaggaggagggatggaggacgggagacgacggcctgggcgcctcttgtgccccccgagaggaggtgacgtgagagtcgtgactacactcagtcacctgaattactgcatatgcatcgtcacaattggtgaaaatggtaatggtaattcacggccaaccggcattcgtttttgactttctcctggccgagccatatggtcgggccttcatttttgactttctactggccgagccatatggaaatggtaaacgactgaataaaatggaaatggtaaaaaatatggaaattgaaatagaaatggttttgccgttataccaatcgtttccgtatttaccttgttcttctgaaaatcaccgtttcttataatatggtaattaccgcatctctaaaaatgtcgatattcataagacatatttctacttgacccacagtttagagattgattgactcttcaatcaaatccctaacttgagtgcatggctaaaatggagttaatttgtaatttatatagtataagcttgaatttatttatacatataacatacttatgtaaagttaaatatatgttttacagtttaatatatgtttccgtatttgttaccggtttctgatatgtatcaatatgtttctgtccatattgttccgattcaggttttccgatattgtttttgttcctcacattaccattttttatttttgaaatggtttaggttgttttccgattgtttccgaccgctttcatccctactgcacacactgatcaagacactacagctccccagcaactcgtacccctcagtgcatctccctgcatacaaattgaattgattttccatgctaattgccagacaattaaaccggctattctacataatatggccagctcaaatgaaaccaaatattgaccaaattatggcacaaacaaagtaagatctagctagtccaatcagcggttccatgtgagaagcgtgtgcactagcttgaagatcacaccaaaaacaaaatgcccccgtttcccacttgtacctctccttgtgtgtcacatctacattttgtttgccttttttctttcaaatccatttgactattaagtagtaattgttgtttttttcatagtactcattattttttcaacttcctttgaatgtagttctttaaaaagtaaatgtgacaatctagtggattaaaagtatattaagtattcggatagttacataaacattttcttgaagtacgtgattacacattgtcaggttacggataagacatacctccaatcctacaatttactaaatataccggattggcaaacctcatatccaacgatatttttccgtatgcaataaggaaatatacaagatattatggaaaatatcctcacgggctgatgattatcaaagtcctactcggagaggatagggactattctatatcgtgcagggttcgttgtctccgagttctacttgaagactaaggcaattc

SEQ ID NO: 76024 - DNA, 10113 bp, Oryza sativa
gtcggtatcgtcggattcatctgttccctttttactctgtggttttctatatcaatctcatataaactggattagggctattacctcacgaggggcctgaaccagtataatccttgtctcttgtctactttgatatcgtatcgtatagatcctcgtaccaacgtacctcaatacacattttatccggtctacaggtatcccccatcgacagtggtgcgccaggtaggggactttggtgctcaaggttctgccgacatgacttcaagccgctccgacaacttcatctacatcggccccaatgcaggagatccaacctcaattccgatgatgtggactcaagtcggatccatcatctttccggtctactctgtgataccgatctcgtctggcccaatctctgttaggaacgagaacgtcgcagctacgactttacggaaaaggcaaatttatgtcatcagtgcctccctccgactgtacggaaaaggcaaatttatgtaattggctaggagacatcgtaaaattgcgtcgttgctgatggacaccacaaaattcgtgtaatttgctataggacacccgagacaatattttttatttccgagaaaaaagaggagagagaaattttaaaaaaggcaaagttgccctcagccctatctaacacccctaacccatcggcaaagcaggccaggtgccgacttcgacgactactggcgagccccggggtagcagcttcggcagtggctggcgagcttggcagtggcctcgatgatggtcggcaagcccggcagcagcggcttcgatggcagtggtggtggcggaggcaatggcttcgacggtggcgatggcggcagcggcgggttagacggcggttggtgagtggctctagaaagcacgcagcggaggcagctttgatgatggttcgcgagcccgacggcagtggcttcgaggcggaggtcaaggcgaaggccacagcgggtggtgacaaacggcttcgatgatggtcaacgaggccggcggctgcagttttgatggcagcggtgacggaggcagtggcgggcagcgctgggaagcaggcggggattagatagggccaagggcaattttgtctttttgaaatttctctctcccctttttgataagaaatgataaaaaattgtctcgggtgttctacaacaaattacataaattttatggcgtccatcagcagtgacgtgattttatagtgtcttctagccaattacataatttttgggtgtcctagggacaattttgcctacggaaaaacagacgtcgactacgacaacatctagggaacaacctcaagcggccaacctctggtgcaagaaccttgtgccttgaaggcgtgttccattggcactatgctgtagagacgtgggatgcatctctttttgggcaaatatgcaagtaccaactggaccggagcagcaaacagctagaaaagaagagggcatctcctctttcttgtgtgcgagtaggtgttgcggaagcaagaagctgtgcatagctaagagtggatgaaggctaaccaaggcggcacatgagctcaagagaggggctgggtgcagctaagcagcatgatcacaactggcgaggtgtatagccagaaaagactcgcacataatgcggtctttgatctagatgtagcccgtcagccctcttgctctcttcctcttctctcatctttttctgcttttcttccgtctctcttttcttctctttttttaagcaaggtgacaccaacttaaaaccttgatggaactcatcatgaaaatcttgtcgatcgccctcccccacacttggacttttatgtcatgagacgtcaaaaaccaagtgtctgagactgggatcttcataaagtatgttccaacatcaaggatctccaaaatgaatagttgatgtagctcccatgttcttaggcatcgtatgtccctcgttcttaatcttaacctgaaatggttactgaccaagaatacctgaagatgcatactattttagaactggttcttgcttttattggaaggaaaacgtaccaagataatccgggatatctcccgtagtgctttgtttatggtcacaagctcgaccatggagacatctagctgcaagattagtgccacaaaaaaaatacgagatttgcaatatttctgataaacaaaagcatccacaaccacacttctaatcatgttagaaatgaggaccataaggtggttgtggtcctcgtacaaagaagcggcactaatcggacaagactttggagattccttatgtgagtatcaatcctgaggaactttgaaagaaaaactttcatactcatttgtggagttctcatcctctagagttgatgtctcgaacttgtccttggcttgaaggttctccttgtcaaaagatgtgtcatgcaagatcagggttatttcttgaaaattgttgagaacaacatcttgagggctagagggacaagattttggcttgataggaggttgtgatggcggttctaggattggaagttcaaaagtttcaccggaatcaacttctttttcaatgaaatctgagacatcattttcaagaaatgattcgggggactcagatggcagaacagtcgtcacctcctttgcgtacttatctttaggcagaaagtcagtcaaggcaaatcttgactgcgagaatggcagtgagaattcattcccgcctaaagagaaattgaacctgcctactcgaggggtgttgatgagatgtttctcaatagggtgcccgattagaatattgaaatcctggacttcaaaaacatggaaatccaggataacctcgttgctatcatgaatgactggcatatcttggacaaccccaaatccttcaataatgctcccattgggatgcttgaagaatttgtcagttggtgtaattgtcttatcacttaggtatgcaaacgcaaaggattctgagacaatattgacaccgactattgggctgtagagaatcacaacattattcccctctaagtgacaaggaatgggccgaggagtggaatttatcggaattacttcagaagaaagctcaacctcctttagccattcgtcactcataatagaggtcaactctcgaactgtttccttaagaaactggaattctatcgagtcaggaggtagtgagggaacatatggttttctcttgctaaagtagttcaaggtgtttccgtaatcttcatcaagatcatccctcaacaagagagcacaacccggagtttgaatttcttcggtctcaatgggtcatggctcgggaagaggttctcgggtcgaatcaggagaagtagagacttcaactgatgcctcggggaggggctcattatattcgttcatgaaggaggtgttttttagaattcaatctagaattaccttcctttcaatcggagttttgtgcatgaatgatcctacagcagtgatgtctagatagattgcagactccttttctaaacccgaataaaaatgttgcagcagcacatgatcgggtatagatagggatggcattttcacccgtggggtcaggtccaggggacccgccctataggggtgggggtggggccatttttcaatccgcggggcttcatggccgggggagggcatccacccgtgggtgacccacggggccctggggtggtatgctacatcacaatacacagcccattctaggccgaataagtccgacttgctgaaatagtggcatataaaaggccaaaacctaaccctatcctcactttttcctttcccctcactccatcctcacagctagctgccactccaccatctaggcgagcgtcgcaaccgagagaccccgccgcaccgcgcactgcctcacacaccagcaggctcgacgcccgcgcatggccctccccatccggtctcatgtcgtcgtcgcatcagccacctgagcccggcgaccaggtaaaccgatgtggcgtgcgggtgggcgatggctagggttcacgcgtgcaagcgccaggcagcgagcagcgcaacgggctgctaggctgtcacaccctaaaaatcctaaatatataaattgttgtttaattggaattattagaatttattttaaaaacctaaaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttaaaatcctcttttggctttgggccgaaagtcctctctctctctctccctcggcccagtcggcccagtccggcagcagccgcccgcgcgcgtgtccgcccgctgacaggtggggcccacctgtcaggcctgtcgtcttcctccggccgcccgccgcccgaaccctagcgccgcgccgccgtcgtctccttccaaattcggccacctctttccgtttccggtgaaatcaatagaggggaaatgatcttcgggatcccctctatcttttctcttttggaatcgtcggctaaaatcgtttggaaatccgtggattcgagttcgattcggatcgatctctctcctccgaaccctagactttccttcgccgtcgccggtcgccgtgggccttcgccgccgccttccaacccctatataaggacccccaagcccgccgctacccgtcgccacccttgctttcgcctctcgccgtcggtagcgccctagccctgtgagacctcgcgtcaccgtcgtcgccgccagccgtgcgccgccgtcgctccagtcgtcgccgtcgctcggggaggtcgccatcgtggtcgccgtcgcgtcgccgtcctcgtccgcccctccgccgtcgctgtcgatcgccggaacaccgccgtcgtcgtcaagccgaaggtcgccgccgcttcttcctcgacgccgtcgccgtccgttgatcttccgccgttgctttggtcaccggtgagttcgccgtgccgtccgctacccgtgggtgctctccgttcgcgccgccgcgccgtcgttcgccggcgagtattgtcacatcctgatttttgtttcaggatttataaatcatttaataaattattattagaatttatattaaatgatctttaacttacaagtgaagttaaatgtgggaaataaaatttcctaaatataaagcatggatggatttaatttttattaaattctccatgattaagtcaactctctgaaatattctcggatttttcagagctcaattcctaaatgatacaaagaacagttcagtaattatttgatcattaatgatctaattatattttttaagagcttttcttgtttaaaaatccttaaattacaaattgttgtttaaaaggaattattagaaatgatcttaaaagcctaaaagagaagatctaattttaatttgttaaatctcaatataaaattgggctagataaaatttttttaaatactttgcttaattctataattcctagatttttctgggattaatttgagctaaggaaataattttaataaatggaattgcatttcatgaataatttaaattgaaaaaggtttttaaaagtctcttttggctttgggccgaaagccggcccaaaacctctctctttctctctccctccccggcccagtcggcccaggccgccgccgctctcctctctctctcgctgtcgctgacaggtggggcccgcctgtcggacccgtcttcctccttcggccgccgccgcccgaaaccctagcgccgcgccgccgccgtctccttcccaaattcggccgcgtctttcccgatccggtgaaatcttttgaggggaaacaatcttcgggatctcctcttccttttctcttatagaaactccggtcaatttcctttggaaataggcggattcgagtttgattcggattcgtttttccccgacctttccttctcgtcgccggcagccgtgggccttcgccgctgcctccttgcccctatataaggatctccaagtccgccgctacccgccgccaccctcgccttcgtccctcgtcgtcggaagagccctagcaccgtgagacctcgcgccgccgtcgtcgccgtcgctccagccgtgcgccgccgtcgtttcggtcgtcgtcgttgctcggggaggccgccatcgtggtcgccaagtcgtcgccgtcctcgtccgccgcttcaccgccgccgaagaccgccggagcaccgtcgccgccgtcgacccgatctccgccgccgcttcttcctcgtcgccgacgccgtccgttgcttttccaccgttgttttggtcaccggtgagttcgccgcgtcgccctctacccgttggtgtcctccgtttgcgtcgccgcgccgtcgttcgccggcgagcatgcgttgccgagccgccgccggtgctgacgtcatcgctgacgtctgtcacatcctgattttttcgtttcaggatttataaataatttaataaattaataatagaatttatgttaaatgttctttaatttacaagtgaagtaaaatgtgggaaataaaatttcctaaatataaagcatggatggatttaattttttattaaattctccatggttaattatactctctgaaattttctcggatttttcagagctcaattcctaaatgatacaaagaacagttcagtaattatttgatcattaatgatctaattatatttgttaagagcttttcttgtttaaaaatccttaaattataaattgttgtttaaaaggaattattagaaatgattttaaaagcctagaagagaagatctaattttaatttgctaaatctcaatataaatttgggctagataaaatttcattaaatactttgcttaattctataattcctagatttttctgggatttatttgagctaaggaagtatttttaataaatggaattgcatttcatgaataatttaaattgaaaaaggttttaaaagtcttcttttggctttgggccgaaagccggcccaacacctctcttctctctctccccggcccaagttggcccagtccgccgagccgccgctctcctctctctctcagccgctgacaggtgggccccacttgtcggtttcgtcttcctcctccggccgccgccgcccgaaaccctagccgagcagctccgccgccgctttccaaaattcggtcgatcctttccttctccggccgaattgatagaggggaaataatctcctcgatctcctcttccttttctcttatagaaactccggtcaatttcctttggaaataggcggattcgagtttgattcggattcgtttttccccgaagtttccttctcgccgccggccgccgtgggccttcgccgccgcctccttgcacctataaaaggacccccgagctctcctctacccgccgcctccctcgccttcgtctctagtcgtctgtagcgccctagcgccgtgccgcctcgcgccgccgtcgtcgccgtcgctccagccgtgcgccgccgtcgctccagtcggtcgccgtcgccaccatcgggttcgcaaggtcgtcgccgtccccgtccaccgcttcgccgccgccgaagaccgccggagcgccatcaccatcgtcgacccgatctccgccgccgcttcttcctcgtcgccggcgtcgtccattgatcttccgccgctcctttggtcaccggtgagttcgccgtgccgtccgctacccgttggtgccctccgttcgtgccgaagtgccgccgttcgccggcgagcatgcgagcttgcgcctcccgagccgccgccggtggtgacgtcatcgctgacgtcatcgtcgccctctcccgtgagccggtcgtggaccgatcgatctcggccgttcgtcccgtgaaccgctgccgtgcacccggtccaccgcaaaccctagccgctgacacaataatccttcttttccttttcaaaaataattcattattgcgtcataattcaattaaaatcaatataagtgttttaatccgatttaatctttaaaaattcataactaattcatttgaactcagtttaatgtggttcaagttgcaaaagttgtgtaaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcccaaacacaatcctttgagcatgttgatcctatatttaaattctctatttatttcaactatgcatttattttcgaatgtcaccgggtggtgtgaacttattcctttgttatggccaatttgcattgattactttattccttgataccttgggttattataacttgactagttgagctttacatattggttcagctagatattagttatgattgcttagccatgcttagaaacattagcacactattgggataacttatgactcattattatttaatgatggcttaatgatagttcacgatggttaatcgtgattggttaattaattacttgccaactaaaacttgataatggtgggttgtgagcacatggttttaagagtcgtgctcatgacaattaaggaccggttcgcgagctactattgtgaaacattaatcgtgccaaccacaagccagcgtgggcaacggctttacctttcgtatagcatggttcattgcagagcaccagactgagaagtggcggagataagcccacgggggtcgctggggagtccatgccttgtttataagggggtgactatgatccaggaatggtgcgctttggtgggttgtgttgtgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttatacctggtaataatttgcttagctcctggtttggagattagatctgtacagccgggtatggttgcttcagaatggttgggcctgagcagcatgggtgtgctgttcagtgttgattaaaatttctgattaattactccactgttttacttctcttaaatgttttgctaaaagctgcttttgcaaatgagcctatattatgccaacctttggtatccttgtgcacttgcatatttgctgtgtggcttgctgagtatgtcatatgctcaccttgcaataatcaatcaacctcagttgaagaaaaaggattcagaagaagaagacgtttagcttataccccagttgagctgcctgtgggagtggagccggagcttcgctagattttattttccgctgtaattttcttcctggtgaggactaagtgcctcataagtaagtatttatcgttttagttaatttgataaatctgtatattaaattgtcagtttgtgtacctcggctgattcctggacgaggattttatgcacaaataagttcggaaattactagtgaatttccaagcgtgacaacgtcatcgttgccattccccgtgagccggtcgtggaccgattgatctcggccgtccgttttggataggatcgatctcggccgtccgttcccgtgaaccgttgccgtgcgcccggtccaccgcaaaccctagccgctgacgcaataatcctccttttccttttcaaaaataattcattattgcgtcataattcaattaaaatccacataagtgttttaatccgatttaatctttaaaaattcataactaattcatcttaactcagtttaa

SEQ ID NO: 76025 - DNA, 16530 bp, Oryza sativa
cctgtgggagtggagccggagcttcctagattttatttttcgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagtttggaaattacgagtgaatttccgggcgtgacaagtatgcacgcccgagccgccgccggtggtgacgtcaccgctgacgtcatcgtcgtcgttccccgtggcctggtcgtggaccgttggatcttggccgtccgttttggataggatcgatctcggccgttcgtttccgtgagccaccgccgtgcacccggtccaccgcaaaccctagccgctgacgcaataaacccctttttccttttcaaaaataattcattattgcgtcataattcaattaaaatccatataagtgttttaatccgatttaatctttaaaaattcataactaattcatcttagctcggatttagttggttcaagtctctaaatttttctcaaattgagatctacatgttaaaaatatccacatgtactgttcatgcttgtttatgtgctgttttggtattttgctcttttctgtttagattccgacgtttccggagagtccgttttcgcaggagaagaatttgaagagttccaaggccagtaaggcaagtcacccagatcctaaacacaatcctttgagcatgttgatcctatatttatattctctatttatttcaactgtgcatttatttttggatgtcactgggtggtgtgaatctattcctttgttatggcctgtttgcattgattactttattccttgataccttgggttattataacttgactagttgggctatatatattggttcagctagatattagatatgattgcttagccatgcttagaaacattagcacactcttgggataacttatgactcactattatttaatgatggcttaatgatagttcacgatggtcaatcatgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctagggagtccatgccttatttataagggggtgattatgatccaggaaatgtgcgctgtggtggattgtgttgtgcaaggggtactgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgtttagctcctggtttggaatggtatattcctggtttggagatagatctgtacagccgggtatggttgttcaggatggttgggcctgagcagcatgggtgtgctgtttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaagagttctacagtgatgctgatggtgtggaggattaggtgtagccctggtcaaactgcctatggagtggagccgtctgcgtcgtttatcttattttttcgctgcttagatctttattgattgagaggaactatctacctctgtaatgacgttttattcgcttattaattagagtaataattgtactctattatcaatttgttattgtgtgcctcggctgattcctggacgagggttcacacacatgtaagcgtttggaattttggatagaaattccgggcgtgacataggcgagggcaagcaggcacataggcgagcagcaaagcaggtgacggccgacgggcaaacaaaaactcaggaggtgtcgatctaaatttctgtaatgtgttctttcattgtttggtaattatatatcccgatgacttagaacatgattctggtgctttctcagtttgatgatctttggtttgaacgcagaacaccatttctttggatagaatgtcaaagttataaattatttttgatgaaccactgattgttctgctatttttttttttgctaattgaatggtgcggacactcaatcggggccccggtcgggctagggctgcgggctgttttagccccgcaactaacctcgggggcggggggagaagttgggagtcgggggcgggggcgttccagcccaaccccccctcgacccgccctgttgccaatcctaggtatagataaggttgggccaaattgcactagattaggatgtgtttggatggagggattggctgggatagggtatggccacccaaattttggaggtgtttggatggtgggcggtactgggatatggccaccccctagggaatattccctccagatgccggctctgtgcatccggccaattcggccggacagggcggcccaggaccgcgcgcgactcatgcaagtgaagtggtcgcgtgccctcacctcctcccatccttttctctcttttttctcctctgttctcaccggttcacagtggcaaaccctagctctcctccctcattcagcggtgcaccaggcggggtggttcggcggagcgggtggccgcgccggggacgagcggtaggcggggcgggcggcaggtgtcggcggcaccaagtagtgatacgggttatcggaaaaaaggcaagacaaaatctgtctcgcagcttttccagtcaccattcacacatccaatggtagatgtgtatcaatggttcgctctctcgtgaagagagaacggaaacaatttcccctgaacagtattttgtctcatgccacgaatcttaaggcacgaacatagctgttcgaattcccgcaaataatggtaaggattttctcggtcaagaccagaaaaaggattttccttaatcatacgtattaattcagggcagatctcatagccagttgtataaataggctccgatgaaggaggtggctcgtaagattcgcctcgtggagcagatagctgaaaaattgatgatggctccttcggtcaagaaggttttactggaattcttctctagggtagcaggggtgatggtagaagatgaacaaggttcggagatagacagcaaccgttccccgacaacggcggcagaaatgcttgttggtatttattaacctcacagataaaatccgcaagcgcacagaaaataccgatgtagcacttcactgggagtattctcaggtatcgatttccatagggagcgtgtgtgtcaactccagatcaggttgatccaaggacacgaagctaatgataggcaaaggatagagaggaacagtgtctacggaaagcttaactttaatcctaacgcgatacttcgggcactggccagctcgctgctcctagatatcgctctactatgcacccgggcaaggaggacttcagtgatctcgagggttgtcaccacctctacacccacctcacacctactgtgggaagcggagcaaacaccggaaatcaactacctagacaccgcgtataagcagttaataacttactttaatgttagctataaactaaagcactcactatattttactggattatagtgaacgatgatcatgtccgctgattaggaactaaccaagacataattttcaccaagcaaaacaaaattactcaaaagatatttctattataatcagagtaattaacatggcaaaaaataagaagaggattaccgataactccagaactcctccgacttcttctactctactctccctaatcaagtataaaataaagttcaatagagcctcttataattcagcgcaagcttgcagtgtgtgtgtgtgaagtgagtgaggtgaggtccttaaatagggcaggtataacggttaggaaaacgtgacatgtcctttttgcccttcaaccgccattaggagctcatctggaccatacacgccaaaccctagcctgaacggctgagattgtggttcggccgaaccctggccaggcccaacaggcctgcactttggcctgttgcctctcctcctcctcttctatccatttttgtgtgtggaaggcccatttggtcgtattttaatgtagttcttggcccacttgtgatatggacaggaattctccttcacttaagtctatatttcatccaacttcgacggtttatcacctgcattcaaatgtacacaacacttgtggaatatgtcataattaaaccctatcactatgttggatgttttatttccttgatttatgcaggtattttgttaggagctaccataggcagcccccgattacgcaatgcgtatgtgtggacgacgggaggacgaggtcaatagcttcgcctccccggcgccgtgctgtgagatggaacagagagggagagattagagagaacagaggaaggagacagtagatgagattaaatttcttgcttggatttaaccataacaatccacggcttaagtagccttacatgctagcaaactttagctaacaaacttgctaattaaaagggataacagaaacaaattatcaagctgatcctaatccaccgaattcagtggcacgagatactattcctcgtccggcacggtgttcgtccgtccgcccgcaccgctgaaagggaattccccacataacatattggcggcataaaattggcatttagcaactgccaacagttaagttgagggacctccggtgaacttagtccttttaattattgggctgtgtcttctactttctacaaagcccacagatattttttcgggcagattggaaaaagttcactttgactccttcaaatagaggttcgttttgacccaataagtattgaaaccagtgcagaatgactccctcggtgattttgtgggtgattttcgctggcgtggctagttgatttggtctaacctgctgagtcatcatgtaaggcccacatgtcagtgtcacatatgtttccttctctcgttcctttttctctcctccctccactttctctctcaaccttttctctatgctccatgcatctccctcggtgatggcgagaactcttcctctctcgataatcatggaagctgcagccaagacggcgtccaagaaggaaggaagtgggcgacgagcagatccaagcagcgtggtggtccttccatactcccgcctcccgcgccacgccctcggtcgttgtgggcgtgctcccttgaggacgcgtcgccactgctgacgcaaccaacggagccgatgctggcgctgccgcctccgtctcaccttcttataagtcccaacgctaggactcgtgtttgtgctagatctgctggccgaagcaggcgagatagagaaactgctggggaaactgaagcctgctcgagtggatcctggtgacctccagaccttcctcggatcctctgcagcgacggaggagacaatggagttgcgcatgcgagcttcctcctctgccattggtgccagttcatcaaggacgcacgccgcaggcatgaagtagtgggtagcgtagatcgagtataggtacgtatccactggatgggtggtgatcagttcattcctatttcatagatcttgttggtaggctagtcagattttttttatctaaatctctctttttcgaactgcatgagtgcttaaagttttgaatttttcatggccaagttcatgtgtattgtgttgttttagttctaagtttcttgaaccatggttcttctctcctgtgttgtttttgtgtttttcagagccttgattacatcttttgatagcaaagttcaatgtagttgtgcagacattcgatagttgccgccaccgacagccgtatggtagacatcaacgagctcgacgagtgggcagctggcggcggctcaaccacttcggcacttgtgcccatcatccccaccgtgaagaggttgttctcgacggctcgctgaagagaaggtggggaagttcctgacaaactgggcccactctttttttttaattcatatgctgactgggctaacacgtatacaccacgtcaaccaaaaccgctatcaaaatagctgagagagtcgttttgcacggttttcatagttataggggtcgatatttttggttttacgtttaagggatacgaattagatctgacgtatatttgagggagtcaaattgaatttttttccaggtagattaggagcataggacttcattcaaatgtttcttgttttttttgggcttcactgctggagaaaccatttattctcccggttggtaacccctttagtcccggtttttcaaccgggactatgaatccgggactaaagatgcccatatttagtttcggttgaaataaccggggctaaagatccatttttgtcccggttggtaacaccaatcgggactaaatataccttatctttagtcccggttggggactaaagagagggtagcgacagttccatttggtctctttttttttcattgttttttagctggagtttaatccctgtattttctcccaaatcaagtgggatacatatcccaaatcaaacctcaaatcaaagtaacatcccaaaacattcccattacaaatcttaagttacttatacacacaaatcaaatatatcataaatcttaaaaaaattacacacaaaccaaatacatcacagattatacatctcaggtcatgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaagtcccctttccctccctctccctcttgggccggctcggcccatctccctccccctccctctcctctccccgcggcccatccggccttcccccgcgcgcgcgccgctgacgggcgggcccgcccgccaccctcgctgacgggtggggcccacccgtcatccccttcctcccgccgctcccgccgcctcgcccgcgccctagcggcgccgccgccgcgaatcccgccgcctcctgccgtccccgcgtgcaatcagtagggggaattattccccgtgattccctctccctttccccccacttttccctctctctctcgcgttcaaacgggcgaatttgcccccgcaaatctcgccggcgccattgatggcggccggacctcccgcgcctattccttccccgccggccgccctctcccccttccaaccatatataaaccctccccgcgcctcctccgtccgtttccgcctctcgccgcccttcctcctcgacggaatcgagctcgcgccgtcgctctctctctccgccgtcgccgtcgagctccggtccgccgtcgtcgtcaccccggaccatctcccaccccggcgtcgcctccttcggcttcgccgcatcctcggcgaccttgtccacccctccgtttcgctcgccgaccgccggaacgccgccgtccccgtcgacctgagccgcgccgccgccttcctccgctccggctgccattccgtcgtcgccgtcgacctagggtgagccgtggaccgccgcttcttttcccccttcccttcccctctctcggccgccgctccgccgtgcctatggccgccgccggcgaccataggggcgcgggtgcgccgcctcccgccggctgtgccggcgtggccgccttcgggcgcaccgtgcggctgccgcgtggggcccggccgtcagccgcccgcgccctcgggtgcggctgacgcgtgggacccacggcgccggccggtgtgagcccgggtgcgcccggtccatcgtggaccgtgaggctgccgcgtgggccccactcccgtggacccggtccgcgcgcccctcccctcggctgacgcaataaaccttttttttaattaaaatttaaatgaagaaattcgcaaatattcatttaaagagcatataaacttcaaatggccaactcggaattggaccgttcaagtctctaatttttccttaagaagtcaagaacccatttttgtgctttgtttcagcttgttatatggagtttattagagtaaaagccttttcttttccgttggtcgtgtagacgctgcagcttcagaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacttttgttatgaccttattattgttattgttattatttccttgttcaccctagaataaacaaaaccccaactagtggacactctactcatggtaccactagtatgattttaggtagatgcttcgctggttaattaggcaacattatgtggttttacaactctagactttgggatattcatatcacctggacactatggaatggtttgattattgtggaattggattcacacctccccctctattcaaaaccctcaaaatggttttaggctgggctcggggtgcatggttttgatagtagcacctcggccatacaaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctcggggctcagtcctgactacctgtcacatcctgatttttgtttcaggatttataaattatttaataaattattaatagaatttatgttaaatgatctttaattttcaagtgaagttaaatgtgggaaataaaatttcctaaatataaagcatggatggatttaattttttattaaattctccatgattaattatactctctgaaattttctcggaattttcggagctcaattcctaatgttaataatacaaagagcatttcagtaattacccacatattaaattaatcattaaatggtctgattataattttgttaagtactttgagtgttcaagtattttcaagatttttcttggaattatttgagcataggaagtatttttaacaattcaaagatcatttcagtgattaatttaattggaaaagtatttaaaatccccttctccttttcgggccgaaataggaaaagttcagcttcagtcctcggcccattctcccattttttcggctggccttatccctcctccaaagtctgctttgtgtccctctttcaatcgggccaagaagtagaagcccagccgaaagtctagttggcctccctgcgctactgttcatcttccagctctggacagagcccgagccagccgagcctgtgcacagtgccgccttcttccaccaaatccggcctcctcgttgctcctctttccaaattagttgcgggaatggaatcctctcaatctcctcttccttttccccaagaaatccccaaaattttatatggaaatcctttccaatttcgcggttcaacctttcctttttccggcgaaccctacctaatccgtcgccgattccatccgttcccgagtcgttctctccctcttctggctatataaaggaccccctagtcctcctctttcgtttgccccctctcccgtggtctcccgtgcctcgtagcgccgccaccacgtgctccaccccgccgtcgtcgccggcgccgctccagccgccgtgcgccgtcgccccggccgtcgccggtcagtgccgtcgcctccctcagcttcgcaagggtgagagctaccccggccacccgttcttttgcgccgaaccccgccggaagtcgccgtcaccgtgaaggccgaaccgttgccatgttttgatctccggcgaagctttgccgtcgactccgtggtcgccggacctcgccgtatccactgtcggcatcgcagcagtgaggagaagcccggcagccatctccccgaagccaaaatccaccggagctccatcgtcgccgtcaaccctgtggagattatggatatcccatatctacacggcgatggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactcctccccatatataaggggggtccgggtgcctctaggggcagatgttgattttccctaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggaatcaaaccagtcgggagagaaccggctttcagtcccgtttggattcccgaacgcggctgaaagctacttcaaaaccatctcaaccgagtcggcttcaaaccactcggccgagatcgcatcttctccaacgacaccagatcaagatgatggggcttacccaccagtcctgatgaagctccccgacgatttggtggccgtctccatcgcgacagcgtcttcttcccgtaggcctaggcggaagtcggcttcaacactgatttcgcctagcttcagggaagttggcgtcatcctccaaccactcggcacggtttcgacggatcagctagatggcgactacagctctcccaccgtcgactcgcgccccaccaacatcgtggagtacgacgagtttagctctcgctaccacgatccggatctcgacgacttcgacggaagcctagatgacaactacacccctctctactttggcgtcttcatggccaataacgagacggaggagcaacgccaagcccgggagaccgaagcgcgtcgcgagactgagcgccgccgactggaagaggagcatcaagcacaagaacaagaacgattacggcgtgagcagcaggagcgtgagcggaccgcgaaggaggctgaagatcgacggcagcgagctttggaagcagggcgccgggcgcgtgatctcatcggccagcaagatgttgaagggacgccggttttccgcacccctcaacagaatgcggttgccgcgatcacccttctcgacaccctcctcaaccaaaacgagctcaatcaatccgaccacgtcgtcaacatcttgaaccagacgaagaccatgattgcggcttcagtcccagttaactccgaaagcgtccacacgccgactggtagccgagtccctcacttccgatctcatgactaccgtcatccaagcctcagcatcaccggcgcaggatctaatcgcaggagcaggggtcacgacgagcggtccattcactcacctcccgaccaatatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcaccgacgatctgcgtcgagtggattggccagccggcttcaagccgactggaatagagaagtacgacggtaccactaatccagaatcgtagcttaccgtctacggtcttgcaatccgcgcagcaggaggagacaacaaggccatggcgaactatttaccagtggctttagcagattccgcccgatcttggctccatggattgccccgtggtacaattggatcttgggctgaattaagcgaccacttcatcgccaacttccaaggcaccttcgagcgtcccggcacacaatacgacctctacaacgtcattcagaagtccggagaatcccttcgagattacatccggcgattttctgaacaacgtaacaagatctccgacatcaccgatgacgtcatcatcgccgcattcaccaaagggattcgccacgaagaattggtcggcaagttcgggcgtaagccccccaggacagtcaagcttatgtttgaaaaagccaacgagtacgccaaagccgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaatttgcggatcaatacaccaagactgcacgaaagaactctgacgaagaacaaagcacgtcaaggaagaaggacgacggcgacaccccggcaggttttcaagatcaccgcaaggagctcaaccatatcttcggcggccccctggcttatgagtctaaacggaagcagaagttgactgaacgggagatcaatgctgttcagcccgacacgccccagtatcttcgttggtcagagattgcaatcaagtttgaccgctcggatcatcctgaccgagtggtccacccggggcggtaccccctggtactagacccagtggtccgtaatgtcaagcttcgcagaaccctcattgacggtggcagtgcactcaatatcctcttcgccaagaccttggatgatatgcagattcctcgctccgagctaaaaccaagcaatgcgcctttccacggagtaattccaggattatccgcaactccactcggccagatcaccctcccagtcacttttggcactcgggaaaacttccgcacagagaacatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaactcacgagatggcgtctgcccgagaggttatccgactggctgcagccacggcgagcgaaggagaagtgcccgctaccaagatttcaaagaatggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaaacctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgcgttgattatactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccttttggtgcatactgctacgtcaccatgccgtttggactaaaaaatgcaggagcaacttatcaacgtatgattcagagatgcttctcaacacaaattggccgcaacgttgaagcctatgtggatgatgtagtcgtcaagaccaagcaaaaggatgatttgattttggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagccgactggatgcatggcggcgctcagccgatttgtttcaaggcttggcgagcgggggatgcctttctttaagctgctgaagaaaacagataacttccagtggggacccgaagcacagaaggccttcgaagatttcaagaaactcctcaccgagccaccagtcttagcctcaccacacccgcaagagccgttgttgctgtatgtatcagccacctcccaggttgtgagcacagtcttggtcgttgagcgcgaggaagaaggccatgtccaaaaagtccagcgaccaatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacgtattgctaagtgggctttggagttgatgtctttggacatatcattcaagccccgaatttcaatcaagtcccaagcgttagctgattttgtcgccgaatggaccgagtgccaggaggatacccccgcggagaacatggagcactggaccatgcattttgacggatccaaacgactttcgggcactggagcaggagtggttttgatttccccaactggagaaagattgagctatgtgctttggatacatttttcggcgtcccacaacgtcgccgagtatgaggccctccttcatggactacggattgcaatttccctagggataaagcgtctgattgttcgaggcgattcacagttggttgtcaaccaagttatgaaagagtggtcctgcattgacgacaatatgatggcatatcgacaagaggtgcgcaaattggaagacaagttcgagggactcgagctcagtcacgttcttcgacacaacaatgaagccgccgacagacttgccaattttggatccaagcgcgagacggcgccctcagatgttttcgtcgaacacctttatacaccgaccgtacctcatagagatactactcaagatgcggacactcatgacgtagctatggttgaagccgactggcgagagcccttcatacgatttttaacttctcaagagctcccttgtcacgcccagaaattcccgaatagaattccaagcagaatgtgtattaaaacccccgtccaggaccagccggggtacacaaacgacaatgttgacatacagatccacgtcttacaaacattataaaagtcttacagaaatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcagggaattaacaaagaagagctagagtggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatc

SEQ ID NO: 76026 - DNA, 1937 bp, Oryza sativa
ttagcctatgtgatgctacagtaaacatgtgttaatcatggattaattaggcttaatagattcgtctcgcattagcctccatctatgtaattagttttgtaattagtctatgttcaatactctaaattagcgtccagtcatccgatgtgacagggattgtccctgtatccaaagtgccactaaattcatatgttttaaaaatcctaaaaaaccccgatgtgtgagatatctttgtatgttttccccttttctgtgtcttacaagccgtatggtgcaaaagaagcactaaagcagagcacaagacgacacaacccggggactggctgataataaccgcttgaagagaccagcggttaaggtatcttcgtcatcaccggtgagtactgtgaatatgtgcgtgagatgaattgaatgaggccatatatcgcacacaacaacggtgtgacatcgcgatcgaatttgttaggagttaggtggcaggaatttggagcaacttggagaaaaaaaaaggtgaaagaggacacaaggatagatatggtggctattggtcagataccccatattgtcttacaattatcgttcaggtattagccggtctacgggtgtcttaaaatgacctgcccatatgtgataaaaaaatcattgtggccagtggcggagcggcctggccccctccaacaaaaatagtttcacatataatcacctatctataattaggtaattaacctaattagtgtattaataattatataattaggtcccctgcaagacttttaggctcatcctatatatagccaaatcctggctttgtcactgattgtggctcatgagttttcgatgctgcccgaagcatagagtgccgccgggcctgggccgcccatgcatatattataattggttggcctacgcatataattgtgtgaattatgctatcactgaaccagaacgtttgccacaattcagatgtgttgagttgttgaaagtatatgcatgtgacaagttatattcatgatatatatgtgtaccactcttcatgattaagagcaatagtaatgcgtcccaaaattttaccgacctcacataccacatagactaagaaccatattagctatatactccacaatgcatgttacttatagtgggtcttacctatctctctcctcacttttatctctccccctctctctcctctcacttttcccaccagtctctctctctctcgggcggaggaagcgaagcggcacctgtggcgagcagggctccacacctccacctctcctcgtcagggccggaggcagcgatgtcatcgtccgagcccaaacctctccactgcctccttcgccgtgggtcaaagctgccggagccggagccattgctcaacctcccgctcctccgtgagtccatctccatccctgccgacgagccggacaccaccaagcacaagcgagcatcggggcactgcccccgcagctctagaagcccaaacaacatcggcagtggccgccgccacggccacaacgatggcagtgtagaggagaggtggtggcatggcccaagcggtgacgacgccgggcggggctccacgtcgggcaggcaaaagatgcggacgacggcgccgccgagttacggatctcgggaggctcttctccctctccgtcgcctcccttgtcggctccgaatcgacctcggcggcgcggcctctctctcttcgtcgactccttcttccaccttctatcttcctcattgctgctgccacgcagtggcagcctcctcgagctcacgctgtggcggcggcgacctccccgagcccacacgtcggatctggccgaagaggcggtctaggcggtggcgtccccaagccctcgcggtggttgcagaaaagttggaggagaggagcggcaacttcggatccattgtacccgcttcccaaggctcat

SEQ ID NO: 76027 - DNA, 4045 bp, Oryza sativa
ttatcaagagcctgacgggtcccatttcttttattagaaataaaacatcgagctacagtagtcttcaaaaagaaacaggaaataaaaacggaaccttccacagagaaatgggggttaagaattcaaaagctagccctattacaaggggttcctgactcttttcagaagttttgcctgaacagatatctaacagcaaaaaagaaggagagggaattacaaaacatcatcacttatatctatctcatccctcaatccttttattgttgattctccatccgaactgcgagttgtagacttcatttgccgccctatcttatgagtctggatcccagtagcagtcttcttcgacttgcctcctccttttgcagtagtgcccaggaatcaactcaatggcaagccaaaaagatcacatcagtggggtcttttggataaactttttcaaaacaagctttatttctagatttccagatggcccaaattatagcagccattcctaccataactaagtctttcatgttcttatcaagtttttccaaccaatctccaaaaatgttttgactatcaagggctgggttcagattcaggacacaaattgcagtgttccacattaatcttgccaggggacggtcaaaaaacaagtgttgcacagtctcctctctatcacagagctgacattttttatccccttttctccagcctctcttgtataaattgtcttttgttaagatcctatttttggtgaagagccacaaaaaaaccttaatcttcaaaggagttctgaacttccaaatttttttctgtgggaaatgcacttgttgtagcttcaaagctttgtagaaagagttcacggttccatccttagttaaattccatcgtagtttgttattgcagttatcttttaattgcacatcaccccaactagtacaaattttgtgccaatctctcaatctccctccactcaggtctctcgtaaacttgatgcaatttatccctttttgtttcagttttgccacagttatatgttttgtcaaagtgatgttgtaaaggttggggaattgttcatttaaaggtttgccccctatccagctgtcctcccagaaaagtgtcttttcaccattgcctatcaccttggagcagaatttcagaaagatgtttttgatctccatgagcccatgccagaaatgggagtctccatttttaaatttcaataaagatatgggtttgcaacccatgtatttactggtcaaaaagctttaccaccaaccttcctcattttccaatctccagatccatttccttaacaaagctttgttcattgtttccaaatctaggatccccaggcccctttgatctttgggtgaacataccaccggccattgtaccagatgataaccttgtatatatgatatgacacattttagtgctatgaatctgggcatgactcgattggtatattttacaaacgaggtagtaaaagcagtaccacatgaaggcaagaaacagcgatgactgttcagatgggcctctcaagctcattcattcaaatccattttctctatgggtttccggaccagtatatttcttccaattgggctcgcagggaaaccactactctcataagagaaaaaaagaaaaaaaagaaggccacagcccacagcaacacatcgtattccttcccccgttacacttacacaggaagaaaattttctgttaggagtaaattgcatcgccggtacacgaacttgttaggtggggcaatctagtgcacgaatttgtaaaacacttgttttggtgcatgaacttatctggtgcgtgcggaggaaggcaaaaaggacattacatggctaatcttattgatttaggggatgattaggatactatgtaaacatatatctgagaaggttactattagatatacacctcttcaataaaaaaaatagaataggatatagtgatagtagaaaaattttaaaaaagcaagcaataatataaatgttagaaatatatgaaattcatcatttccataatgagggataaagtagataccaaatttataaatatggcatgtcttatgcatgcttactacacgtatacacgtcacatcctaatcaacatcaacttcgtaaaattaacatttataagttattttggtccttgtccgcatgaagtagacaagttcatgtaatgaaacgagcgttttacaagtttatgtactaaattgtacccacctaacaagtttgtgtatcaccaatacaatttactctttctgttagtatataaaattaatataagccctccaagtcacaaaagctagcttaatggatacgattttttttcttttctttttgcgaaacatggcaggttatattaaaaagcaaataccttttgttttactaccaggaatgccattgttgagtaagccatattcaattacccgccagcaaaggagagggattgctgaagcgtacagtatcagccaatgaaccaattgggtagtagtatatcaatccatagatacagtagaatatcaaaataagacataggcactgtactcaacaatggcatccctggtgttgaagtccacaaaataggttgtaaaatcaaaggtgtttttgattattattctgtgatgaacaattgggcattggagattattggttttgttatttagaatttattcacgaagtggttttggagatgattggatttcacaggtgaatctataggatactgctgttatttcatgttaccgatcagaccgggcagtgtgtgccggtcagaccggtggtgatcgagcggtcggaccggccagcccgcggtctgaccggccgatgctgtgtcggtttcggtttctggttgtttatttggatatccgtgattatttcatgattatgacttctagatggatactatacgtatgtaatactgttgtttgctactaatgagtcaagttggagatagcttggtctcggaatatggtttctttgtttatttcatgtgtaggtgacttgatgtctcgggagagtatttgcggtgatggaccgggagtcggcttggggataagacgacatccgtggtggtcagagatcatgcgggatacttaggctagagttgatgcacgtggttgatagggattccatatggcatacgatggaggtattgtgtgcgtatgggatgcagagtcgaatttggaaggagtccaaatttgatacgattggttatgtaaagtttcttcttatactatagggtttctaatgtgtttaggactcttagtatgagttttgttcgtggttttaggctacctacctcatgtataaatagagggggagcgtgaggcttcccggtatcgcttttgagagcaattgagttgagttttgagtaaggtttcgagtttagttgaaatttttgtaaggagtgttgttggtgcactttgtaaacacagagagaatcaataaagtcatcatctactttaagagttcttcgatttgtgtttcaccgggtttcggcggtctaactggcaactcaccggcggtcagaccggcggcattgcggcggtcagaccggcgggagcacggcggtcagactggcggcggcgacaggcgcagcaggcgatctcggcggtcagaccggagattcaacaccggtcagaccggtggcatccactcggtcagaccggcagaacaacttcggtcaggccgacttccgtcgatttcgagggtaacttttatttccgctaaaagttttcggttttagggtataccaaccattcaccccctctcttgttggcttagttcttgtgatttgatcctacataggtgtgtgcctgcacatatcctcgagcaaagcgaaaggcgccggtgccttcgacgatcggcatctcacggacatcgtccactatgtggttgctgccgagcacggtaatcacgctgccgttgtacggcccggtggtgttaggcccagaaattcccgaatagaattccaagcagaatgtgcattaaaatccccgtccaggaccggccggggtacacaaacgacaatgttgaca

SEQ ID NO: 76028 - DNA, 1453 bp, Oryza sativa
tccttatgtgattcctgaagctattaatactgctgctgaaaaaaccgcttttgaacaaaattgcaaagctcgcaatattcttttgagtggtatttctcgttcggattatgatcgtgttgcccatcttcaaactgttcatgagatttggactactttgagtaattttcatcaaggaacaaataatattaaagaacttcgtcgtgatcttttcaaaaaggagtatattaaatttgagatgaaacctggagaagctttggatgactatctttctcagtttaataaaattttgagtaatcttagatccgttgattcttcttgtgatgctaattatccacaatctgagatttctcgccactttttgaatggtcttgacatgtctatttgggagatgaaagttacatctattcaggagtctgttaacatgtctactttgactttgaattcactttatacaaaattgaaaacacatgagatggatgttctttctcgaaaagttgattctaaatcgagtgctttagttttttcttcttcctctttggatgttgatgcttcttcatctaagcttcttttcttgctgtttttaatgccacatccgatgatcaactcgaacagatcgaggaggagaatttggctttggttgctaacagaattgctcgagctatgaataatgccaggaacaggaaaagaggtggtccaaattgttgctttgaatgtggttcaattgatcatctttgttcgcattgtcctaagcttgggagaggcaaaaagaagacaaagatggtgagaagaccaacaacaacaacaagccgaagggttcataccaagggaggaagatggagaatcttaggaaggcttttcaacaagtttgcgccgcgttcgagccactaagtgatgtagatggtgagagtggagatgatgataagggaaagaacatctccgatgtttgcttcatggcgcgtggtgaatctgacacagagtatgaagataatgaggtaagtgcttttgaggaagctattaatattttgagtgaaaaaaaataagaagtgtgagaagatgtatagaaaataggaatttatcattgaatctcttaaatctgaaattgctagattaaaatctcttattcctaatgatgatgattgctcaaattgtgaggttttaatgaatgagatttcaaaaattagagatattaatgctgcacatgatttgaaaaatagatattctcttgcttgtagttttgcgttacacacacgcactttggatgagttgtttttaaccaaaaagttgttgcaaaaatatcgaattgcttttcatgctagtttgatgtttaacatgatttctgctaagaagttaaaacaacctcatgatgttttggattgctcaacatgtaatttgaataagttgaaatcgaaagatgctttaggtcgtgttgagtacatggaagatgttgtgaaaa

SEQ ID NO: 76029 - DNA, 1597 bp, Oryza sativa
  unsure (1)..(1597): unsure at all n locations
aatacaattgcagtggcttgtctgctgaaataacaagctaatcgaagcactacagcaccaaaaacgttttttctaccaaatgtgtttccactaatgatttttttcttcactctcatggcaaacaagatcatcaagtagcaagcctttagaacagccttcgaaccaatcctccagcccatagcttccgtattcctagctgtccagcccttcctatcatattgctaagatcaaccttgcacctcgaaccacgcagcactcgcccaaagcaaagaggccacggaacccaaagctaccgaaaccgcgccgccgctcctagatccagcgcggcgactcggcggatccagcgtgaggaacacgtcgggggttcggatctagggttaagggaaggaagaaaggaaggaaggaagagagagagagagagagagagagagagagagagagagggggtgggggagcgggcgacaacgcaccttgtggtcggactcggaggcggaagcgaggggcagccccgcgacggtgaggaggaggacgactgcggcggcaangatgaggtggaagtggtggccgccgcggcgatgcatctcgtccggggcgagatctgggcggggcgctgtccgtgaggggaaggtttggtctcgcgtctcgtttcagtctcgccgcccgagcacgagctgcctcctcatacggggaccttcggtgtttttgcgggaggtgcctgtggaatgtggtatttcatgcagcatgatccttcatttgtttcgtgtagtgaaagtaaggcagaagtagtttttttatacttttcaaattttataaatgaccatcctttttaaataaagtcttaaattttgtctctttttttttcaagataagagtgaaggcacatatatcactatactcgcgctccgggaatatgtgcccgaacataaggtcaaatagatggagactagcagcagctccttaacctttgctaaaattctattgaaagcacacgctcatataatttgttgctgtcatctacagtacatagcatgagagactatgatcctatgggggtcatttgcttaaaagctgacctcaccaaggtttagtttcgaggccaattatagcttgttatagagacatcatgaccaacaaaatgataaaaggcataagttagccttagctagggaagatgtttagtttgtgttaagtgggtgtttatttcaagaaatcgtgggcaaaggctattatgctcacgaacgaattatctaagaagtgtctaaattttgcatgtgaaaaacatgtcgtgtttatgtagctcatttcaacaaatatagttttgtggagattgatcacgagtaactaaatccggttatgaccctacaatatatttttgaaaaagaaaataagaaaaaaaaaactttctcatactaggataaaagacctgttttttcatctagacataaatctgtatattacaacgagagtctaggtaacaaaatctaaggcttagggtagaccaccaactagttttgagtatgagaaatggagaagatagatatgctagccttttaattattgtttgtgtttcttttggtgcaattttaggctagtcata

SEQ ID NO: 76030 - DNA, 10182 bp, Oryza sativa
ctcacctgtgccgagataccaaaggaagggctcgggaatgtgccgctcaaccttgacctcgcctgcgccaagctgccggagagtgaggcgtagttcgttctgctccagtagagagaaggaagaaaggaaaaatgacaggtggtcctaggttgactggattgcctcctaagaaaaaaccagagcggtttggatgaggggtataaattgcatggttttaagagatgaggggcgtctaatacccgattttaaagttaagggtgtattttagataaatataatagttgaggggtgtaaaatggacttatcccgatttgaacggactattataccatggattgtctacaaattaattatttttataaatagaattttcagaaatagcttagaacaaatgctctaaatagtgcagtagaataatgatttcgaggaaatgttattttctgtgagtttttgaagttaccagcttttagtgttttttaagataaggggaagagttttgttaaaaataaaattaaatccgacccaactagggatgcacaaaagtctagaaaaataaaatagaaaaaaacactaagacaaacctaaacatatcatgttgtcttgtagcagctcactcaaatagaaccaagacaagaggttaatcctagttatttactccgaaacaacgccctcgagaaatacatgacattttgtctgccgctgctattggaacacaaggctagattgttattcgaagcctgacatcacaccttcaacaaaggaataacacacaagcagcgatgttgtggaatcattaggttttcactctggagtgattgctagtactctgtgccatcatctggatggacttagcacaatccactcacaatctgatcataaccacaattccacaaaaccgcctttagcattcgctgaccaagcaaccaatatatcagattgctaactatacagaccaagcagtaccaatgtgtagccaccaaggacaaagtactagcctactggatctgccaccaccaagcgaatgaaagaagccatcatcgaaccggactaccgaaaacatgaataaaattatcgctgaacagatcagtatggaacttattggcacaaccggataagagggtgccattgcgcccttcatcagctagaccaatatcccttcttggatcacgttcggattgatgtgatgtcctccgcattgcatgtttatcgacccaaacaaagcggattgccggttggaagagaggatcagcggtgaaggggtgtccttgctaactaccgattcaactcctccgacatccatggcgagcacggtcacaacagcgatcgaccgatcttcctgctaattcgcacatggtgttgatctctccgatctacttcatcgtggtgttgggcggtaaaaaaaactaccaccatcgtcaccaacggcggcggcggaggcagaacaggcgttgaggcagctggcgacgactagggctgctgaggctcctttggagtcacccacgggaggcaacctgagaggtccgcgtgtgccagattttactgtgacaggggtattaaggatatgttaaactagggaattttaatgtgccagatttagaccagtgcgtgtttttcgcgtcaacacatgggaattttaagagctctaatccaatgtttaaaatagcgggtctaataatttaagtaaaaattcaaggttggatggttttctttttttactctaaatttctaggatttctctaattttattagagcgtcacgcgataatgtagtagtgtttacaagacatttaatagaattttagtatataatagatttctagggtttctctaatttatttgagagaaagtttaatgtaattttagtatataacagatagatttagaagatggtttaaaagaacattgattggatatttcttatagttcttaatttaactaaatatatttatatttgggaagtaatatattttatctttatattgtagaaattcatatttgaatgtatgttttttctgtctgttttatgtacatgtatatgttttttcttccagcgaagattaggaaaattttgttttcaatcatgtacaacgtttgtacgtacggaaagaaagcagtggcatttgtaacgtgcaaactcattcgtacatgaggaagttattattttttaatctaatgatgtaaaataatggatccatcaatttaagtgaaaattaacgatgagattagatagtgcatgtggtgacttaggagcgttcgtaggagtgccatgtagcggcttaagatcgtttgtaagaagtttaatggatttttagtatataaaagattataggggaggttcattactttcgattggtcaacaacgcaagcaactaactaacaaactaacaatagagtcataacatgcaatgcaaattaatgtatggatcacctgattaattgggtcgtcgttccattcccagccgatcgatcgcttcaaccattcgatatatatagctgccctaagcaggatcggttatttatcgatcgattgattgatgtgtggttatggccagcggtgtggtgatggtgatggtagtggtgacggcgacagcgatggcgatggcggtgcaggggagccgtcactcggatttcttcgtggagggcgaggtgtactgcgacacgtgccgtgccgggttcgtgacgaacgtgacgacggcgatccaggccgcgcgggtgcggctggagtgccggcactacatgagcgcgagcgggtcggtggagagatcggcggaggggacaacggacgcgacggggcactaccgcatggagctggtggaggtggacaaccgcggtgccgagttggtgtgcgcggtggcgctgctcagcagcccggtgaccgaatgccacgagatggaggtgggtcgcgaccgcgcgccggtcaccctcgttcaggacgtcggcctcgccaccatggtccgccgcgccaatcctctcggcttcctccagactatgttagctagatacgctgatacggatacgcgatacgtggatacgaagatgtggcatttgtgaaaaactaaggatacggggatacgtctatatatatattaacaatataaaaatttaatatataaatttatgaactcttgcatggaaataagctcgtataatgtcatggaaatattttctaataattgtaattgactaaggttggtgaagcgatttaaccccgagaatgatgatgcagactgaagactgccaacttgccaataacttgccaacaggtttattccaagagtgtaatgaacatacacgtcgagagtgttagatgcattagcacttgatattccaatccgaaatttcatccgatctaaaagtagcactttgtaccaagaaaatagaaagagggacaagaagttaaaaaagaaaaagaaaatcattgctaacactagcatagctgcatgggagaggccaacaactgaatcgaccgatggaacttgcttgcctcactgctgaagtaagtggttgcctggttggagatggcgccggcggcggacggcggtgctatgcctggcggcggcagcactgcattcagcatccggtgttacgcccgcatatggcgacggcgcacaactctgcgattggcgtccgtcagcggcagcggcgctaggagtcgcgagccgcgtggggtgtcgggccatatgcgagaaccacggaagcgacgaacggcgtggagttgcaggataaagcgatgtttagttctctcgatcgtatccagaaggtatctcaacgtatcgggggagtatccagattttttttttgatttttctgaaaatcaccaatatcgccgatacacatgggatacgtatccgatacgtatccgtatccttccacgtatcagatacggatacgtagcttttgggaagtatccaggtaatgtagcctccagacccgcccactccccatctgcggtgaccttctcaagagctacgcgctcggcaccgcaccaagctactagctacctcatacagtgctccctttattattatttcctcttcttgcttttatatttatattatatccgtgcgttgtaatgggtgaaaagattctaatgataatatatgtttttcatgtataatcatgttaatgacaatgtttgtattttaatgagtggtttgtttttttataaacggtgttttttttcttgcgtgattttctcaaaccatttttttagaaatggcgtatttctttcaaatatttttttcatagcatgtttttttttgcattttttactgacgacaaaaaccatattttttctccctttttttcttttatttttttgtgttttttgcctgttttttcaaacaattattttctcgcgctttttttttgcttgttttttcaaatgtccttttttgcttttttttttcaatacaggagaatatatgacgaaataaaagccgtatagtagatggcaaaaaatcgatggatcctatccgagtcaagcatccatcaatttagtattttctctgacagttttttcaaagcgatttgttttttaatagacggtgttttttttgcacggttttttcaaaccattttttagaaatggcacgttttttctgaccgtttttttctcgcgcatttttttatttgttttatggaagatggaaaacattttttagcgtttttttgcgctttttctgacttttttctcacacgttttattgaacggtttttattttctcgtgcattttctatttttaaatagttagattagattagagatagagaagagatatatagtaattagaaatcgcaccactatgtttcgcactttccatttttttctcgcgtgcattttttattttatacgaaccaacttcttattttttaggaaccatttttgtcgtcacatttttcgcctttaaaggaatcacattttttttctctttttttctgttttaaaggaattggatctagtgttttttgcaccactttttttttgccgacaaaaaaaaccaggcgaaaaaaatttgtccgatccaaaacaaaacgggcgaaaaaccgggcgaaaaaagaaaagaaaaatcaaatctgtctgatcaaaaaacgggcgaaaaaaagaaaaggaaaacaaatccgattccacggtaaaaaagggcgaaaagaaataaaaaaggaatctgtctgattcctaaaaaaacgggcgcaaaaaaaaaccaggtgaaaaaaaagtccggccaaaaaaacgaatccgcgtggacgcagtaaaaaaagagcaaaaatattaaaaaaacaaatctgtcggagtaaaaaaaaagaattatatgcgacgtggtaaaaaaaaaatcgaatcctaatatatttgacgcggtactatatatctctatcttctctatctctgctacttaaaaaattaaaaacatttcctatgtccataataacaaaaaaagggcgaaaaaaacattaaaacaaaaaaaaagttcgattcaatttacttccgttgtccgtgaaaatcttatcttatcttaatctcaatactacttatatatatatatatatactacttaaaaaataaaagaaatttccgtcgtccgttgggaaaaaaactgataaaaacaaaagatcggaaaaaaaaagtccgactcctccaatggaaaaaaaaggagagaaaaaacaaaaaacgaagagaaaaaaacttccatcgcaaaaaaaagatgtccgactctaaaaaaaatccgactcctcggcggagaaaaataaaggcgagaaaaaacaaaataagagaaaaaaacttctactataaaaaagaaaaaaaaggtcctccgtccccgcctgtgcgatgaaacgccagcaaaaaaaaaagaaattgaggaaagggataaactagattgaagttcccaaaattaaaagaggataaacgatattgaaactcccataactcgaaaagagggaataaaatatattgaaatttctcgacaaaattctctaaattcgaagaaccctaatttcgggtaagaaccataagagtcaaatccaaatcaattatgctaagggttcgggttacttaccggatttgaagcccgtgagctcaccggagctttctgggaagcggcatcgccgcaccttcacctcctcgcagtcgtgtcgggttccctgcgcgcgcgctgtcctggagcacccctccaccgtcctttgccgaagacgggaagcgtcggcttggcatcgcccctaccgccgacgaggtccaggccgcttggcgctcgtcgccgtttgcacgcccacctagccggaccgccgacgtcgtggcacggctttgcgccgcccttgggtgcgcctcctagccggcgaagcaggagccgctcagtggtcgtcgctgcacgcgcgcaccagcttgccggaccaccgtcgttccgctcactcgtcgccggagagaaatgggatcaagagagatggatttgggacctagggttttgcccctctccccggtcgatgcttcattcgtcgcggggatgattggagccgtccattagattggacggctcagattcgcccagcattaggccgtcgccgccgttgattacgctgcgcccaatgggccgcagaagtgtatcggtccgtccccgcatatgtgggccgcgctcagttgctcagcttgcgggccgtcgaattgactcaactcaccaaagatgggctagcccaagtttgggccggcttgggaagacctgggccgaaagcaaatttgatcaaacaatgtggctcacatttttcaaattaaagtccattggataaactcttaagtaggctcgaaaaataaatctaaaactaaatcctaaatccatgctaattgataaaattagactcggttctacctatttgttaatatatcaaattagacttgatttttacagaattgaggttttcaaggtgtcacactatcaaacggtgtttttcctgtagcaacgcacgggcactattgctagttagaaataatgtgtaagatagctagacgacgatataaacttacataaggtgatgtggtttatcataatttaaatagtatatagaatgatgatccaaatgtaaaagtaatatgatgtggctttatgagagaagataatgagggagataattgcgaccatagattaataatttgatggctagaaacaatttgaggtgatatggcttaatgagaaaagagagaaataacattaactaagtgaggatgaattgtctaggtatatagatattatacaaaatgatggggagatatattgaaatattttgagaattatgtggaatgatgatttaacatgctcggatttttaaagctctaaaattttagtgagggtgaactatataggcatataggatattataaaaagtgatggagaaatatattgaaatattatgtgaattatgtgtgatgataatttaattatcatgcttgtattttaaagctctaaaacttaataaattagcatgcttacatgaggtttgagatgtaataattgttagtggataatgtggcatctttgcatgttgagctttagaatttagaagaccttaactttatagaaagataggatattaagataatggaaaatgtatttcatctccagactccggttatatctaccctatagttcaacaaatactttcactcatcactcatcactcattctttcatctaccctaaagtttaacaaatactttcactcatcactcaccactcattctttcatgcctcactcaacggtctagattatccgattgagatctgacggccggaatagctcccgcgtaatctcgcccatgcgccccaaaatttcgcccttttttcatcccgatcgattctagatcgcgaaaaaatccggcccctatcagttcgctttttttctaatataagtcaaaacggtaataagccaaaacggtttattagggaataaaaataaatttgtaggtaaaacttatatatatatatatatatatatatatatatatatatatatatatgttctttgtaacttaaaagccaatgctgaaaaagaaactacgtagaaaatatcttaaaatcaatcttaaaattaagtttgaaaatttaaaatttggcttattgggccgccctcggcgccgccgctccctcgcagcctcgcccttcacctctccgctgacgccgcccgtgcctcaccacctctgtcgttccaccgcgccactacggctcctccctccccatcgtccccatcgccccctcgccgcgccacttccccatcggccgccccgatgcacgccgcgtccccccgcgccactacgacgcctccctccccggtgtccccatcccccccccctcgccgcaccacttccccatccgccgccccgatgcacgccgtcgcgtcgcccgcgcctcaccgcccccggcgtcccccgcaccagcggcagaatggcgcaggccacttcatgttccccaggtacttcgaatctgaggcctcctggttgtggaacaaggaatcactagcaccctcctccctctctgctctactcttcttcttgcaaatggctgcttctggattcctgtgtcctgcctgatgcttgcttgcttgtgctttgcaaaggattaacgcctagacgtcgtgcattggatctggcaggagtgcaattgaattcctcatgctactcatttcagatgattcagccacctgtagaaaatgttgagtgcatgataaaaaaaaactaaattttcctgttgtttacttgtaaattgggatttgcactacagcaatctacaaaatctacatttttcttatctgttggaatggggcggtgtggatttttggttaatttttccaacggcaggattttagctcgatgatacatcacggcagatgcacttggttctgttcaggaaagattaactatgcattctttatttactgattaatattagtatgctttacattctagcgtgtgaaactgttaatgttagtactgcatttcctttacttggttgtaggattcatgtggtctcacttgtgttgatgttttagcaattataattcagattgccctggatggcatagcatatgaatgatctgagatgtcttatacccctaatatttacatgcaggattatcattacttatttgcgtttgttgcaccgtcatttcatttatgtaggtattgcctcgtgatgaagcaacatttcggtttgtcaatgaagccaacaagaccaagagcggtagttctctgtgtcacaaggtagctgaccattattagatcgaacaatggttttatcaggacctagcatacatattcagacaggtggtctacggcgtggcagcggtgcggtcacaagttccaccacggtgagtgcctttctgcgttcatatctctctgtactgaattgatcttgactagcataattatatgctatcatgtttgtacacactgcaattatttctcatatttttacctccaatcgtatggcagcaggttcatggtagcacatgggtttggtaaatctattccaacgaaaaatggtagtgtttgatcattcccttcgttttgtatagctttggttaaccttctgggtgaggtgcactacaattccttgtatgccattgaagttgagtgcttctgcttttttgtgatatatgggagtgaagaaaaggtttcctacaattcctctacttggcctcagatcaaatgatttgaggggcagaaaacgaaacatgatggtattcagtatcaaagctaagtttttttattctttttgcagtcataaaatttgatggaatactaatgcctgttgcagggtaatttgccctcaatctgaggtattgccatgagtattatcattttctccctgcaaattgcaacaaggtaatttgctgctagaaactttgcgcatctatttttttaggaaaaagtacgaattaccccatcgaactatcgtggtcgtccgaattacccccttgaaccacaaaacaagacattcttcacccccaactatacaaaccggacgaattacccccctcgacctaatccgcggtggttttggtctacgcggcgtacgcgtggcagtccagtcagcattttatttattaaaaaaagtgggacccacatgttatagtctctcatctctctctcctctgtctctctcactctccgtctctctcacacatcctctctctcgcgcgcgggt

SEQ ID NO: 76031 - DNA, 10951 bp, Oryza sativa
ggatactatcttcttgggtaccccatgcaaacacatgatccttgcgaggtacaattctgccaatctctttcccgtataggtggtatgtactggtataaagtgagccaccttggtaagtcgatccacgactacccagattgaatcatgtcccgatgatgtccggggcagtcctgttataaagtccattccaatctcctcccatttccattccgggatttgaagaggttggagtaaacctgctggtctttggtgctctgctttcactcgttggcaaacatcgcagagtgcgacgaattcagctatttctctcctcatgctgacccaccaaaatttttccttgaggtcttgatacattttggtgctgcctgggtgaatggagtactgggtctgatgagcctcggtgagtatcagatccttcagttctttgtcgtcaggtacacacaatctttctcccatccagattgtgccatgctcatcttcatggaaatcccgagcctttccgactctcatgttctttttcagttctgctatttccggatcatttacttgagcggctctgacttgatccacgagcgtaggccgtgcctccaaagcggctacaaacccgtgttcaacaattcccatgttgagatgttcaaattcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggtttccaatcagataatgcctccagatcttcaaagcatgaaccactgctgccaattccaagtcatgagttggataatttccttcgtgtggacgcaactgccgcgaggcatacgcaaccactctgccctcttgcattaggacacatccaagtccgtgacgggatgcatcacaatagacttggaagtctttcgtctggtcgggcaggatcaaaaccggtgcggatactaatttccttttgagctcctcaaagctcttgtcgcactcagctgtccatttaaacttctcgtctttcttaagcaactgagtcatgggtcgggcgattcttgagaagttttcgatgaaacgacggtaataactagccagtcctagaaaactccgaatctgcgacacggtctttggtggggtccattttgtaactgactccacgttcgatggatcaactgccacaccctgggctgtaatgacatggcccagaaatttgacttccgtcaaccagaagtcacacttgctgaacttggcgtatagctggtgctccttcaacttctcgagtaccagacggagatgttgttcatgttcctcttcggactttgaatagataagaatgtcgtcgatgaacaccacaacaaacttgtccaaaaattctatgaacactttgttcatcagattcatgaagaatgcgggtgcgttggtaagtccgaaagacataaccgtgcactcatatagcccgtaccgagtggtgaaggccgtcttcggaatatcctcttcccggattctcagctggtggtagcctgatcgcaggtctatcttagagaacactttagctcctttcagttgatcaaataaatcgtcgattcgcggtaagggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctctgctaattcgttggccgccatcctgtatggtctcttgtaaattggagcggttcccggtgccaagtcaatccggaattcaatctccctcttgggtggcatggtagtgaggtcttcggggaacacttccggatactcgcagactatgggtatatcttccaattttctcaagttcttccccacggtgtccactgggatttccgtttcaatttgattcaaggagactccttgctttggtgagtctggtgatttgtacactacggtttctcccttctcgttggtcaaggtgactgtgcgactcgcacaatcgatgacccccttaaacttggtcagccaatccatcccaagaatgacatctaggtctttggattcgagaagaatgaggttggctagaaatggtgatctttggatttctattagcactgaagggctaaaactgactgaggttgaactatttcccggggtacgaaccctcattggtgtgctaagctcgtctttccttagcccatacattcccacgaatttctttgaaatgaaagaatgcgttgcaccagaatcaaaaagtactgttgcagggattgagttaacagggaacgtacccagtacgacctctggtgctgcttgtgcctcctccgcagacgcgtggttgacacgagcctggataaaccttggcccggcacgcctgggcttcgggcatttgtcagcgaagtggccaagctcgccacagttgaagcaggaccctggttttgctcccgtctccttcttggcttgcgcgggctgggctgactgtgccggtgccattggtgggcgtggagctgcaccgcggttgggctggcctccctggtggttctgactgccactagtgccctggtggaagttgctggagttgaacgggcggtgctggcggacgatcatggtggtaggtccaccctgctgtccgggagtgaagcgcggtcggtgctgactaccttggttggaccggaattgcgccgcctttcttttcctgtccattttgttgcgctgatcctcctggcggattgccttgtcaaccagcctctcaaagtcggcgtagtccccagatatcagttggttggtcagctcatcatccagacccgccatgaacttctcctgcttctcggcgtcggtgcggacatcctctggtgcatatcgcgcgaggcgattgaactcgtggaggtactctgtcacagtcatgttgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctatcgcatggagccagtcatttgcctccatagggttggtggtgctggagaaggtgggtggcctgacacgtagaaactcaggcaacttggactgggggggagggggaccaaactgctggtgctgctgttcggcgtgctgcatcatcctctgatgcatctgctggtgctgctgctgcatctgctgcatcatggctgccatcatctgagtctgatgtgccataacttgggcaagcgtcggattctcgggaagtggtggtggaccattgccagaatcaccgttggggtgcacaccatcagcgcgttcttcgccgttgctgccctcgcctgttgcgcggctaccagtcctggtgtagaccatctggagggaagagcagacggggaaaagaagaaaaacagatgctcaagaactaagctttattacaaaggaattaaaactgtaattgttctgatctgaattaaaaacacttaaaagggcaagcaaatatccttattaagacagccatatcataggcacatgatatcgaccgccgactgaccccaaacaagcaacctacacacacaaactaacaaacaaaaactagacagtcgatgaactagtggaaaaacgagcctaatgctcggaacggctcctgcggtcggtggagtcgaaggcgtcctcctgctcgtcacccggtccctctgagcgactcctggagcctgacggatcggtctcgccgctgccgctgggagtagcagacagccaacctccggtaccactggctgaacctctggcggctgatgctggagcgaaggagagagtgaacgcgggagttggagctggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctatctcgtccttcagagcgacgatcctcatgagcttcccatcattcaaggccttggtcgccttgtgcaggtccgagtgcatcctgtccaatcccctcatcacagcacacatgtgaccaaaggtggtgtcgttctcgccagctgtcggacggaaggagctgacgccatcaccatgggctcgacgggggtggtagcggtacgccgtgtcgtggaagatgtagtcgtggcgctcccgtaacctggccatcatcaagtaggctgcctcctgacaggcgtgatctgctgtgcctcctgatgcctcgaccgccatgttagcgaggcaagtccccacgtagccatggacctccaagcggacacggtaaggaagctcgccactgagcggtgggatggtcgtgtattccggcgcgtcggggtagcccactaccagtgtcatgcgtgccaactctgccacgaaatcaatcatgccttctccgcggtggttgggtgggtgaccggccatctagagaagacaaagaagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaataccttgcaacccatgataccgagctaggaccgaatgcatttcacccatcaaatcccaactgactgacgaataaatcccaataattttactaaaaccctagactgactcgttttgaaaaactcactttaaacgagcgaccaagatttttcccttgaaccacaagaacagatccccattttcccggaacaaatccaattgcgaagaacatatgcaatgaaaaaggattcagagggctcttaggtttctccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaagtcttacagaaatgcagcggaaaacaaaagaaactggagctaagccttgacttgaacggcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaataggggtatgatgcagggaattaacaaagaagagctagagtggttcatttgcataaatactggcatttataaacaggaatttaatgcgaaaacagttgtaaaaattaaacagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacatagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaacgtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctctgctgctggaggtacctcggcgactatttcgaagtacaccggagcgtcggagggatcggaatctagcgacatacaaagcaaacattgcaaacaggctataagactactgaaacagagaacaaaaccatttttaatggattctacacatttttcttgatttactgagatttgaatgggattaaacggagctcggatgaattagatatgaattttagaaaattcactgtgtttattactataaaagaaatccttaaataatttattgcgcaatattaaccagggctgacgtcagcgagggggcgcggcgccgacaggcggggcccaccggtcagcgaccgggagagagagaaagagggtggcggcttgcgggcccaccggtcagcggcacgggaaaagaatggggcggcggcgccacgtggcgaccggaccggcggccccgatctacccaagggtagatcggacggcggcgcgggacctcgcggccggggcgcgcgggcgcggcgcgagacggcggcgaccatggcgccggcggcgcggcgctcacacggcggcggcgcacatgcggcagcggcgcaaagcgacgaccgacggcggcggagagcggcggctagaggagaggaaggggaaaagaagggaggggatgcctcaccgagggtggccggcgcggaggaaggcgatggcggacggcgacggcaagccacgggaggacggcgtcggctagcggacgagcttcggcgtgccctaaggaaggagaagatagggattagagagagagatggaccatggcgatcgggatccatggccgaaggcggcggtagaggtggcgctcacccgtgcgcgtggagatgagggctccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggagctcgggagaggtcggcgcaatggggaaaaagcgagagggggtgccggtgatgcttaaaaaggggatgggggaaccgaacgtggccgggagcggcgggattcgacggccgacgtgggggagtggggaggagagagaggcgggattcggttttcgaatcccggccatctcgggcgcgggcgcgagcgggagagggaggggaacgggcgcggggaatgcggcgcacgcgcgggcgtggtcgacgtggcccgggagagacggaggcgtgggcgcggcgtcggttgcggcggtggcggcgcgagcgggatcggcgggaggagggagacgggtccgacaggtgggccccacctgtcggcgaccccgagaggagggaggcgggcggccggctgtcgggctgggcctcggcctgggccggcccagtaagggaggggaaggaagggagaagtgggccgacggcccacttgacaaaaaggagggaaaagagaggaaaaaggaaaagaaaaggaaaaaggattttccctggaattaacaattgcactttagtgatttttaattggttaaaaattatttctagagctctgaaaattccactaaaaatcctgttaatgaattttgacatgtagaactcaagaaaaattccacatgtcaaatccgattattatttgcattactttcttagggttttctcctgatttcaccagcattttcttagggtcaattataaattacaattttgacttgggaggaaaacttcggggtgtgacatccctcatgataaagatgaagccgagcggatttcaaggcggagcaaactttatgttatgcatgaatctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcatctaccagctcaagagttgcagactatcccgctgtcttggccgtttgcggtttgggggctcgacatggttggcccgtttaaaaaggcagttggcggttacacgcatctctttgtggccattgacaaattctccaagtggattgaagctaaaccggttgtcacaatcacagcagataatgctcgagacttcttcatcaacattgtgcatagatttggagtgcccaatcggatcattaccgataatggcacacaattcaccggtggagtttttaaagacttttgtgaagactttggaattaagatttgctatgcctcagtggcacaccccatgagcaatggacaggtggagcgagccaatggcatgatacttcaagggattaaagcgcgtgtttttgaccggctaagaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaggaccgagtggatgatttgcaccgattggaagaagcccgcgaagcagctttgattcggtcggctcgatatttacaaggattgcggcgctatcataatcgcaatgttcgatctcgtgcctttttagtcggtgacctggttttgcggaaaattcaaactacacgagatcggcacaagttatctcctctatgggaagggccatttattatctctgaagtcacccggccaggttcttatcgactcaagcgcgaagacggtactcttgtcgacaactcttggaacattgaacatcttcgtcgtttctacgcttaagtttatcattgtacttccctatcttgactgtcaacatcaagttttcttcttgaagttgtcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccggtattgtacaaattgagcctccatttgttacattcatactcagtcagagtcagtcctttcatcatcagagttattattactcggctgaagatcgttgttgcggaattgctctacaacatcacttgcaatcttgtcagccgcactttgagcattactgataagatcaagagcagcttcttcacttgtcccgtctgcaaagccatcaatggtatcaatttcaatcctcgggtacaaggatttggtcatcgccaatgccatactagctcccatacttccagctttcttgatattcttgaagtatacatccggtgcaactctcagcttgtcaaagatttcggttgcgtcaagtgcactcggaccactgttattaaggaacatagcttggacaagtggtgtagcgacattggcgacttcgtctcttgctccttcaagtttcttgatcttaccaaccaggacgtcaaactgagcttgagatttgattttacggtctacaaaacacatttataataagaatttgctgcattaaaaagaggaaagttcagattgtcagctggcagtaccttcaacctccttcaaggctgagtccctttctgcagccagttctgctttgtcttttttcaaggcttctatttgcttctccatttgagccatcctggtggcttgcgctgtttgaaatccaaatgtttgaggatccagttatgacagcacaaatgggacagatctagagattaccttttgatgaaccatcagctcgaagttggagtcctgaagctgtgcaattcgatcccttaattccttctccgttttcttggcatgctccttggcctcgtgtagctgttccctaacggcttcaagagttcccaaatgtggaaccagcttttctaaggttgtggtcttggcctcattgcgaagatggatcctctgcacggtggttcatggattagttttgctaacgagacaataaagtcatcaaaggcagtcacctagaagacttacattcacaatgcgag

SEQ ID NO: 76032 - DNA, 649 bp, Oryza sativa
gggcatcttcgctttcaccatcgaccgcattcgtcaccgccgactggtgtcttcattgttattgatggacgactttgttcccacattggccacctctgccatcaccaaggggaatattacgaagctaagtcatcattgattttttttatatgatattttccttttcctctgcctccctacatcaactggttcgccgttgactagtgagtcgggggctacatatgttatatcatattttttaacaattttcataatatttatcttgattgcttgcgatataatctgagtacaaaagtgcctatcgagttatggagttctatcttcctatgctttccgtttggtttgtcgatggatggttgccttcgggccgattcctagcacccgggggctcgttggatggaccgagtaaaggtgctaagtattactcaaaaaaattcaaaagcatagagataagataatttattttctgctcttaacaattgcaaaagtacccgagtagtaaactctgatccgtgaaactttgttccattaatgacgaactcatgtcactcgtatgcatgcttgggaagtgcctagaccgactcccggtgcttggggactatgactagtcgggcagagtgtttaaacgtaaggagttatccgctcgggg

SEQ ID NO: 76033 - DNA, 694 bp, Oryza sativa
attcctgcagccttattatggctaaaaagcagtcggctagaatgcctctttaggcgccgcgtatgcttttgccatctgatgcacgattgtgctattattttgttctcaactatatgtttagtttgttaactaatcacatagttgggggctacacctaattaggtgcatctattcgatgcaccatattctttatcttttcgccctttacagtcttcgtcttcgctactcggcaggccttgacatgaaaagtttgaagcactcggactatttttgagatggctacgatggctgactgcaaaggtctcgggggctactgtggagattatggatatcccatatctacacggcgatggtatttggactgggtacaggatacctaatgtagatagaatatcttatctgtatctcgggtttgtttcttaacttgtgtatcaaggaaacaccctgagacttagtcggttacgactatatttcatctgtatttgcatattccgttagggatatagattatcttttgtaacacggactcctccccatatataaggggggtccgggtgcctctaggggcagatgttgattttccctaaatcatacaatcaataatacactcggcggattcatccccggacaggagtagggtattacttcttttataagaaggcctgaacctgtataaatcctttgtctccaaacc

SEQ ID NO: 76034 - DNA, 13370 bp, Oryza sativa
acccgcgcggcgcgcgcccctgcccaccgcccgtcccgcgccatcccgcgccgccgcccgccgtgtgagagagatagagatagagagtgagagtgagagtgagagagagaggagagagaggagagactatgacaggtgggtcccacattttttaaataaataaaatgttaactggactgccacgtgtacgctacgtagaccaaaaccaccgcggattggatcgaggggggtaattcgtccggtttgcatagttaggggtgaagaatgtccggttttgtggttcaggggggtaatttggacgaccgcgatagttcggatgggtaattcgtactttttccatttttttaacaccataccagagtttcctgtagtatatattacaaattgatcaataatttctggttataacatttacaaggtgtttttttaaatggctacttcgttataacatggtgttctgttcatgtgaacttgtgaagtggctgagaaagtctttttagctaaaatgcagtgtgctatgttgtgaagagtgaaatgaagaaatggcaaaagggtgagacatgggcttatagttccagtgatatgaaatcgttcatccctgtcttgattcctagaagatgatatttttttccaagtagctttgatgaaatgtagcaatgagtcaatgaccaaatttgtaataatctttgtatggatctgaacaccatcgatatgattttttaatgaacctcttgtattataaatggttgtttgcggctttttgtggtttactgctattttgatggatgtctttgtctcctatgtcacttgtacttgtgaatttgtggttatccgtagcattagtatggacatgctattattacgttgacatatgtttcatatcaaactgttatttgggtttatattcacgccctcgtgctatgtgctcaaaggatagcggccaacgtgtgccttatctatcccgttaccactcgccgctcatcttcctgcacataaaatttctaatccactttttaagttcaaattatttactccaattatgaaaatttgtacttgaaaattttaaattttcatttcaatttttaaaactttcaaccttttgatttttgtttggcaaatatttaaattagaggcctgaaaatgcatcttttaaataaatattggcgatagtccattctattaaacccgcccagtatattattcttgccaagaatatgtctgacatatgacatatattgaattaagactcaattgcacagatcatacaagaaatagtttttgctaacattatattttaaaattctttaaagagaaataaacttgcaccgtagcgtttagcacgggcatattactagtggtacaataatggaaaaggctctctaccttcttgaggtcatgttaaatggatttaacccaaatatgttttaactttgcagtgactcaattgtgaaaagaaaaattggcacgtcacacagatttatgactgctaaattcttatgaataagtgtaggcgtgtagcaactttttctagattgactgctaaatcaatttaccatcttttattggattgtcaatttttctagattttttttagatcaattcaatttttgtttggattataccatccacacagtgtatctcatatgtttgggaattggttatgcgtgttaataaaaaaaattaaggaactattttttaggggcttccactatatattgggctctttggcttagtagaaatgatatgatttttttgataaaaacactctcaaaaacttatttgtaggtacttttcaagacaacatattggctccagggttgggctcaactacaaagacatgatgatgatataaagctaataaatgatgcatgtcgtaaacttgaatcgacgattatgcacctttttaccaacttcggagggagattctcaaatactataattcagtaattgtggattcttttatcttgtgttggtgtttattagtttgtgtttattttatgttatgtcagtgcgtgctatgtgtgtttatctgtggattttgtaataattgattatagcttattgagcaaaggtcggattgtttattctattattttaaaaaaaagtatagcaaattggctagaaaataagatgcatgtgatggacaaaccagctagtaaaacgtgctttgtctcagtcgtaggcttgtagccttacgtaacaaactctaatgattggattttggatcctcttacttgcatggtaaagtcaaatgagcacagtatctatgactctggggattttgtagctgtccaattgtgcaacgaatggacaaaatatgtgctatattatccgatagaaaatttgagccgctacaggatatgtatacttctctgcaccataactacagtgaatcactttagataattgtagcaacatactcgtgctaccattcctctgccttaatttgtacctgcaaggctagtactccctccgtcccacaatataagggattttaagtttttacatgtaacgtttaatcactcgttttattcaattttttttgcaaatataaaaaacaaaaagttgtgcttaaaatactgtggataataaagtaagtcacaaataaaataaataatattttttaaaaaaattaaataaaacgagtgatcaaacgttgtaagcaaaaactcaaaatcccttatattatgggatgtgatggagggagtacaagttacgggatccttttcttgagctatattgtttaaattatgaaattctagattttgactttaacgaccaaaaccaaactgacgatagccttccagaaggcgacatttagtgttggggttgtcaacgatgggagcaccgatatcagtgatgcttatgggcgtcacacatctttttggagacgatgttagctgatgccttcttccccaacttcgtatctcggggttgactctctaagtgaaaatctagttataaatgttcagaacaatgatggcaatatctacaatgtcgtgatcttcttggaaacatacattggagatagtgtgctggtgaggcattattggcatcggattggctttgatggctatgacgttgggtaaatgactgatttacttagttaccttcaatgttattttctgctttggtttaacgttagtcactcatggtgatgtatgccaaattcgattatagaaataattgacgttgggaaaaactaaggactacatataacttgtacactgttgggcaaaacaatggttatgcagatagaagtattctttaatctttaaagtgatattcattttttaatcaaactgtgaatttttttttcatttgtagtcatttgccctgtaatttttatgacaattgattgtagtttctttaaagaaaaaccgaaataaattatattgtgttaaaaatgaaagaaacagatggcagcgttaaactccaccggggcttgcaaaaacagacggatcttgtgcaggagcatgaatccggtgcaaatctaatggtgaaagttcaaatgattcacaagaaaaaaaaatgggttgagtattgcactttcaggaaaagaaagatggcacacagcgtctctcctcaagcaagaaatggacttatttagtgatttgcaattgcacacgagatgcagtgaaaagagatgtgtaattttaacatcgagcccgtgtttaatctctgtctggaggacgtctttccctccgaatctccctttttttatttacaattgcacaccctaaagttatcgatcggagcacacgcgtgacgacgtgagcagcctctgctttctctaccggttgtatacatacatgctcaacgagctatatgtatataattggatggttagtacttcatatatactaacgtggaggatctcatcctggccggcgtcgtggcttcttggccggtgaagggctctccgcctcatcgtcgtcgtcggcctcctcgccgcaccgtcgttgctcgccggcgatctccttgatgggcgccacgtttaggtcgaaagcggcgcccacgctcgccgccgtcgctgcactggagaccgtcgccgacaccgatgggccatgcaagtagtggaacctcttgtgcccgcccagcgcctgcccggtggcgaatcctcgccggcacagcgagcagacgtgccgccgccgccgcccgtccgcctccgaggcggcgtcggcgtcggcggcgacgcggcctgatgatgccggagcagcagcaacgacgacgtctctgtgcgcgggcggcgccgccgccgccgccgatggcttgcggtggctcgccttgtgtccgccgagcgcctggtacgacgcgaacgccttgccgcagagcgagcaccggaagtggagctccggcggcggcggcgccagcgccagcgccagcgcggtgctctccccgcgcgccgcggcggcgagcgccatgaggcacagggagatgaggtcgccgccgtcggcggcgccgccgccttgctccatcacgtcacgctatccaacacacacagctcgtgtcgtgaaaattgaaggcgatacgtttgcatgcgattgcgtctgtccgtggtgtgtgctcttatttatgcgtgtaaaaaaacacgaattggaaaactctatttatactctcgttttgcatgtaaattaaaacgttatcaacttttttaaaaaaaatagtatgatagatcaatatgttatactccctccgtcccataatagaagagattttgactttttttttcactatttaaccattcgtcttattaaaaaaaatttagaattattatttattttatttgtgacttactttattatccaaagtattttaatcacaacttttcttgtttatatttgcacaaatttttttaataagacgagtaatcaaacagtgcaagcaaaagtcaaaatcataagatggagggagtatgtcacttcatgcctattcaaattcaacttatacatgtaaaaattctttttatagtcaaatttattatttttttcgaattatataagtcaaagttcaatttgtatgtttgtgaaaagatatatcatatattaatctatcttgatattttttttaaaaaattataactttttaaacgctacgtacaaaacgaggacaaaaatctacttgcgaatcatagtcgtcgcaaatggcacgaagaaatcgcgcgcgtcaaatcaaagcagcgcacaatggctgacgacgcgaacaaactcccgaggtaagaagcttggaatttgatctgaaccataaaaaaaaaaagatacatggcgatcgatatgtcgtaatttccagttttccaccaacccacacgtgcacttttctgtatataattctcgacgtcattttcatctcattatgagtttacaaattacaaccggtccaagttcgatctcaacttgcgaattttacatatgcaacttgtggatttatgcataccctgaatagtgaatactctgaaaccggtgccttttctacggaagagggatgggccactgtctcctgaagcaatgcatatgattctcgacgtcattttcatctcatgatgagtttacacccggtccaaattcgatctcaacttgcgaattttatatgtgcaacttgcggatttatgcataccctgaatactctgaaaccggtgtcttttctacggaagaaggatggaccactgtctcctgaagcaacaaacacagctgcgtgctctttgactagttcaaaatttgtccaaaggaaaactcgattctgaaaccagcagggataaagttctagaacgatcattttatcagtccccttgtgcggcatgacctgcttttgttttaccttcaccaggtagaataaacatgcatatgacgagtgcaatgaagagcacacggagcgccaatcttgaaagatgaaaatcatagcctcataggcgagtaattgtatatgtactactctataagctctttaaaaaatattttgtaacgaataaattcatttcatcattattaaaaaatataggaatgagtgtattttgcacacatctacacactatcgcaaaggtcaaaataacaccatcaacaccgagaaattggacattctaccacttctaagattgggttttgccacaatgccattccgcggaatggcgtcgttaaaatgccactttcaacctatgccaaaccgttgctttgccatattcgccatttcacaagatttttaccattttttgcacttcaactgaccaaaatgcccctctctcctacagtttctttctcttctccggtgaacatgtgggatggggaggagaccacgacggcagggtggcgctaacctcaggctcggtgccaccaccgccggagctctcctcctcgtcgtcctcctcttgctctgcaaattcaagaacacaatctttgagctcaaaccacacacaatctccacaatccggagagctagcgagggcgagggcgagcgcgagggctgcggctcacctcccgccgccttggtcgctggcgagggtttcggctcacctcctgccgccttggtcgccggctcgtcggtctccatccccgccgcagttaccgtgccgaccgagcccgagacgacgatgcaggtcccgtcctaccacgagctcctcctggagctagccttcttgggccatggtggcgtgcagcctccggcgcgcggcggagacgctggcggaggagatggtgacgagcggcgcacggtggtcagcgggaggaagcagcgcgttggccggcgggcgcgacgacggaggagattgtggcgcgtgacgcggtggccggcttagggtttccttctctttctccgatgtgcgggcggcgggcttcggccatgggggcgggacgtcgccggcggtgagcttgggcagtgcgggcgtcggcagcacgaacgactcacttgtgacagccggaggggtattttagtcagctcgggtggaaaattaggtggaaatagagagaattggcccaaatggcaaaacaaatgtttggcatctcttgtgagtggcattttaacgacgccattccgcggaatggcattgtggcgaaacccactattggcagtggcctaatgtccaatttctcatcaacaccagtacaccacaccatgacacaaaactgtctcaaattccaaaaagattaatgcatagaatttggagagaaaccggatttggtgataatgggacctcctggatgacatcttcaaggagaaacgcaacacacggagcgatgctgatgtctgtccagatctcaaggggatactatacaaggttttcacccgatggtctcatcaaagagggaaagagacacttccaagagggaaaacgacgcccaaaggcatcgccattgtctgccacaagactgggctagacttttgccttccacccaccccggttgttctacagctactgctccaaagccccgataccaagtagcgactatcaacgtgtagacaccgctgtaccaacgtccccctcccccgttagccagcccctacatgccttcatgtgccaatgctgcaactataactgtatcacgctatcatcgttgcaagcctccaccttagggcgtcatcattgccggtcaccatccccgagcatctagacctcagggggcctggaacttccgacattctttgacagcacaccagaaaaacggtcataactctttgctccggagtccgttttcaacaaagttgggctctgcggaaggcttattgagagggttattgtcgacgggggatacccgtaggccggatatagagggtactggggtacgctggtacgaagatttacgtaatacaacatcaagcagacagaaaacaaagattatactggttcaggccccttgataggtaatagccctaatccagttgatatgggattatatgatggaaaccacagattacagagggaaaaacagaactcgatgataccgacgagatcgtaatcaaacaggttcgattagatctctcgtcgacttggctcctgtaggcttcaactccgtaggctgtggtggatgtgctgactatgagatttgatgccttaggtcctcccggggggtcccttttatatcgcaggtcaactggtctccaagtaggactcggagacatcagacccggcatgatacaatgacgacccagttttgtccgagtaggactccttccatctgtgaactccatgatgaatttccttaacgtataccgaaaacgtccgtatacacgcaagtatatcatatcgatatgtgacgtatatcgtagggtagagggtataccttacccgtaaccctgacagtagcccccgacttctgcataactgaactcgtgtaaccgatcgtgacttctgatgttgaggttgttgtcgttctcggtgtgaggaccgagagacaaggagtaattgacaacgccaagtgaaactcaacagtcatgagtgaatttaaattaaagtccgaaaaactgccgcgcgtaacggacccagaaatttccggcggccatctctctcctttccttggaatccgcaccatcggaagtgcgactatttaagggagttttggggatccattttgaagtccgcctgttgtgaaaaaactctccagcctccaagcgtacctcgtcttctccgctcccgcaaaaaccctagctagctcatctcggtcctttctccggcgatccccggcggcaatagacctcgacaagtctacctccaccagcgcgtcgctgaagaaactacaggaggatggcacccttcccggtcgcgggaccatggagagagaagcaggaggtattgaaccccagcctgtcctgggtcgcatggttgcgatcgaggactatattctctgtggttttcttctcttggtcttgaacttctacggcctttctttgctccatttgaaccccaattccatcgccttcctcagtattttttcgcatctttgtgaggcctacattggggtagagccgtttcttgacctctttcgtttctactacgagttgcgttggatggaatccaacaaggtatctggatgcgtcggtttccgactccgggatggcctgaagtcgcgctatatccttttccagtgcccttcttctcgtagcaaatggcgggcgaggtggttctatcttcagatagaaaattcggattcagtcttcgttgttcctgaggaacaaccagacaagatttcgtctcggaccgcaaaacccgccttaaccccttctcttcagtccttcatcaatgccatcgatgacctccgagtacgaggtttgtcagggtatgaagtcgctgtcgacttcattggtaggcggatcaagccgctccaggctcgagcccacccagcctttgactattctgggccggaggacgcaacccgggtttctcctcggggtatttttcttgtatttaaattgacttccttatgtgcgtgttcctcctgacttatcgaattctggttctcgatctacatgtttgaacagcgaaaccgtggagcgccgcgtcggccaattgatgatcagcggcccgacaacggcgagcaaagtccccgtccccctttgcgagaagggggcagccgaacacgaagctgccatcaatgtaagtgtactcggcggccctttcgcatttttcttcggggatcgcattgtgacttcatgaagtgtaggctctccctctgactgatatcatcgggccgctcgtggatcatcaagcagcggcgtcgctgaaggaggacgtcaccaaggaggcgcccgatgttgctgtcgccgctgccacaacgagtggcggcaacgttccgaaaagggggaggaaattctcctccgtgatcagaaattgtcggaagacacccaccccctcggtaagctctcttggtccttcatcgcgtagtcggaaaacttccacctcacatcatgcccgttatactccagggctcggatgcgtctcccccgcctccacgacggcagcggcttgtgacgcttggcgagaagtaagtggatgaatttgaggttttgtcgcttcgtcaaactcttgtagcctttcacagggtagcacgggcgaaggcggcgcaagacggatctggagggacttccagcgcgtctcctgccgtggcctcgacggatgttgtggtcgtgcccaggagccgcgaggcaatgcctagcggcccagccagcgatctcgtggctggtcggggtctgccggctgtcgtcctcacctgggaggagctctaggtcgagatggggcgcctccttgaggctggtgctcgcagcattagccgcgagatcgcggaggcgagggcggcgtcagcgtcgtcgacgaatgagtgcgccgaccggctgacacgcgatttggcagaggttcgcgaggacctccagaagatgagggagctggtggccggcaatgagcgacaacgacaagggctcgagcatcgtatgtcggagcttgagaacaacttgtcggaaaactgtggctcgctgcgggtcacctacactggtctgcaccagctcgccggggagtgtggcgttaagactaccatcccggcgaatcccaacgagttctcgctgacgtcttcgcttgcagaactggcgacagcgatggaggcgatcccctccaagcacgcggccaggatcggagaggagacgtccaacgggacttataccggggcgtgccatgtcctcgcgtgtgtgaggctggcgcaccctgaactcgatctccagaagatcttggatcaaggggcggctagcgacgcgcgcaaggatgtgatggaagaagtgggcgatctgggggagtccgtccccccgctttttgaagaatagaatttcggctcccttgtactccttagtcatgctttgtaaaactctaattggttccaaccgcctttgtgcgtgcagtcatcaccttagttttctttagcattttgatctcgagtactttgttgtcattgtagagacgttgatgtcgagaatgtccagcagagcgggcagctgagttgccagtgttatttttgttggcgacgacttccttaggtgggttatttttgttttcatctcatttactctttcgtctggatcgacttgctttgctgtgttctcgggagaaaagagcagtttgccttagtcgtttccatgctaagcagacctcgagagtgcgcttgctgaccaagatcgccgcatccagtattggaggacgaaatttgaggtcgcggaactcgagaggactatgctggaggtgaagaaggaccaggccgtgcaaacactccgaggtcgcaaggtgtggttcagctcatatctgaagagttgctgcacgtccatgactagggtctgtagagagctccgagtaccccgtggagatcccgaggaatcagcggccggatacatctcgtggctgaatggggcctacgcccagctcaaaggcatcggccagcgtatcgatgaggccctgaagcaggagtgccgtcgatcgagccgatatgccggggggcatgtactggcttgcatacgagatcttcgtccgcagctgcacctcgagttcctccacgaagggttttctcgttctcggagaactcctacggagatagatggcctggcgaagtcgatggcgccgctggcggagaaggtcttccaatccatgaactggcgttggccttcctggtagtctccgtgtcctgtgacaaatgtcttagggaaaagtgtaatataattttggatttttatggaattgtaagaagtacttgtgaaatagaaaagaaatatatctaactaagctttcttactctagacgtagtgtgtaagagtgtcttctcacttcgcgacttcgatcagttgtttgagctatacactctccctagcccccagccttgccatcggaaaattcttctcgaaagataaagctcttggacctttgacctgcctcggttgaacaagcactgatcctagcccccagccgtgaagttggaaaattaatttccgattacatggcttggttaatacacacggcgagaactcttacacgaccagatcttacatggtctttcgtctctacaggatccgacaaggccttatcggctctgggcgtccccagccgaagttcccttaggttcctcggaggccttgtcaagacggcgtaaagggatatgaggataggtttcaacgctaggtgtcatctgggtaagggatcatcgggaaggaacactttgattgtaatttgtacctgaaaataggctttattgaagctgtaagatatcttacaagtatggatactattgtcttatacatagaatttacataattgatcaatgttccaggaatttgccaactcgcgaccatcgccgtctgcaatcttgaatgcgcctggcctcaagacttgtgtgatcgtgtacggtccttcccatttgggtgagagcttgtttcgccctgcttggctttgaacctgtcggaggacatagtcgccgatcgacaacgtgcgtgctcggatgcgcttcttgtggtaacagcgaagggcctgttggtagcttggctgctcgaacggcaactcgttcgtgatgttcctcgagtagattcacatcgtcgtttcgctgctcctcctgatcctcatcggagtacttctgtactcgtgtactttgatgtcgtagctcggtggggagcatggcctctgagccgtacacgaggaagaatggtgtctccttgttagacgttgtcggtgtggtacgcacggcccatagtactgatgggagttcttcgacccacttcttgtcgtgtgacatgagcctgtcgtagacgcgggtcttgattccttgtagtactatgctgtttgccctctcgacctgtccattgctctgagggtgagaaaccgaggcgaagcagatcttgactcccagcctaatgcagtgatcctggaaatcggcactgataaactgggagccgttgtccgttatgatacggtgaggcaatccgaatctgcaaaatatgcctttgatgaatttgattgcgtcgtcggccttgatttcccccgtgggtgtcgcttcaatccacttagtgaatttgtcgatcgccacgaataggaacctgtagccgccctatcctcgtgggaatggcccgagtatatctagcccccagcacgagaacggccaagtaagagggatagtttggagtgcttgcactggtagctttgtgtgtttacctgtggaattgacaggcttcacaccgctgaaccatgtcgcatgcatctttgagggcggttggccagaaaaacccttgtcgaaaagcttttccgactaatgtccgaccggcggcatgtgacccacagatctcttcatgtatgtcgaggaggagatgtctgccgtcgtcggacgagacgcattttaggagtaccccgtttagcgccttcttgtatagat

SEQ ID NO: 76035 - DNA, 21644 bp, Oryza sativa
actagttccgaatcccctttcacgaccagtcgcctaactccgagtgcagctgcagctcttatcccggcgagtattccttcgtactcggctgtgttattggtcgccctgaagttgaggtgaattgcatgcttgaattgatctcccgaagatgatgtcaagatgaatcctgtccctgctccttggctgttgagtgcgccgtcgaacgccattgtccacgtttcgttgtcgatttggttgtctgacctgttattaggcatggtccaatcggctacgaagtcggcgagtacctgggacttgatggatgttcgtggcacaaagtggacatcaaattggcttagctcgactacccattttgcaatgcggccgacaacgtctttgtttctcacgacttcaccgagagggaaggaggatacaactgtgaccctatgggcttggaagtagtggcgtagctttcttgatgtcatgattaccgcgtagagcagtttttgaatctgtggatatcttgtctttgcgtcgtggagagcttcgctgacgtagtagactggttgttgcaccttctctctctcaacaacaatgataatgctaacggaatatggcgtggcggcgatatagagaaataattcttcattaggttggggggcaacaagtacagggggatttgataggtagcgcttgagtgcaatgaatgcctcttcggcttcctgtgtccatacaaatttgtcttgcttcttcagcggagcgaagaaaggttgtcctcgctctcccatcctagcgacgaacctgcttagtgccgccatgcattcggttagcttttgtacttccttgagtcttgtaggtgacttcatgttctcgattgccttgatcttctcgggatttgcttctattcctctgccagagatgaggaaaccgagcagcttgcccgatggtactccgaacgtgcacttctctggattgagcatgaggcgatatcgtcagaggttgtcgaacgtttctcgcagatcgtcaatcaatgagtcgcttgtcttggtcttgacaacaatttcatcgacgtaggcctcgacattgtttccaagttggtcgctaagtgcgccctgaaccgtgcgctggaaagtgtttcctgcggttattagtccaaacggcatcttcacgtagcagaataccctaaacggtatgatgaatgctgtcttctcctcgtcctctttcaccatgctgatttggtggtagccagagtaagcgtcgaggaagctcaacaactcacaaccggttgttgagtccaccagttggtctattcgaggaagaggaaagtgatccttgggacacgccttgttgaggtcggtgaaatcgacacacattctccatttcccgttggccttccgcaccatgactgggttggctagccactctggatggaatacctctttgatgaaaccagctttgagaagcttgtcgagctcttctcgtatggcttgttttcgatctggtgcaaatctccgcagtttttgctttactggtttggcgtcgggtcgcaccatgagtttgtgctcaatcacctccctgggtacccccggcatgtcggacggctgccaagcgaacacgtcagcattgtcgcggaggaaggtgatgagcgcgagttcctatttctcgcctagtgatgccccaatcttgacagtcttgtcggggttggcactggagagtggaacgatgttgattgcatcgtccggtttcggcgtcttgtttgtcttgctcactttattgggtggctcagctgtggcaagtggactgggcgtgtgctcgaccatgtcgaggctccgcttgtcgcattgcactgctagcttagcattcccttgaatagtgattgttcctttcggtcccgacatcttgagcacttgatacgcgtagtgagatgcggtcatgaacttcgcgagtgcagttctcccaatgatggcattgtatgttgtattgaattcagcgacatcaaaggtgatctgcttcattcggaagttatttgcttggccgaaagttacaggcaacgtaattttacccaatggtttggacgatgactgaggagtgattccatggaagggttgatcggtgggtgtcaactcgcttcgtgggatccccatcgcgtccaaggtgctgccgaagaggaggttaattgagctgccgccgtcgatcagaactcgcgcgaccttgatattctgaatagtgggttcgaccacgatcggatatcgccctgggatgacagcagtcttggggtggtcctcttctgagaattctatcttctgttcagaccacttcatcttgggtgcagctccctgccacgtcgaacagacttcacgttccactttcttgtattctcgctttgaggagtatgtcgtggaacctccgaagatgtgcaagacatggagatcagagtctgggtatgctgagtccgattcctgagtagccgcctcagcgtccttctcgaccacacgtactcgcttgcctttttccaatgccatgtgttttgcgagcgactttttgaagacgaggcaatcttctagagagtgtttgtccgacttgtgtatagggcaccatgttttcttcatgtcgctgccttgtgggtctgggcgcttgggagggtctgcgtattcagttgtgagaacttccgcttgagctttccttttcccactcttgcgatttttcttcttgcttgactcaggtgcgtccttggctagtttcttctctcctccggtcttcagtttgtcgttcttgcgtctcagtgcgtcgtccgcgtgagcgcattgattgacaattttgaataatcttcgagtagtcgtgacacacctcgttgccaactcctaggtagtatagcgatctctgacaccggacttgaaggcgcggattacagaagcgtcggtgatttcggggattgtatttctgcactcactaaagcgccgaacataatccctcaaggattcacccgggttctgtgtcaacgcatgtaggtcgtcttcgatcgcgtgacgcttgtaagctccttggaagttggcgacgaactgctgccacaggtctgcccacgaagaaatcgagtagggcgggagatgcatcagccatgaacgtgcagagcctttcaatgcagttggcaaataattcgccaatgcgttgttgtctgctccagcagcgtagagtactgtggagtaaacctgaaggaattcttctgggtcggtactcccatcgtacttctctattgctcctggtcggaatctctcaggccatcggacatcacgcagcgaacgactgaaagctctacacccagcactgggggcagtgggttgtcggcgatcgtacgtccttcgtggatgtctatctgatgatgaggatgaggaagatgacgacgatgacgatgggtcacttggtttcggtgtacgattacgagggcgtcggccaggttctcgagaatcctgtcgtcgtctcctgttgctgtcccggcgccgatctccatcgtcgtcgtcattatggcggcatcctcgactagtatcgcccagcacccgtcgttcgcgatcatcgtgatcgtggcggttatcatggtctcggtcttcgctcgaacggcctcctcgttcttcgttatcgtgacgtcgtgaagagacgcgatgtcgggaatggttctcgttgtctcgtgcgcgtcgcgcctctcggtggccattcaggtgatcgcggagatcgccggtgccacgaggtgaaggggtggctcgatgaggcgattcccgctgttcagggttttcgccatcagcaccgccagttggtggccattccgggtgcgctgcagcagcggcctcttcgaacgcgttgctgaggttagtcactgattcccgtagccgttctgtccaccgtgcgagatcgtcattctgaacgggatcgtagggggtttccctcagtattgcgttgacggccctgatgtgctgggccggtgtagtcacttgattttccgcttccgcgttagcgcgcgctgacgtgccggtcccatcgatagccaatacctcgcgtggcgtacttgtcgagatgagccatagtcttcgagcaggtgcaggactgacggttcgtggggatcgatgtcgattacccccaacgaatcgatctgatatcagcgttgctccttgttccttgtcctcatccctgagggggatacgtgactgctggaccttaggaggtgacgtcttcatggcactgagaaagaccttgcagctcgagaggtcgtgattctttgtcttgtgaataggacaatagacatcacgagttggagaagtacgctgaattccacgctctttgcaggcatgaatttcagcgtggacgttgagaaaaacccagcaggcttgcaaggtgtgttttctggttttgtggataggacaccaggaccttgtcacctcggaagtcatcctcgccggctcgtgattcttgtcggaaagacaaggtttggccgcactaggatccttctcgggctcggatgtcgtcgacgttccgttctccgcttcggcgggaggatccttcgacatggagtcgtcttgggttctagccactgcgttcttgcttccggtcattgatggaccagacgagatcggcaccgtggtgtaaaccgggaagacgatttcgccgacttgagtccacaccagcattgttgaagcaggaactcctttgttgaggttggtgttgacgctgttgtcgacgaagctggatgacatagtagtagaaccttgagcaccaagtccccctacctggcgtgccactatcgacgggggatacccgtagaccggatatagagggtactggggtacgctggtacgaggatctacgtaatacgacatcaagcagacaaaaaacaaagattatactggttcaggccccttgataggtaatagccctaatccagttgatatgggattatatgatggaaaccacagattacagagagaaaagcagaactcgatgataccgatgagatcgtaatcgaacaggttcgattagatctcctggcgacttggctcctgtaggcttcaactccgtaggatgtggtggatgtgctgactatgagattcgatgccttaggtcctcccgaggggtcccttttatatcgcaggtcaactagtctccaagtaggactcggagacatcggacccggcacgatacaatgacgacccagttctgtccgagtaggactccttccatctgtgaactccatgatgaatttccttaacgtatgctgaaaacgtccttatacgcgcaagtataccatatcgatatgtgacgtatatcgaagggtagagggtataccttacccgtaaccctgacagttatccaacccaaccaagctctgaaccactcataggttagtttaaggctctggtttctctcaaggtaacacttgcatgggtcactttgagtaccgagagataaacaaacacatcaacaatgcatcactcttaatagtacggaattcgtatactcaaatgcaaataggaaatctataccactaggaatgttttcttgtcatcttcttgctttaccttgacagttgccaacaccaacgccatctcactactaggactattctcacctataactcattaagcacattaatccaaaattgactatatatttgtcttgatcaatgaccactttggcttttggcttgatgttcatcaacgaattacatcctattgatcttcggcattccatcttgcgctcttcaaataattgatgtggattactcatggcttcaaatggcctcgcacgatccatcgtgacaaagtctttgctcgcccttcaccaccagattgagtccatcggcgccaagcctcttgctttcccttcacctcctcatgatccattgtagccgagtcttgattgcccttcacgatcttgccatatatagccactcataccccgtgtccccgtatcgtcaatatctttacttgctcctcatcaagctgtaatgtccatcttctaccttcaatctttcagcttgatgtcggaactcaacctaatatcttccaacatgtgttgtcataaatcaccaaaataatcaccacactcttagggtaatagatcttccaatctcctcttacaaaggcaattctagggaatagatctttcaggctgcaccccctcctctatagccgcatcttgccgcctcgcctccatatggaccaagccgagtcacgacgcatccaagctctcgttgttatgttgtagtttgctctcctcaacctctgtggaatccactatcggggtgtcagatctagccacattgatatcggatatggcaacctactattgttgtcattgtcgccaccttgcgccacctccgccccagccatcgacccagtacacctcagctctcaaaaagcaccagatctagtcgtcgagttcaatagtgaagccaccacgccgcttgtcatcgtcactgccacctaatctccatggcggagctaggaggcaaacgggatatgttgccaccgtatcgttccgtgcgtggtttctggtggcatcgagacggaggagggagggtggtggtgatgacgactagggttgaagcccccccccccccttccccggtgcggttgtctacacggggggcgatgtgagaggccaagtcagtataaaataaagtctttgtaggatagaggttgtactgatatgtgttcttgcttgcgggtgtttggattatcacagagaaaactcaccatgtgcagtagaacttattggtaagtattgaagcggctccgatttaaagctaatggaggtatatgcggtaagcgggacacatgcaccgtatgtctatgtcatgaggactcacgtagaccaacaatttcaagcaccaactttggatgattggatccatatatatgactatatgagtcatgacatatttctaaaatgctttgtccaaaccagtcaaaccttgaaagtttttaccagaagaaattagcgacgtcgagactaagcacattcgccattgatgaaacgtttcgtccttgagttctcgttaattttttacccaatgtttaaccattcgtcttattcaaaaaatttatgtaattattatttattttattgtgacttgattcatcatcaaatgttctttaagcatgacataaatattttcatatttacacaaaatttttaaataaaacgaatgatcaaacgttggtcgaaaagtcaacggtgtcatacattaaaatacggagggagcactacttactagattgagttttgacgtcatatgtccatattgctcattcgggcttccgtcattctcagccgccaaccatctcccccaaaccagaataattgctacctctgatatgggttgacatgttcccagcccagtttcacaaacccaacatgaaatcgaaaaagtctaatttagttccctttgtaaatgtcagatctaattcatatctttcaaccacaaacctggttatatcgatttttccaactattaaaaccgtgcaaaatgactctctcaactattttgaacgtgacgtccacatagtatcccaatcatcggagaaataaaaaatagacatgagccccacatgtaagtggtgagtgaaagaaatatgaaaattatggggtccacattgccacatgttagcactcaacacccactcattcttttttcgctgtttcgcacggacaggtgcaagaactacagtaggcaagccggcgcaggtccgctcaacactgcttcccactgaggaagcggttttgtagttgagggataaaaaaataaaaatcatatccaacctatatttttgagggtgttaaattagactttattcggtatgcaattgtttgcttcaaatgggcctcactttgaaccttgtttgattttaatggcccatgattggcactgcttatgggctcagaatctgcccaatcaaaaattcataaggcttattcctgatgcattccctgagcaatacagcaaaaactagcaacaaaacaaactggatccttcgttggcagtaggaccgtaggacggtaggagtagtagaagtagttggcagttggtacagtacagccgcctgcaactgcaatgcaatgaactgagcttgtgaaacagtgaaactgcacactttttgcactgcatctcaccagtcaccagaccaggtaactgctattgcagcagctgcaacaagagcagtcaaaggacgacatgaatacagctaaagagccgagctctcgattatgaggtcacgggcgcaaaggagcttgagctgaaactgcagctgctggatgcccaattaatgaagtgatttgcaactcctaaccatcaactaatccgcaacgatcgtgatttgctaggattaatccctttcctgcaggtctcttcgcggcataattaggtgacgttaacgctgaccggcttccccctttttcctgggacagttgcagaggtgccgttcagacgacggtaaaaatatactaaaacgacagattttccctgatttcgtcaccgcgaatcgcgtcaccgtgatgtcgatgcgtttgattcggcgcagttatgcaacagatttgaggttttgtacgtaatcatggctcatttactcgagtaaattacgccgatacagggcgcaattggtaagctctggtcgtgaaatttttactgagttctgacgcaatgggcttggactgggacggtgaaacgtattcgttgttgtgccaggacaaagagatgcgagatgcgtcatgggttattctgaattgttgctgttgttgattcggaggaaacgaagatggaattgcgtgttgaggccagatggaagggtcagagcaagcaggacaacattttcatttttgggctgattggtttaggtatggaggaaaggacttgttctgttgttggattgcaggagcattttaatatgaccagtggacgaatcttctgaattttaaatggggatgggtgtaatcaggcaggatcatggtagttatggtagtgaagagtgaaatgccatctctacaataaatgttgtttctagcgaaatgtacgttctcttggaaaaatttctgaccaaaatatatgaccttgtttttcctctataaatcaaacaatttcacatgaaaattctatgcattttttcacataaattaagctctctatctctctgttatgagataggagtaatgttttttttaagaatctgtttgctcatataaactctactggcttgattctaaacttgggtgggtggtttccgttaccacatcctgttgataagcccgttaccgtgataactgacctttagggagaccttgtttcaactatcactctggttatggaattgtgtttttttaagaatcggtttgctatgtaagttaatgaatttcatgcaaactctactagcatgattctaaacttggataggcggttaccgttatcgcacctcattgataagcctggttaccgcggtaactgatgttaagggagaccttgatttagactctctcttattacgcaattatgctttttaagaatctatgtgcttatataagcttgtgaattccatgcaaactttactagcatgattctaaacttggtccatacgttacacggtttccgttaccgtatcccgttgataagtccggttaccgcgataaccgacaataatgaagacctttgacttggatttgagctaatgagacaagcattagtagcttccaatccagatgatatccttccatgtttgtaccaacattgaccaatgatggctaccaagtgtactaatgtactgacattttcttagggccccaacaacataaaattgaccggagtagaccacctcatcagtgtgggcccagcggcgcagccaccacaaaatcccctgcgtgtcttccgagttttaaaaccgaacagccaaaaagaagaccaaagggaaaaaaaatctgaccatttcttgatttcttcttctcccttctctctctccatcactccatggaccaagagaagcatcaagccatggccggcgctgccgacgccgccgccggcggtggctctgttgcgaaggacacgggcgacgattttgagttctgtgtactgtcgtccggtgggctcgtctctgccggcgccggcgccgcggcggccgacatgtgcgtggccgacgaggtgttctcccaggggaagctgctgcctctaaggctctcgtcggcggcggctggcgatgcggccgggcttggtgttctgccgcggtcggagtcggtggcgtccaccgtggggttcggctcgcggtccgacagccggagcgcgagctccagcggcagcagcagcggctgcgtcagccggagcgagtcgtccaagagcgcctcctccgaccactccgccgcgcatccgccgccgcagcagcagcagcagccgcggcggtctctgtcgagcagcctgttctacgcgcacccgagcccgtcgccgcagctgcgcacccggccgccgcgccgcagcaccgggtcggctcccccgccgccgccggccaccgcgtggggcatcttccgcctcggcgtcgtcggcgccccggacgtgtaccctccacgctccacagattccaagaacgccgccgccgcagcaaaagtcggcagcagcaggagcgcacggttcgagccggcgagcaccgccgccgacaagaagcatccggtggtgggtctcttcggcgacagcttcgggtgcaagtgctcccccgacgtggtggagccagtcaccttgccggcggcggcgaagagggccaaggccaagaacaagaacaaggccggcgacaagaaagctcagagtgttcgtcgcagcaggatcctggactggttcgaggaactaaccatcaccaagaagtagtaaatctttcgcgtaaaagatcgtgtaatttttttttctccgagttactctgtgatcaaggtaacatcatcattttagttcttaaatttcgatcattagaatttcattcctctgattaaccggccgcagtccttaagacataagttttctttcaacttgttttgtacagattacccttaatccgtatattaattaccttcggaattgtcgcgatgacacctgcagaggtcgcagtatatattcttgtttcagatgtcgtttacttttcttttttgtttctagaaccttacacattatctcatcagtcatcaccgttcgcgtgttgacgcttgtcgaattgtctatacggcgcgagataccactggtgtcacgtcgaagcgaaataaccgcgtcgggttcgggttcgggttcttgtcctcctcaaataaccaatttacgaacccactacttatatcaagtaataactcataataattttttatgttatggttagatttatcgtatctatagatacatgtgagacgattcataaacctatttacagattaaattgataggtaacttatgaatcaatctgctaattacctatttattttacatgtaagcgagttctcataggttgatccgcttgcattcctatcgcgagtggagacggggacagccacgcgtgcacagcgtaacgtacaattacgtggtgttgccgcctaccaccgagcacacggcagcagcgagcagccgaaccgaacgcgtggttccaccgcgcgtcgccggaatttgcgtgccgacggcgaccgcccgcgggtcggtgcggtgcagcagaatccgctctcccgacggcgacgtacacacggcgtccatccctttcccaaaatctcacctggaacgcgaaaaaacaaaacgagaaaaaggccactgtagctggctggctggagctcatgtgcaacgcatgcattgtctcgccggttggttcgtgctgcactgcgtattcactcttcagatacttgtggttttttttgttcctttttcctgcgtagatcgagattaggtgaggtgagcgtgagcgattcttggagcggttcgtgagcttttctttcgacgattaggattagctcatccaacctcacctaatctcatatccttttgcacggcattttgggtcgctactttctgaaaaaaaaaggttgttgttgccacatactacagcttggtggtcgatctcatggcttgcttgccggatccaaactttagtggaaagagagatgcccaaatgtgcacgtcgtttctcacctgatgccttttcgtttgccactttgccgggccagtgaaaaggcatactccctccgtcccaatatattaagacctaggatcggatgagatattttctaatactacaaatctggacaggcttcctaatatattaaaacctaggatcggatgagacatttcctagtactacggactgtctagattcgtagtactaggaaatgtcccatccgattctatgttttaatatattggaacggagggagtacattatgggatagagcaatcgagtgaaatgcacggtaatcaaatcagtagagcgtgaggtgagtgaggtcagtgtacatagaggttaaagagaaaaaattaaagtaagaaagctacgcctacactagattactagttgctgtaaaagaatttttgtgtaggagaaagtttggaaagcattggcgtgcatgtctctgggaatgggagacgtatgatgtgcactgcaccccgctgcttaaacaaagaagttaatcatggctgctacgcgagaaaggctgcaccggtgttttgtttgcacaattcccgaggccactaaaagtgttactactccactactacacaaaactaatcaatccaatctatactagcctaatccaattgtgcaggattacgtacaagtaggaccggccgacaggcattgcttccagggttacattgcatgcctctcaactgcacacaaggttatgtactgtcacgaaatgtttggatctcgtcgtccccatagccaacctggtagtactttcagtatcagtacatgacacagcaacagaaaatgaaaaaaaagggtcaaaaactgttgctggcagctgcgtcctgaaaacaacattcactaacagaggatctgagggttgccttgacggtgaaatggtagacactctagacttaaaatctcgtgctaattaaagagcgtggatgttttactgcaaacagaactgaatgtttgctgtacgattcaccagtagtcaccacgcttcatcgctgtggctgtgcagtgtaggacgtgcccgtcttttcgctggcataatcgatagcctgtgttagcctgtggtgtgacaagccagtgtggaggtaaaaaagtaccgggttgtttgggctttggacaccaacacgtgctctatgagcatcgtgctgttacttgcgtaggggccgtcggctgttacaccgaagagcaacggccaatctgtggcaggttgagttgacttaagcgagtgatttctaatccagctttctgtagcatggagtatttctgcagcaacctagcagggtcggtccatttccaacaccatgttgaagctatgtcatggcacaatcatcgatcttaataaaacgttactccctcagtctatagcctcattgtttattagtaaaaaaataatttataagtacatattttctatgcgtgttcttagtgactaaaaacaaatattgtaaaataaacttctttaaaaaattaaaattaagttctaaattttaaattttgacttataagtataaacataaacaaaacaatgaggcttctaatgtggaatggtaggttgctatattttgaaatggagggaatataacctaaataaatattattatatcatgtttttgctataaactttgtgcttttaaatcatcaaaaaacattcaaattcattgcgtggttttcatggtttgccgggtgacaaggcaacttgggctgcatccctactccttagcttaaatagccattgaaaatgcatttcaaagcttcaaaaacaaaaagataacaaagataaaattgtgccctacggttggaaaaaattctggctccaccatggctggaggtggatccacccatgctatggcaaaatacgcttcccacattcaaaacggatgcaagtgagacagggttgcgatttgcatatacaccgtacaagtttttccttgttttagtacggagtagaaaataaactagcatgcagggtttttgatgtgggataatgtgctgctcgcttgcatccctagctactcaaaacaattgattaggccataaatcagtacacggactgatcaaatattatagattatgaagttagatagcttagaaagaagttatctgtagcgcccgttccgtcgtggcgcctagcgggaaaattatctcttaaaaaccctaattgcgaaatttatttctttgcttgttgtctagtgtccatgccatctcaagatctcaaatccccgatctatcgtcgagttcaattccgaatccaaaaccttccaaatcaaatccctccgcaaaagtctattttgcctcccccggggtcgatgggctgaattttctctcggcccatctccccctccctcccccggcgctctccctctctctctctccccctccgctccgcccgcgcgccgcgcgcgcgtgcgcgcgagcaccgcgccgagcgcccctcctcccctcctcgctctccttctccccatccctggcgagctccccgcccgcgaagccggcccccgcgcgccgtagttcgcgcgcgcgcccgcggggttgccgcccgtgccgcgccgtatgcgccgtccgcgtcacccggtcccgctgccctgccgcctgcagccgcgcagccgctcggccccgcagccagcgcgcgtgcccgagccgcgccactcaaaccgccgcgcctcccgttgcatcccgcgcgcgcgtgccgtggtggccgaccgcctggtcgccgccgtcgtcagcgcctgcccacgcctgtcgcccgtgtcgccgctccgctccaaaccgccccaccgtcatcgccgtcgtcatcgcctcggccccgccactccgagcgcaagccgccaagggacggaggcagagcccctcctccctctgccgcgacgcccccgctcccctcctccttttccccaaagcggcaaggaggcgagccccctttctctccctctttttccctttcctcttccccgccggcgtcatccgcctctgtcgccgttttggccgcaagcgccgagcgccagctcgcgccttgaccgcccaaagtcggtttccaaaccgacattgccgccccctttaaacccaggcgccctcccttcctcttttcccctcccaatcttccctgtttttcgcctccacgccattgccgccgccccccgtgctctgttcgccgtcgccgttcgtcgttgcgcgtgtcggacgagccggcacgagcaaggacgcggaaggggactccgggcgcgccctctccttcctcttccccggcccgaggccggagagattactcccgcgccgtcggcctctcgtcacagcgccccacctcatctcggtagtgcctccctccgttcttcctcctcgttccatctcctccccttagactcgggtagtagcacaagtagcctccccgtagctagccggcgccgccccgactgctgccgtcgctcgccgtgtgctcgccgccgtcgccgcccgagctcggaagcgcctctcgtcgccggcctccctcgatgcgttttcgcccaatccaacgctagcatcgaattcccgtagccgcgtagatgctctcgccgccgggaatcggcccctcgtgacctcgtcgccgtttcccccttctcccgccgccggttgccgccgccgcaattcgccgccgtcaagctccctccggcgaatccgagccgttggctcgtctcccctcgtctcgtgcaaccacccggtgtgctcgccttcgcctgtatcgccgtggttcgctccgccgctcgccgctgtcgtccgccgtccattccggccggcgtcgtcgtctacctcccgccggcccgcgtggcagccacgtaggcgccacgtcggcgccagctcggccaagaccgggtcgagccgaccccggtcagtccctccccgtgcgcgtgttccaccgcgagccgtgaggctgcgcgtgggcccgccgcatccgcgtccaccgcgaaccgcgcgcgtacaccgcgtccctcccccgcccgtgcgcgtgcgccgcgtgctcgctccgcacggtgaaccgtgtcaccgacaagcgggtcccacccgggaccgcgcgaggtgagcccggtccaccggccctctctctcctcccctcccgcgcgcgcacgcttgggccgccttgggccggccggcccatttagctcggccggaacgctccgtttctctcgggccgcgccctagccgcccgaggaaaagtctatttcccctccctcttttctttcttttcttttatttttcaaaaaggatttaattcaatccttttcctttagaccaaaaatccaataatcttagaaattcaatatcttcccaaccgcaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggactgcacttactctgcttgtcccgtctgcaaggctcgcgtgacctcgtcgccgtttcccccttctcccgccgccggttgccgccgccgcaattcgccgccgtcaagctccctccggcgaatccgagccgttggctcgtctcccctcgtctcgtgcaaccacccggtgtgctcgccttcgcctgtatcgccgtggttcgctccgccgctcgccgctgtcgtccgccgtccgttccggccggcgtcgtcgtctacctcccgccggcccgcgtggcagctacgtaggcgccacgtcggcgccagctcggccaagaccgggtcgagccgaccccggtcagtccctccccgtgcgcgtgttccaccgcgagccgtgaggctgcgcgtggtcccgccgcatccgcgtccaccgcgaaccgcgcgcgtacaccgcgtccctcccccgcccgtgcgcgtgcgccgcgtgctcgctccgcacggtgaaccgtgtcaccgacaagcgggtcccacccgggaccgcgcgaggtgagcccggtccaccggccctctctctcacttactctgcttgtcccgtctgcaaggcagattggcggacctacctaatttgttgcatttgatccttcctttgttaattgtgataccatgtccccttgtaaccatctagttgcgtctcgatattcgtgcaccctgcgcgagtatcgacggacgccttcaaacttaaaattttgagtaacaacttgggtaaaacttgggttttacaaaagacttggaaaacccgacacctgggtcggtgcttgcgaactaaatgaatttccaaaaccgcggaccggggaacgtaccgggtgtacgatttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgttggcatatggtaaacctgtgtcggctttcaaaatgccttgtcatgaaagcttggaggtctcctgacgtggctgatccccacgggctgggtgatccgagttagtaatgtcgtgtgggtaaagtgtaccccctctacagaggttaacaaactgttcgaacagccgtgcccacggtcatgggtggatgtgaggtgattcctagcgtagttttgtttgactactgcttgtgaaattgctgttgtggaaaggggttcgatgtttgaaaaatccgtagctgatggaatcagctaggcccgggtggccgtttgaaagttgttggcccgggtggccgtttgaaaagctgttggccgggtgccaaccttgtttcaattctaaagactgatacattgcacatactccgaccggacgagacgcactgtctcatccgtgtcgtttgagaagcactcacttagtcgtttttagaaaagagttcaaataaaatcaattgcaaaaacaacagcctccccttgaagcctgcattaaacacttatttcccatggcttgctgagtactcccgtactcacccttgctctatataaataatcccccccccagttgctgaagaagatgaagcggatcctgctgatgaggaattcttccaggagcaagccggctacgatgagttttagggtttcggcctagttcccaagtcgcgcctgtgatgtttggtcctagtcctggcttccactttccttttgtaatgcagttgtgagctcggggtctgtccgcagcccaacatgactgtacctctactctataataaagagacctctgttgctgtgataatctgtcttcctgtgataccagcactgtttcctgggactggtatcgattaacatgttaatttggagcgtcacgggctagttccggtcggtactagttcggggcgtgacattatcgaagcaacaaccaatatgttttttaaagtaaatttcaagaaaatacagataatttcaccaaattatcataaaactatacatttaaggtgatgtatcacaaagctatagatttaaaactaagtatcataaatctacatatttaaacaataaaattaccccgaaactatccttttggccttttggggtttaatctttaccaataatattaatattatgtttgagttatatacgtttaagatttgtgattaaattaatgttaaatctatagttttgtaataactttgttactaaatatgtagttttgcaatactctatccaaaatttataattttgtaacaaatttgatattaaatctgtagttttgggatatatctataattgtgtgaaattcattcttttttgagaaattatatttttaaaagcgtggcacgaataatccacttctcttttgtttaaaaaacaaaagccttgtgaagtgagtataacttaaccgataaggtttcttatgttgtaacaagctcactcgagttcaagtttcaagtttgacatggacgctctgtattatggctaattattttttcagtggcacggaacatattcgtcgatagtgaggtgtcctcggtgattttgtcaattttatggtagcctacactatcgaagtttgatacttttaaaatcttccacccatgaaaaattaggaacggtaacaaaccaaaatttggtcgaatggattagtgggcggggtggctaggtggctcaccaacgcaggcccgtctatactgcgtaggccacgggtgacaggttgaggtttgttctggctgtggacgtactagcgacagagctagggttggtgcaataagggcagtagcaacgcaagctgcacgtacgaggaacctaaaaaagccacataggctttagacatgggtccaaaattagtttccacacagtgcaaatggcctcatgagtgaatttaatttttcgctttaggccctaccacttttgatttcaaccctcatatttttctcaatttacaaagaagtgtaaattttacactaacccccctaaaattgagaaaagaatataaatcaccactatcaccgggtccacccccacaaccctctccccttctcacgcacaccatctcgacaagttcattggcaacaaactccgccgccaacgcgctctccccagttaccctacctgggcaacgaactttgcaccggcgacctctccaccctagcgatgagctctgccaccgctagcacctctctcatccccggtgacaagaacaatatcgcgacggccactacctccggtgtctcccaacttccccacctcagcaacgaactatgtccgcggcggcctctccccatcatgcccctccactttcggacgccgctcgagaccacaaggaaaccgtatccagcaccgccgcctgatgtcatggcctgatctggcctcaagctcaatagccatggtcggatttggcctctcttatcccttgccaacaagtgccgatcgagcatagtgcatcgttgtcggccatcgccttcgtcgacaacctcactcctgtcacctctctactgctgccgccatgcctccatcgttgttggcttgttgctgccaagctcgggtggagagagagagagaagggcttttgagctcgagtgggaccgctactaagctcaggtgaagagagagaagggtttttgaacttgtaactcacaagtaagaccgatcttccaagtgaagacatggtccccacccaactctctcttccacggcaagaggcgtcctatgtggcgggctagagccacacaccacgtagacgcactgtgaacggcctaacataacagggatatagctcattccctcctcggccttgccaacccgtgatcacccaacgacacgacaactatgggcttttttcgtttattgccaaaaaaacccttaccatttgtaggtaaagccaaaatttggcaagatcaagatatgcagatggcccggactaggttgacccgaggcttgacccactgcagctcagatttttacctaacattgtcattttgcaaacagctagaacaaaggcctgagcatacacaaacaacaactcgtaccattcgaattacttactaacagtaaaggatcccagcttagatagatcagggacccaacaagacagttccgaagatgcagtcaagaacatcaaagatcctggagcccatctaattagcggtggctcactatctgtgcttccccagcgagcaacctgcatgtccgaccatattatcatctctttcaaacaactacgatctccgtcctaaaatatagctacttccggttatacatggagaagtgcagtagctatattttgggacaaagggagtacaaaaactatatttgacatacctttccactcctaacattccaagcatatacactgccatcaccagagcctgcatgaaaaataaatattaggtaatgaaagaggatgtgccaaataatcacaaaggatgttagagaaaagtgggtcaccagatattatatggtttccatcagggctgaatgatgcttccagcgtcgaattgcttaccactggcttcacgttgtatgttgctatctgaaaaaggaaaaggtcaaagtctccacataacaagtctgcaaaatataaattaccaaagatagtttgcatgcttacattattgccatgaaatgaatctagcacatgaacacgcccagctttggtggttaaaagaagccgcctgccatcactgctgaactttatgacattggcttctgaatcatcattaccgacagagaaaatatcaaaaggcccctgtggatgtaagaagttaaatgggttgggtaattaagatcaaacaacatactcattcccattaccttctcaa

SEQ ID NO: 76036 - DNA, 3553 bp, Oryza sativa
aaaaatataaatctatttagaaattaaatttaatcagcaaaaattatggaattgagtaaaaacaatgaactcaaagcattacgaaattatgagaagtaatttaatcaaatctaaaagtagtttttatataagataaaagtaacttacctatataataaaagtaatttacaatataaatgttttttcatcataatattatcatgtaagatcttgttataaagatttaattgcaacggacacaatggtgtaatcggattatatatcggataagtaatttaagagaaaattttataagaagaaaaaaaatatgcacaacctaatagcaaaaactacttgcatgcatgtctgtaacgctactagtacttctcacgtaattgtccgcgtcgctcgttaagtctaaatcgagatgcctctcgaaatagattttgcgtaaattattccctcctccgttctaaaatattttaatacagaagtagtatttagcgtgttaggtaagctgcttaaaaaaattatgtagttataatttattttggtatgagttgttttatcacttaaggtatttaaaatttttgaataagacgaatgatcaaacataaacatgtgttcaaaagtcaatggtgtcatcgattaaaaaccagagagagtagatttcaggacagagggagtattaaattagacacgtgtttgttatcattttttttgaaacagttgacggtaagatttctaccggatatattagaagaaaagagtttttacctaaagggggagagagttcacaaggcaacacctccaaggaggaaacagcacccgcatacatcgatgtcaccgatcctgtaagaccagacaaggatttcacccaagactgtcgccgatcctgtaagaccaggcaagaatttcacctaagactaccttaaaacgtgtagaaccttcaagaaacaagagcaaaagtgttgagtgttatcgttgcccaactcatcggctgacccgatgcagcagctccgactccgccttaacacgaaagctcaagcaccgtagagaaaagcacaccgctccaaactcggcactaagacagatccacacagtcacagggctcttatgcctcgccagtgctttgttatcattttgtaccatgtcttttgggcctacggtgtacattactacatgtggagcgattagcagcagccatttcgtagttagaatagaagaacacactcttgaggctatcagcaaccagctccactgctagctccaggccggtcatggcggcggctggtcacgatgtgcagctcccccacgtcgccatcttcccgttcatggccaggggccacaccgtcccgatgacccacctcgcctgccttctccgccgccgcggcctcgccaccgtcaccttcttcagcaccccgggcaacgcgccgttcgtccggggacagctcgacgacgacgtggccgtcgtggagcttcccttcccggaccatgtcgtcgcccgcggcgccgcggagtgcgtcgaggccctcgactccctgttcccccttccggcgttcgtcgaggcggtgtcggcgctccggccggggctggaggtgtcgctcgccgccgctcggccccgcgtcggcctcctcgtcgccgacgcgttcctgcactgggcgcacgcctccgccgccgcgctcggcgtcccgacggtggcgttcctcggcgggaacatgttcgcgacgatcatgcgcgacgtgatcctccgcgacaacccggccgccgcgctgctgtctggcggcggcggcgccgaggcggcgacgttcgccgtgccggagttcccgcacgtccacctcacgctcgccgacatcccggtccccttcaaccgcccgtccccggagggtccgatcatggagctgaacgccaagctatggaaggccatcgccggcagcaacggcctcatcgtcaacaccttcgacgccatggaaggccgctacgtcgagcactggaaccgtgaccaccgcgccggccccagggcgtggcccataggcccgctctgcctcgcccatggcggcaccggcaccggcaccggcgccgtcgagccctcatggatgaagtggctggacgagaaggcggccgccgggagagccgtgctgtacgtggcgctcggcaccgccatggccatcccggacgcgcagctcagggaggtcgccggcgggctggaagccgccgcggccgcgggcgtctacttcctgtgggccgtgcgccccagcgacgccgacctcggcgccggcttcgaggagcgcgtggaggggcgaggcatggtggtgcgggagtgggtggaccaatggcggatcctgcagcacggctgcgtgaggggcttcctcagccactgcgggtggaactcggcggtggagggcgtcgccgccggcgtgccgctggcggcgtggccgatgggcgccgagcagccgctcaacgcgatgctcgtcgtcgacgagctgcgcgtcggggtcagggtgccggtgccgacggcgatggcgacgggcgggcacggggtggtcgggagcgaggtgatcgcgcgcgtggcgagggagctgatgatgatggccggggaggggaagggcggcggcggcggcgaggaggcgaggaacgtcgccgcgctggcgtccaaggcgcgagaagcggtcgccgagggcgggtcgtcgtggaaggcgctggaggagatggttgccacgctctgccgccctgttgaaggagatacaccgaaacccacaaaataagtttatttgtttctacgtttgaccggcatcttataatctatctatctatctatctatctatctatctatctatctatctattattattattattattattattattattattattattatgattattatatactaaaagtccattaaactttctacaaacactctcaagccaccacgtggcgctcctacaaacgctcctagatcggcacgtggcgctttaacatccaaccatcggttttcatttaatctggtgaacccattatttttaaccattggatctttattttaagaaaaaacaaatcaatctatctaaaaaatcccacgttactcggccgtgtcccctgaacctgtacgtctgtacgtccgatgtacgtacatatcctctctatgtccttttctttttccttgttatatatttagattagatgaaaaactttagttcatgttaaccatatgttttaagttgtaaaaatatatgttattttaagttttattctaaatagtgcatctcatcgaaatatccataaaaaaatattaataattaacattatagactatatgattgtatatcacaattaaattggacttataattaaaaaaacaatttaaattttgagtagcattttaaaaatttactcactccctatcgtgtaatactgatatatccaaatgacattattaaatttatcaagaatgtatttttcatatattatatgttgctgtattcatatatttttttttggaaaattaacaaccatatatattttttacaccatgtggatgtccttttatctcttagggctgcagga

SEQ ID NO: 76037 - DNA, 1794 bp, Oryza sativa
attcctgcagcccaatatatcttacttaaatatgaaaagtaaatatcatcaagaaataacaaaacacttactcgtattaaggcaaacgtctgtagaggtacaagctaggataagagtgccaacagacccaacacttccccaggagaagagtgctgatagccctagcaattctctagacttcctctatctccctactctaggcactagctaagtagagcttcacttttagaatgaatcatatgatcttctatcttggtgtgtcttgagaatgagagtgtcaaagtgacttgagagagagtggagatgctaagagaatattctccctctatctcctctcaagcctccacctctcctcaaaccatcattcgatggtggtttcctgccttaagccttgcgccactgacttaaggattatgataaccgtcgccacgtgaagctgggcaagaggggagccaccccaggttcggcttgcgccgcctttcacctgggtcgctgcctagtgggcacccaagttggtttggggtgtatggatgaagttgaggcagttctcctcctggtgtggactatttgatccctgttctctcctctatttggttggagttgtgctttctcttaatttgcacaagtaatcacctgcatacaaatattcatcaacacttgtggaagtggttagtaataaaactgtaacatcctgaaaattcccaacaataaaaatcactaaaatttcgaactttttaaaactttttgcatcatgctggatgttatggttgcttttatttgccaagctataaattgtcacaatggaaaattaaactaaagttatacagctaagtaataatcataataataagatattattatgaaccctataaatatttacgcacgagaaaacaaagccagacaaagggaaggttaattaccaatttaatttatagatcaaatattaaatacttgaaccatgaaatataaacacttaggaaatgataatcattcaaataaatggaactctatctatagagtagttttactgggaaaaattaattagatattatataatttgaattgaatcacaaatgctaaattatagaaatccatgtggtggtaaaaccaatccaaaaagataaaccaatatatgtgaaaacatataaataccaaaatcccaaatatagggaattataaaaatctaggatatatattaaatattggacaatattaaattttgggaaaattcacatttgagcacttaatagggtcacccaaatgcttaggagtaaatacaaattaaaataaagattaggtggatagaaataaataaaatattatcgcgaccatatttggatcaattaaatttaagtacgatggaataagaattaatcctaattaaaactcaaataaattatataaaaataaaatatgagtaatattaatctagggtgaattcattagttgagataacacaaatattgagtaaacttcatttatgcaagatttagaaattatagaatcaaatttatatggaaaataaactgaaatcgggataaataggaaaatacactgttcattatggcgtaggtgttcgatgtggtccctagccttccccctcctctcccacctctgcccctagccgccccgagccgcgccatcgccgcctgccgcgcgcgcctcgcaccccgagccgtcgcgccgctgtcccgccgccccgcgcgcccacgcgccccgtcaccgcccatcccgtcaccgcgcgtcgccgcctcgcgccccgagccgccgtgcgccgtcgccatcgtcgcctgc

SEQ ID NO: 76038 - DNA, 932 bp, Oryza sativa
aacagagccatcttaaaatcaacatgtattgtatagcttacagtaaacagcaactactcaaatatatgatccaataataagatattgttgcttacacatatactatacatcccattatagtggtacggtatagtattaatttgcgtgttgcatatattaaattaggagggagtgtatgacaaacatgtatattagataaatactagttataaatcttgaccttatataattataattatagttcaactgtaaattaggattattcattgtaaaattatgtgatgggataatctgtaaccataatatgattaacctaaacaactttaacatatagagcatggataattattaaccttttataatttattgtgacaagtaaaatatgttcataattaaagtaaagcttccatcaataaaataaataatacaaatgattcactgtaattatttgaatgatcctaaatccatctaacaacagaacctctagtatataaccgtcctatttagatagatgcatgcttagccataatccttccataagctatttgatagactaaaccaccgattagccaaatatatatgtatcccataaatgctatgttggttaactcctaaataggccacgttgacaatagaaagattaagaaaccttagcccctagcatgattgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattccttgaacatgttgatcctaattgcgagattgttttgtttacaaataaaatttgggctgcaggaat

SEQ ID NO: 76039 - DNA, 1391 bp, Oryza sativa
ttagatcaaccagcagtaaagatgaaggcacccagcaatagcgacagagttttgtagccatggtgacaaaataatcagtcggagacagacgagacagctggtgaagaagatgaaaacgcccattagcggcgacataataagccagccgtgaaggcgagaatatcagtcggtggcgatgaaaacaagccaacgatgacgacgtagaagcgcatcaacgacgatggcaaaatcctccaatcatgaaaatgcaagaaatagtcgacgatgacaaatgcaaccgatggtaatgacgattggcagcaatagagatgatcaaatatgatgacgaagttgcccatcaatagaagtagagtgggctatgttgaagaggcttgacaggatgttgatgaagatgacgatgtcagtgatccagtcaatagtggtgtagcagccgatgataacaatgaaatcctctatcggtagttgcgtagtaggccaaccgtgaaaacgaaataacaagtcggcgatgaaagtcggtgatgacaaaaagcaaccgacggcgaggacgtggtcaccccttagcaacgacggagacatcaaggccgatgaagtagatgtgctggtgatgatgtcagtaacaacaatccatcaaactgttgagaagaaatccatgctcaagtattttcttaatgttggcatttgtgtgacgaagattgatgcaacgcctcttgatttatgaagatggcagtagaacttggtgctatatctgttgcagatgcttcacttagaggaaagtatatgctgttgttcaactcattgaatctgatctgagttgattggttgatgactccaaactcccagacatgtaaacttaatcttgaccggctctgaagcgcagacgaagataataactcccagagttgacttgttgattgattgattgatgcatcttgacaaaaaacttgtcgaattttgagagtcttgtatttgtgtagcccccgaccctttggttagttgggaaacaacttaacatagagtcgagaattgtagcttcttgtcgtcgagtagtcattgcttgagtgaagatgcatgtcgaagatgtccgagtagaaatattgaagattggaacaccacttgttgtaataaaataacacggtgtcatatttggtgacgcatgccgagatgttgaagctcttgtagacgtcatggttggtgaagtagcaaaacttgcgaagtagcggcaatagagtttgccggtgccgaagataataaaaatgaagtcgctccaccatgatgacaaagttgcatagtcatgatgaagtgaacacgagtcgaaggcaacataagcaaaccggtggcgaagacgcatagtcgtgaagatagaaacaccagtcggcgatggctgcaggaat

SEQ ID NO: 76040 - DNA, 3794 bp, Oryza sativa
gctcaataaaggtacagaacctcagagaaataaatggatgcatacatatatgacttgtttaggattgtgaggaacccaatttccgttttcagaaaaaaagatgatgtacgtaattaaaggggcttgtaagtatttagttgcaaaaatcatacatctgggcttcagaatgatatttcaccatcagatggactgatggaggacaataagaagtctttttaaccgataatcagaaataagataaactaaatctgtaaaagccttaattgactgtaaactgcaggttgccaaattgacgggaaagtagtcaagcagtcaaacagtaaacttattgaggagaaatgtacctgtgctttttcaacccttgaatcccataggagaactgttcgatcaagtgaaccagagagaatgttcccgttctcagagcacaatgagatagaaacaaccctgattaagacagatagtatcctctgttggtattggctaaccgacatattttattggaatttatatttattataaagtttggcaaacctgtctagatggcctttgaaatatctcaaaaaacagttattgaccagtgagagtagacggagagaatctgcacagttaattattttaagtatttgtatacatgacttatatcactctgaagctatgacaatataggacttaccatcccatccattttttgaagaatgcaagacataagttgggttttcagtgaagcacacaagctcaaccccatattttttgctattaatcgtcttcaaacacctgaaagtaggtaagtgattcaaatacatataactgaatattgaccgccaaaataaaatcactacttgacaaaatttagatataaatcaaatactttgaaaacagatacagtattgaaagaaaaaaaatacaagcactagaataggtaagcccttgcccttcagaataaaatgtatgtagtactgcagtacagtaaaacaggagctgaaattgttgtacaaaaaaaatcaagactgagtgactgacaactaaatgcaaaaagggcaattactaccttctttgatttttataaggcttattctaattttaaagagtcctcaagattaaattttgaccgttgttttctcataaaatatattctaggtatccataaaaaatattgagcaaaagagctttgaaatgtgtctatattggcttttacactaaatgtacttgtaacttgataaatccttgatcaaaatcaacaaacttgagttttgaaataaaaatacaccttataaaaatcaacagaggggatgaaagtaagagctgttcaaactgtttacacaattggagacacaaaaaagaacattgagattaattgtttatactcacacagcattttgaatgtcatataggcgaattgattcatcatcacatgctgtcacgaggtaatttgtagccttgctgtggaaatccatagaactgattcttccattctgaaatacaaataagccccataagaagaatgaaatggccagtgcagagaatattttaactaagtcagtagatactaggcaacattctaatgtaaagtgaaatatgtacaaatggttcatcaaagaatatgtactgaatatacattaattttcagagtacacattgagattgctaattgacatcccgaccaacatacccgcaaggaattattgaagaaagagcagccaagaaactgacaggtgtgattgtacatgatgggtgaaaggcccgaattaaacaacagtagcatgctctacagttagactagatgaatttctttgttcttcacattctctgtttagtttcactcacactttatgaattgctaatatctcacgatatgaaatgtaaatatattaagtacaccaagagataaactgatatcttttcgattggttaacattgtttacaggacttattacatgcaaaaaaagtttccagtccaagctaccacttagctgtcagggttgatctacttagccctctgactgcgaaagtgtctagataaccccatgaactatctaataccatctaaataaacccgataaggttttacacatgccttttgccaccatagcagctaatgtgtcaatgcttcaacaaatctatactccatttgaaagatgcgatggtggttgtggcaatgaatctgccaccacacctcttcatattgcagcaatgttattgggttgccacataaataatcaaggcgagcactacatatagtaaaaaacaaattaatgttgtttatttcaggaaataatattatgtaacattttgttttatccctaaaaagctaggatttagctagtaagttgtaatcaaattctaaagctgctatatcagagagaaaaggggtgaatagaaaagtaggataagagaaggcaaatgaaagaaaaaaaaaagagagaattgtttcagttccgtggtgttccacgtaagcaccttagggggttatttagtttttttttctaattcaggatttcaggggttaagtaagcgaacaccattatggctatttctttatttagtttctgttcctcttaagatggaaccaactagagggttgcactgttttgtatcaaaggtagaatgtatggcaaactatttgaactagtataattcacaaataccaacatgccatctctaaatatggcatcttcatatttagttcaaaataattgcccgtaatagcatatattgttcaagaacatgtcctctaccaccacaagtgtccatggagtgacatcgattatgaatgaactcactaggcactccaatccaatgaaaccttaagccccttctattaaaattcatccactaaactaaactaaagttgatatattcgacaagcaacgcctttcgattcatcgatacatcacctaagagccatgacagcaatgataacccatgtaacacttagaagaaaatggcacaagcaaagcaaaagggaaacaccaattccagtagtcgatagaagcaaaaaacaccgtgtaacagcagaatcttacatagtcccggaaggccagcccaacctccatgcacttgaacatctcatcggtgacctccatgctcaccatggtcacccgctcctccctctcccgccctagaaaaatcaacagcaaggggcggaccccccaatttttttggggggaaaaaactgttattagtcctaaggttaagacaaagagaaaacctagcttccagatcgagaagagaagatcaaagttaaggcaaagagaggaggtgtggggtagagaaggatgagaatgagagaggatgcgcgtcggcgccggtgctcaccggaggcggaagcagcaggaacaccgcaccgccgctcgcgggatggatggagatcggccgcaggcgacggggcgaactcctcgaggagacgggagtcgaggccgaggcgacgccgggacggggagatggactcggggtcagaggcgagagtatgcgatggaagcagcagggcgcccggcgacggagaccggcgcgacgacggcgcaggcggcgagccaaggagatgacgcgggccgcggcggcgtcgtcgggtagcggaggccgcgacgcacgcagcctcagcgtccgcggagtcggtggataaatggaccgagcccagccgtgctgtcccgggcacgatggcgcgtgggccgtgccgtgcctggaccggcccgcggtacggcacggcctgctcggcacaccggcccacgtgccaccatcgtgcccgttccggcacggcacgggacggctcgataagcagccgtgactaacgggccgcc

SEQ ID NO: 76041 - DNA, 13285 bp, Oryza sativa
gcagctcctctccccaccgccattgcgtcgcccgtcgtcggccgccgacgccctcctcctcttccgcctcgcactgctggcctcgcagagaagggagagagagagagatgagaagggtgagaagaggggaaaagagagaggaagctgatgtggcaatgctgacacgtgggtcccacactgactcagccgccacataggataaaaccggcggtcaaaaccaccgaaggatctaaaatgaacggttttgtaagttgagggacgccggatatctggttttgtggttgggggacaattttgtaactcgatgacaagttaagggaccttcggtgtactttttcctatattatgtatgggtttggcccaagtttgttgcttgggtcacaatgggctccgatccattttggcccaagaaaatgaccccgagtcgagcgaagcatcgaggaattcccaggcagccgccagccggccgatcccccgtcgctcgcctcacttcgtcggctcgtcgtcgtcgtcgatgccgttcaccggaggactgggggcggcggccagccgttcgttgcagcgcggcggcgagatacttcttctccatccaccggccgcccgtcgatcgcacattcgcacgtacgcgacgctcctcccgcactggccggctacaccatgctgaatcgggtcaggactctccacacccttcatacaatttgcttcgatatatatccaactatattcaggagaactaggggtttcgattgatcgtctgaattcatttttgtcaaatcgtaatgcgttagtagttggggatagaaattggggtactaggctactagtaattacgaatcggaattaatatcgaatgacctagattgccatttcaccaatgtgcatacactgatatgcgcagagccacatatcgatttgctggggtgaattagaactttctaaaaaaaaaaagaactcgagacaatctggagtatacatggattctgcgtctctagttcagtacgcgatccatggctagctatgcgtgctcgaaagtcgaaaccagctgaatcaggccctgtttttttcagtttgggattattataatctagattattgagtcagattactataagctagattgtaataatctgtagtagaataagcagttagttgtttcttttctagattattagagtctagattattgggtttgcaagtctaaagaggaagtggggtggcatggtgggtaatttttcactcaataatctggaaaaagctcacctaaatgagcttatcagattataataagttagctccagattataataagctacttcaataagttgtctgtttctttcattttactcccaataatctggattataataatcccaagctaaaagaaacaaggcctcggtgactttattttcaccatatttattcagttttctctccaagtagtacttctcttcaatttctacctacattatattgacacactagctagtttatgcgcggatattctcgatcggttggcaacatatttaaaatggatatttgtttttccacattatcgtatcttggattaattttggtagttcaacacacaccatacatcaactataacatacaccctttgtccggctggttgttcatagagtatcaattacacagtagcaaaccgaaaaaaaaaatcgtttagtttacaggaaactttgtaaatcttgaaagagaaacacttatatgtatctgtttcttgatgcactcttggaagtgagacgtacgtactgatcaaatacccgtacgagaagttttttttttctttctgtggctgccgatgaagctcatagaagatatctaatagcacaactgcatcaaatgaaagtaaatattcgattagagtactagctagcttgttccagacagctgaaattgatcgcctttcgatcgaacatatatagaataggaaggatatcttgataagcatagatgcatgggggataattaaacatgctaagtctcttttgggatcgatttgagttttgcttttcaaaccgcagcaaaaatgaaagtaattattgctaattctctagatttgatctaaagttgctactacttccattaattggtcatgacaaattggcatttggacattctaatttacacggtatttgagatgaaactttgaccactattttctatcaaaatatatttgtaaagttcaataaaattataataccttctgaagaaaatttatacacacatatatatgatgatttctattatttatacaactaagtatacagaggataatgattcttaaaattataaaagtacaaattaagtccaaaacaacatgttattatgacatgagggaatttaattctttaattactagttgttttaagaggactacaaattaaagtaaaccatatacgaacttattttttagataatggattatattaaacacggcctctacaagtcacaagcacgagtatataagactctcctgttatatgggtaaagcataaataagttttaaaggcggacaacaagcaagaggaacttatgattagtctcagtactaacttacatgcatgcattctaatcagtctagctaaacatatatagtttgataactatatgctccatctgctagctaactttgttgctcatagcaaagttatggaataatatgaggtaaacatgatttttatatatattgagaaatggagtgataattgaatattcaatatatgcatgaagcactcagaaatggtttgcagttttgttttgccacttgccatgcatatatgtgctagaatgggtagatgtctgcttaatttgcaccagatttgtggatacttgttcaaattattgtagaaatatggaagatcaattatatccccatatatgcagttttgccagactagctagcaaagtcacaactcacaacgaagctgagaatgcactttcttgctacatcttaatttgtctgagtagatatatattcctatgcatcatcacgtggtctctcaaaacaggagagcataaattcaagcataggctgatcaactctttaatttgtgttagtagctactaccactgcgcttatgctaataagggctaggggtaccgtacgtaccacgggcatttcttacttgtttctgaaggagtatactataccttcgtcctaaatatagttgattctggactagacaaacaattgttcacatatatatagccataagttttatatttgggatggaggtaatagaagcaccaattgcaacaagagatagcatgaaaaaaaaaccattagcaagagcttttagaaaatttcttttgagagcattgatgaattcatgaattgtttgaagagaacatatcgaattggacaaagccatccaaagattatcttccaagctgtacattatagtgacatgatctgaaaagttgtcctcgaccatataaaaaaaatgacatatatttcttatcaaattttcaggagcatgcatgattgcaagttttttttcttcattcattcattctagagtaagaactagagagagattctcattacatgatcaaaacgacgaatcgtctaagcaaaatcaacaggtaaaagccaacttaacaagaccatctttccacaatgagcatacacaaaaacaaaccctaaatccaaatatccatgcaaaagtaggcacgcacacacgcctacacggccactcaccttgtcgccggccgtacacatgcggcatgccgtccacgcgcgcggcgtcccgagctgatcaggacggcgcccatgccgaggcgaacacgacgttgtgccccttccacgtgagcacgaggtcgtcgtcctcccgcttcatcccccacccggccgcgtggtcgttcagcatcgccttcacctcgccggcggcctcctcgccgaacgccgccgcgcggaacccggcggcgcgcatccgctggccccacctcgtcctgtcctcctgccgctccaccctctccaccccttcctgcgccagcacgttctccaccttccaccccacctccgcctcataccaccgccgctgctcgctccccttggggaggaacgtgtccacggcgtcgtacgggatccacaggaagttgaacgccgcacgcagccgccccaccacgtcgcccgcggtgaagtcggcgtcctcgtccaccaccaccaccagcgtcgggtcgagcgcccggagagatttgaggagcatggtacggagggacaccggcggctgcgccgtcgtcaggctgaccgagccggccgtctcgtccgggacggtgtggaggagcatgtggcagttcacgaccagcgcctcgccgccgtcggagacgagctgctgcacccggagctggtcgacgagggacgtgagcgcgtcggccggcgaggtgggcaccacccggaagtccatggacatgttgcgggaccgcgcgaagttgaccagcttcgcgcccagctcctcgtagggcatgtcgagcgccggcggcggcgcgctgggcgcgacgtcggcgacggtgaggcggaggatcgggggcccctcggcgcggccggcgagcatgtcgatgagcgtcgggatctgcatgcagtgcgtcgtgctgaggtcgacgatgtgcacgacggggaacccctcgacggcctcgacgatggcggcgttggccgccgtgtacccgaaccggtgccacggcgtgaggtcgatgaagctggcgagctcgacggccgtgaaccggtgcacgtggagcgccgccgactcgacggcgtccgctaccgccgcggtcaccgccttgcacgccccggtcctggacgcccgcgacacgagcgcgcacaggaacgccgctgtgagccgctggttggagtccccgtccgccggcgcgatgttgttgagcacccacaggatctgctgcgtcagcgtggcgtcgttggcctcgatggcgttggcgcagtgcaccagcagctgctccatgcagcccgtgctgttgaggttccccaacgagatcttcgacgccgccgccgacgacgggaagtagccgctcccacccaacgtcgtcgtcgacgacgacgacgaccacggccgcgctcctcctcctcccctcgtcgcgccgacgtcaaggtacaaccctaaccctagtccatgcccattagggtgcagaggcggtggaggtggcgcggtgtgcgtgaactgcatcatgtagtggtggcaccagcgcggcgcaagcagtgcagagacgcgattagaaaacagcggagacgcagagctagtacactttgagcggtttgaggcacggatttggtgcttgtacaaggcatatatagagggctgtgcacttgttgctcggaggcgccacacgtggtctcatactctcatcccaagctgccgctgctagctatatactgctacctagctaagccaaattccattagaactttgggaacaacatggatccaagggagggaatggagagaaagagaagctggccagtgatctagtacaaggaatatttcagtgaaggatcgatcgagcagagatgcaactgtagatggtttgtactatctagctggggaaaaaatggcaagaaactaatgaattcttcgatctcccatgtacttaccatctacaaagaaggatatatcgagatctgagagcactgttatggtagctaattaaccagaagctaggaataattagccgatcgagatggcatgcggttctagctagctaggagccagcttgaattcaagattcaagctgcggagatttctgcttgattgtctacaagagaattttatctaggatcgatgaactagcagatcagggagcagttgggaaagcgaggagaggatagatggggaatgctaggggaggggaaggggaagggaagaagaggttacaagtcactaattatagagggaattatgtagtggtttcttggattgttctggatggccagctattcatatatttgtctatatagtaactagtaattatcaagatcgctagcatgtcacattatgaacaatattttataattactctgcttggtaaaaatatataatgcctgtaaaataatgtataattgtcaacacgccaaattaaaggttaaaatgacatctagtggcccccgttttttacaagtctgatagcccattcggacttcaaaatcattcttattacctcatctgaattatctctcattttttctgcaatgatttaagctgtctatgatagagtaattttgcttctctctaaaagatagctttgtcgtatttacaaaaggagacatgggttgtcgtgattgtaatttattcgattttctttggaaaaaaaacttaattcagagaacgataaaaaatatatgagttaaatataacaacatactgatcctagcctcctacaaaacacacatgctcgtgtgagtgtacatctacctgtattgtgttgcacatagctagctagtataaaattgtgaatataaaaaacttttctatagattaccttttaaagaaagaaagtatggaggcaaaacaggagttcgatcataattaagtatcataacctcatggaggatgacgcagatcgacgtacggttgaaccggtgcactgtacagttgcgtgtaaatatgtacgctaaggaattttatgcacatattaaatttttgtaatccgttttcaaaaaagaaaatgtaacccgattattttagagagagggagagagagatagagagatcacggggcatatcatggtgaaatgatttggtcagttcgcgttgggccctacatggaacaaagctacaactagtttagtaattagagagagggtccattctatttaatatcctcattgttgcaactggaaaacgactctttgtatggatctaaacttacgcgtccaagcactggaaactattcagctgaagaattttatagaccaggtatgctgctctgcagcgcgtagacacacacacacacacactaacaattcgaccaaattgattgatagatggcacttgtgacatataagttgcttataatagaatagtaggcttacacttcgaatatttccatttgttcttaatttgccatagaataagagtgcatttgtttaaagttaatcaagcaaatcatcttcttagttaattacccaatgtcgttatgattttttaaggctatctacataaccatatcctcgatatgcctttagttaagtgcatgttaatttgcgtgccaatgtcggtctgtgtcattgctagttgttggaaaccatcgggataaaattccaatagttatacattactacatctgtctcatagctaaaaatagatacattttagaatgaaggtaataagatttcttcactacctgtgttaatatcggtggtgctgccactactttatagcaattagatccaaaacaagaattcagatataggatcataaagtggtagaactactgcagaaacttttattggttctgcttattaaccagttgtaggcgttggtttctcagtcggaaccaatttaagagtactaatgcctaatagcataggtgccggtttaaaatacgatacttataaaactataagtaccggttattatactacaaccatcacctataaatccgaactgtgccggttatgctatccacccagcacctataaattagaatgtgtcgggtatttacttaaaaccggcacctattaagttttataaatatcggtttttcaataaccggtaccaacactcataaaatcagcacctatacctattaaaaccggtacctattatctgggaggtatttgggtaaatactatagatatcggtttttttttaagaactggcatactctagtgaaccaatgttgcgctataattaatctcagttaggacgatccattattaccacagttgtaatgacagaggatgtttttggtagatttcaaacatacaattccaagggaggtgtgagcctatcatcacgcaagcttgaagtagggatcagaagaatttatagtacgacttataaatatacttcctttgtttcaaaatatttgacgccgttgacttttttagtacatgtttgatcattcgtcttatttaaaaactttaagtaattattaattcttttcatatcatttgatttattgttaaatatactttcatgtacacatatagttttacatatttcataaatttttctgaataagacgaacggtcaaacatgtgcttaaaaaatcaacggtgttaaacattttaaaacgagggagtatctacgtacggatgtctgcatgcatacacacacatacatgcatgcatgatgtgtgtgtatttatgcctctctgtagcagtaaaaggaagaaagaaagaaagaaagaaagatgccaattggcagaccccacccaaaaacacattgttgtacgtgtattctgtacaccaaaacagaagcagatcgaagcattcatttccggccctactgatcacacaacactactactcgctacagcgatcgatcagctgtgatctgtcccccgcgcgcacggctcgcgttcaatgcgtcacacacatgatatgatgcgcggtgcacacaccggcatcagctgcgcgtagtacacgcccacctacagtggtatacggctccgctcccatgtatcatggggagatttcagttcggctcccgcgcatgacggcactgtaattttctttttacattttagctattttaatattttatcttataaataaccctttgaaaaaacttattttagaaataaattgttttttcttgatacccacggctgagaacctatctataagaaaaaatatttacaatttaaactatttttgaaacaatattttttgaatagatcctcggtgccagttttgttgacattgaccactctatacatcttgactgtttgggacgtgatgatgttggctgccagtgtcattagcgctgagtgctgagatgttaagatctcgacctcgacgctacagtcatcgagtcattccaagatcaagttagtttaagaatctatttgtaaaataaatttatagaacaatcaaaatataggggaaaaaaccagcatgactgcacggacgatctgcggtccgcgacgcgagcgattaaatgcacggagtttacgtgacaccggccgtggcgggccggaggagtacgtacgcgctgcaacgcgcgtacgatctcccgtgaaccgcggggctcgtacgtacgtactcaccggccgttggagagaggcccccgcggccgcgcgcggcgcccccaccgaccggatcgtctccactcacgtttgtccaccgtaccacgcccgatcacgaacaaacggatggatggatcgatgcatctgcgcgcgcgacgagagcgagagtgaatgagctcatgtgcgcacgcatggctagctgcctgcctgccctgcatctgcgtgacactgttgagagtagtaacaacccggagattcctcgtgactgctgctgcatgtcagcagttttgccgtcgtacgtagcagatgcaggcaaaagctcaaaccgggaccacatgtcagcttcatgaggtcattctcaacccaatgactaggatggtgtacatagcattaaataagttgtcacctaggatgaaaaatgatgtgacaagtgaataaataaggaaagagaaggaaaccatgtcttgcatgagacgtggtttctacacaacatccaatacattatgtgagataaatagcattaaatttaggtatggaatagtggtgtttgcattgggagagtggtgtctagtactaatttcttgatgatgtggagtttatgtaaactatgtttagtgtctggggttgggaatggccttattagtttagctgtaggtaagctctatagctacgtacaacttactactagtctactaccgctgagtacgaacaggaagctagctgccgggcttgagctttgttcctttgtctgaaatatctagcttatctgatatgcagttgggcgtagtatatgtgcggtaaacaccatttgattcgtgggaagaattggcacgaactggaccacggactcacggaattagtactgatcagcgtgcacttagcttgctagccatgtagcacatatgtacatgcaggctgcagcgaaagaatctgatgatgctctgtgtcacaagatcaagacggtgtttgacgtgcaccgtggatcttattattatcaatgcctgaattcaccctagttaattatgtgttccagaattctgatacctacctccatctctcttaactcttgcagagtgtgtctgactgaaagtgatggcctcttgcatgcacgtggtataattcacatatatatcgatataagatgcatatttttttcccaagcgaaaatggggggaaaaagttggaaaaaaagatgtttaattttcagtcacctgaaaatatataaccacaaattccgttcacttttaaatggcttagattgtgcaaagattcgtacaatgcaacaaccttatcttctcccccttgcggcacgcttctccaacccatcgcgagctcatgcaagcgtacgtgtaaggccacctagatatgtctcctcggttctgccactcttctgtaagacgaacgacgatgagctatccttggcatgccttctttatcttctgtggctctcccgttcctagtcactccagatattccacgacccaaccaccaatcaagtgacttaaccctatttgattcatcttagaattattataatctgtattataaggagtaagttcaaacaaacaaatagattattatgatagattatcgtaatctataagccagattagtgtaatctaataatctcctttggaggagcctttttttgattattggttggctaaagacccactatccttagatgcctccaataatccagagaaacaaacagctcacagcttattctatgtcatcttattataatccatcttagagtaatctaaatttaataatttatattacaataatcttaagctgaaacaaacaaggccttaggtggtgccaccgtgccttgccactcgctcgtttcgctgtcaccccttccatccctctaatgtcgagtaaacctccttccccctccatcaacccctaccataaaatcctaacctacaacaccatttgctctcgtgccgtcattgaagcacggatcttgatatatgtgcatcttatgttgagcaaatttgaccagaattttgaagattttaggcgagaagaaatcttgtgatccccccttccaaaaaaaaggaaataatataaaacccaatcgaggtgagcactatcgtttgcccttcagcttagctgtacctaaaatttaaattttaaatcttaattttagagttgattttgatgttttttcatcatagtttattttttaatgttagtttttaagtcgctaaaatacatataaaatttattttctgtccaataagaattatggtttacaatcaattttaggtaaaacaatgtaagcggtaacgatgcgatagagtattatggtttataattagttttaggtgaaatgatatgtaattgctgcttaattactcttctgcctcaactgatatggacggtactttcaagttctccgaacgtgcatatataccatgtttttgctggctttcatatatagatttgcaattgtcatcatcttatctttactattagtgttttttcacaccctgatacttttagactcggatggaatcgaaagtaccaaaattgacactttgaatgtagtatcaagcgataacttctgtgtaaccgtaaatatcaatcactactgggaaaaccattttactggacaatactccctccttcccataaaaaactaacttagtactggatgtaacacatcctaatacaacgaatctggacatacatctgtccatatttgttatactagaatatgccacatctagttctagattcacttttttttgggacggagggagtagcaaataatttttctaggcagatagacctctcggagctaaacgtccgtctacgaaaaatccatcatagtttgaataatcattttctccttttccttaactagcctaagagcttgtgcgttgcaatgaaaaacaaattgagtttctaacattaaatcaattagtccaagtaatacaacaatttttcgtattgaataagtaggtgattttaaaatttagagggaaccaataatgaaatggaggactcgttaaaaggttgtgtaatagtgtagattgtgagatccaaatatcagcaataggggtggtgtgagaatagacacatcactactaacattttaagtagtatagatttgcagttgtcatcatcttatattatacatacaacaatagatagtaagtgctgatatatttttttttcttttgacatatgttcatgcatctctagtctctacatagtttcgccaaaggtaattgaagcttatccattcagaatcttgacgtgtatatttacttctgcatattcttacacatccacactagttaagaattgtgatattgaaatttactcggcagataacaacgacgtttatcggcacgcaacgcatacgtacgtacataattccagcaaacgctagctagctagtagcttagttcaacccagagaattaattaaattactgatgtcgtgatcgtctgaaaaggtgatgttgttggttacttgtcgaaattttcctacatcaattacgttacaatatagcattcacacgtgtcgacccttagtctaattaagcgtacgcttttgattatacgacgcacctaacaagtatcaggcattggcaggaccgagctacgaatgctgcatcgtcaaaacaccagaatccatcaaccgaaaaaggcagatcgatttcagagattaggttgatgatgacttaaacaacatcaaaattatggtcacatcagaacaacagcttgtgatccatggcatcccaaatgtcccggtcaaacgtggcaaaagttgggtcctgcctgttccttcttggacttaaccaaatgcaagtatatatgcttgctgcaatgaccactactacacagtcccagaaaaggcgattgaaacaatcttgattttgcacgcatggaaaggtgaccaactttgtcagtagaagaatctgatggaaagcacatagggcgaagaagatagggttaagcatgtctattatactagtccccattatgatcagccactaactaaacaggattttgtttaaggctacaagggcaagatgacaagtagct

SEQ ID NO: 76042 - DNA, 9498 bp, Oryza sativa
ctgtgtgtttttctgatcattccatggcactcattcagtcactactgatctgttactctgatctgttattcctgtctctgcttgcatggtagtttgaagctagtacttgtactggcttcattccaatcattgtttagggtatatgtcactaaattccatgtgtcctgtgcatgagctagcatagctgtcatgctcggagaaagaggggcttatactgctaatttgtttttcttatccttggagtcttgtagtatttttgtaacaccaaattgggatcagaaatactccattcaactaactaaggtactctgtatgcagcaggctaaacaaatactagtgccttgtactcgcccgttgggcactaatattggtgatactttgccgacaagtacgatacaagtacaatgcattttattccggattcaggtttcagacactagataatagatacataagccgtgatactgacatagtgccatatccaaatctccctgtttaaggtatatttagacttgaaacatacacgcatcggagtttggattaggccgtaatccattccgattatattcgagagcataataatttatttattcataacttcgtttcgctatgaggttagactgtaaatctgtagtaattcatagatttagttcggaccaagcaagatgcctgagccacaagtatttgggctgccacggcccagtttctcctgacatgataagggcctagcagtaaggctcacaccacttgggcatctcaattcggcctggtaactgtgtggccgtgtggaccacacagttaccacgggtggcgatatgggctgcagcgatcggagcaacggcgacttggcgggatcacaaatcacaatcgaaacgtgataaacagcccactggaaccgtggcccggcacgtcgcacgcgtgacgcgtgggggggtgctcgtctcgcctcctccgccgttcgccgcggccgcgccgcgggagggttgggtatcatggccgcgcggtcccacgggccacgagccacggccacggagctggggctcacccggcctctcctgtaccggttttttcccggctgccgcgggcccgcggctacgtcctgtgcctacgaggccacgatacgtgacagcgtaagttctttggtacgtggcaccaaagggcctatttggatggctaccatgtcaatttttctgttagtaccaaaacttaggtaaatttttagcactaccaatttttttggtagggcaagattatatctggtttgctaccaatataaagccaacatatgaattgtagtgaaaattgttctagagtgatccgaaatctagcataggcattaccaataaattggtttcaatccaaaccaagcatgaattatctatttatttgtcgtgtgatttctaacaacaaatcacctagattttttatacccttagaattacatccgacggactacaaagggcctgttcactttgatgccattttcaccttaccaaattttggtaaagttaccaaaaaagtggctacatttagtttgctaccaaattttggtaactatataagaatcatgccaaaattttggcaagttaccaaaattttggtaactttgccatattttggcaatgataaggttttttttgcatcaaagtgaacaggctcaaaagaaaataaaaaaacacatatttaattacacattatttttattaaaattatagtgtacttacatatcatatcaactgaatttacaaatgtaattttagttatataggactgtaattttatattttaaaaaaaataagaaatacatatttacttacataatatttttatcaaaattacagtacacttagagcaggtacaatagcaggctataaactagctataaacatatttttaaagagataaaagaggagagagaagtgcagcgggctataaatttatatccagttgtagcatggactctaatatacaataagtgtatgacatgtgggaccatatattaatagcgtaatatataactattgtatgaattagctattaaattaactataaatgatttagagctggtagttggctatactattaaacttgctcttacatatcatatcaactgaatttacaaatgtaattttagttatataggactgtaattttatatttatatttttattttagtttcaaacatcaaacgatcgagaacatgtgtgaccgttccctgcatttgtcaccctgcgtttgctgtctacagttacacacaggagccacgccccacgaatgtcaaataaacgaaagcacacagggttctcgaggtcaatttagcggttgaaaaatcgacaaatatcaagtgaaaaatttgtcgacagatttacagcaaaaactgaaccaagtataagtactatttaaactaccaatattaatatttgtagggctacgttttggtagcaattcaaaacggccccaaatcaccaaccaggtaattaaccagtaaccaaccaattgactagtattttctccgttctaaaataaatcaattatatgatactataatactatgaatttaaataaaaatctaagttcgtagtattataatatattgatattgttgtattataacaatttattttgagatgaatagagtaagtgcttgcaaatactcccaccgttcaaaaaacgaatctagaactggatatgacatattatattctagtacgataaatctagatatatatatccagattcatattcctagaatacgtgagatccggtaactagattattttttttggactcaggagtactcaaccactggtccacgcctctctgcttaatcatcaactgtacttctcatagctagcgcgacgagctaggacgtactagtgcacaggggctatactacattagtaccagcatctacgagggtcgtcgacgcactgcttcctccgttgattcaccagtgctacgtgaactatatacgacgtagagaggcgttgtcaccagtgctttcgattgtgattcatttagagcaggtacagtagaatgatttagcatgctccaaaaagttacacatcatcgtattcctacgtggaggaaagagaaaccagaaaaaggaaggaaacgggcaactaatctagcgccgacgatagcacggctccatatgcgcatgcaactagtactagcaattaaaaatacattttttgggccccacaccaccccatccgatcacatgtggtttgctctccttctccttccgcccaattagtatttcccatctccgagcagtgcagctgtgcaacacaggttcagatcaagcacgcggaatcgctctcctcttcctcctccatatcttctccaacgcagcgacgcttcttcctagcatcgtcgtcggtgccaccgttcgccgcggcgtgcagatgaaggccatctgaaagcgtcggcactcccttccgttcattaaaagactgatcccagtttccagcctttgggcgacaccgctgtgtgctagatctgcgccggtcgcttgatcgacgcctaccgcatgaagctggcgttgtctccacgctaaatcttgctgtcttgcgggtgatttcgttgattaaaacaaacaatcggctagggagtggttcagtagttctgatgtactctgtaccggtggatttggctttttttttcttggttttttctctatttctgcctgatctcagatgtatgcgtatcttgtttacaaaaggcggattttgtttccatgtatttttttcgccgctgagtgtattttttttacctcgctccatctgattttcgatagcttccattcaattatattcatgtagacataagaactcatatctcaaaacatgaatggccacaaatatgaagttcacttttgatcatacacagtaagtactcataaagtatgtgtatgtataattaaatatttctttcatgagatgtagtaagtacaatagctagtctattgtattagttgtttgtaatattagctataaaatgacatggagataatggagccagcagcagactatactattaaccttgctcttactccagtatatactcgctggcgttgtcagaataaagaacaccggaacgagttgcatgtgtatcatgtgcccagccgtccaagaacgattcggctcttcaaattggccactatcaagccagcacgctctcgaagggacagcataaatgaatcgatctagcgaaatctaaagttgaattcttttcccagttcaagcaagcgcaagagcgaacaaacggaagtggctctcgtcggtgatccacgcgcgttaagggtggggagaggaagagagtacacgcgcgaatgaagaatcaacaccgtaccagcggggattccgatgcgattgacgatttttgttgatatatgttcccatacatgttttctccgtgggaatcaatgtttatatcctattcgatactcccatttcttttacttcgcgggacaagaacccaaggccgtaatagttgtaactttgtttagtgggttttctttgctagaaattctagtcataaatcggtatattttaatccaatagcataacataataaacatgatatatacaataaagaatggtttttccacggtgataaacataaatatgctagcaagaacagtagcaactaaaaatatgtttaacactgaaataagaaaaacataacagagaaagctccggatatagaagaggaattgttggtgttgttatccccgctccgttgtcgtcgctccgtcctcctccgttggcgccgttctcggtagtggttgacttgattcgagttgttggtgcagaggaagaagattgtgacgtacgtgctcccaaaaggtgcattagcttgactcacagaagtagaggtcgtagtagtaatatctttttgctccggttaggtcatacacaatgcacctacatggtgaaactgtagaagcctttagctcaccccataagagccgcgctgctagagcgagtgggttcatcaggctccccgtgtcttctacaagacatggtggtctcaggtaggaaatgttgaatatataagcacatatagatttaatttattatataaataaatcatgacattgaacatgtatactagcagatccacatcatacgatctagacatgtaaactatatagtaaaccatgagcaggtcaaatagatgaaacatcatgaacacgtaccaagggttctggttatactgtagatcaagttgatgaggagcaacgcgcgctgcaggaacaacgtgcagtgccgaatgttatcgttggtgcacagccctcgagcatagaggaagacgagctgtcgtagaagaccagcaagcagttgcgcaaggcactttccaaaaaccttattgccgccttctcccgatataggacgtcgaaggcgaaggttccggagatctgctctcccgattgctagtgcacgcaggcaaatgggatggagtagactacaagcgacggcgcagtacagaggaggagtcaaactctagattgatttcccgtatattgcgggagtcggcggctcggtttatatagagatatcgggatacgtgatcaggacgcctacatgatcttcacaccacataaccaaactggataagtcacgcgtaacttaatcgaattccacatcgttccacacatgcattggattattcggtttattttcaaaaacaaaactgaattttgtagcaaaacaaaactgcaaaaggaaattgcatttgcacaagggtgaggaaccaatgttggcaggccattcatgcagatgtcgcgtacgcaagccatctagccgggcgaggtgagcgagcatgtgcgtgtgttccacttgttctctctatcacatatgtccatgcatgctatctcatgaggtggacttttatgattttttaaaaaattaatctttaaaggcaaattttgctacaggacatcgcaattgtgtggttttaacccagggacaccgcaaaaacaaaggtttgggcaaaaacaaagctttgccgatggacaccgtgccgtctaaatgaaacttgccgtgctgacatggcaagcggagcccttttttgacgtggtcggaccgaaatgcccctgcgccttatctccgccaccgctgctggcacgagcggcgtgaggtcctcccggtcaaccgagacgtcggcggtgaaggagagcttcttcttcttcttgccgttgctgctgctccactgcacgcgggtggataggcggaggcggaggatgctgccggctcggtgcgttcttggggaggtggaaggggatagtgatgggtgggtggcatggtggttgcagtggtcgcagctccactggtagtcgccaagcttgatgcggaacgcgacctgcgtgtcgttcttctcctcgaggaggatcaagtaccgcgtcgagaggaccggccgtttgccggcggcgcggcgccaaccgcagaggcacaacggcgagcgggtcggcttcttggcggacacgacaccgatgatcaccaccacggggaaccgcgtctgctcatgctcggacgcttggaacgccgtgccgcgcaggaggtcggtgtcgacggcgtcggcgtcgcagcgatacacggcgtggatcctatcgacgcactggtggtcggggacgaggcgggcgcggctgtcgctaagcgcgaacgagcaacggcactcatcagccttggtgtccacagacgacgccggggacggtctcccacatcatcgcgccaccgccactgcccccgccaccaccactacccccatggcgaggagccagtgacaccgtcccgccgagggacgggtcccagcggaggaggaagtgggggccgacgaggaagtcgtgggtgctgtgggcgagaggcgagaaggagagcggcggcgcggcatcccggtgccggagggaggacgacggcacggctatcgaggaatgggttgttgaggcggacgtggtcctccttggtagtctgagttaacgagagaaaagaggctaggggtaggggaggaaataggaataaatatgtgggctacgtgggctgggacatcctgttgtgggctggagtgtctccacccggttacttcggattttgaagagcccagctacgagtatcccccattggaaaatgggtgtctcatgaaggcggtgtttagttccacatcaaaattgaaagtttgactaaaattgaaagtttgaaaaaaaatgaaagtttatgtgtgtaggaaagttttgatatgatggaaaagtttaagggtgtgtttagttgactctaaaattaaaaatttggttgaaattggaacgatgtgatggaaaagttgaaaatttatgtgtgtagaaaatttttgatgtgatagaaaaattaaaagtttaaagaaaaattttgcaactaaacacggcctaaagtttaaagaaaaagtttaaaactaaaagggtgaagtgttttcagttagtgagagcactaatgtagctagtgactctcatggtacatgccctaaccaaacaaccacggagtattgtcttcagcacacatgctgacatgcattgtgacttttgtgacgcggatactactcatctcgccctgcacgagccgtgccgccgtgggatggtgtaccacggacgttcgtacggatgccgcatgcctcgctaccgctgcccgcccggcccagcgtcgtacgtgcagacgtacatgagcctgcggaccaacgcggccgtgctcccgagacacgaggccgcgaccaccggcacggcagaaaaggccgcgccgcgcagcggggggcggccgtccgcgggtcgcgtcaagtcgtcgcctcgcccaggcgcccacgcacgcgtgcgcccaccccgaaacgcggcgccgcggaactatcgccctgcgcaaagctgaaccgccgtatccaatccaaccccacccccacaccccacttgccacctcccacgcttcgtccccccctcttttttcttctaccccacctagagtttcaatactacccacttggattagttattatacgcaatatggagtactatatatagctgttctgttgtctttaaccatggcgatgaagcagctggccaacactaagagcaaggctaatactactaactttaattcatctaagtcaatctaataactaattcatacaatagttacttagagctggtacaatagcatgctataagctatctataaatatattttaaagagataaaggaagagagagaagagcagctggctatagatctgtaaccagctacagcacggactctaagacgtgatgtgtgtatgataggactctaagacgtgatgtgtgtatgataggtgggaccagatattaatagtacagtaagtagctattgtatgaattggctattatgttggttatagatgatttggagctagtagtggactatagtgttaaacctgctcttattatactattaatatatggtctcatctgttatacacacactacgtcttggagtccgtgctgcagctagctacagatctatagtccgctgttcttctctctcatcttttatctcattaaaatacgtttacaactggctaataacttgctattgtacctgctctaatcatgtactatacgctatacgctttcgataattaagttgaggataagatcgatcacgacgcgaggttaatctgttcgcttttattcgacgttttgatgctaacaaagtagggggagaaaaaaacataaggtactgtaaagagtcaagtagaagcagtgcacgcgcaccgtcgacttttacacggccaaaaaatggctaagggatacctcgccggcgagaggctaccaaagagttcgccgggatgcagcaaagaaagcatatgagaattgagcaggttaattagctagctagcctagacaaaaagattcagcagctcgggctccctctcgccgtcgccgacgacgccgcacgtcgtgacggatccctcggagttcatcgacggcgtgtcggcccgcctgccgccggatcgccggtccccgggcgccggcggggagccggggctgagccacaggccgaggtcgcacgacggttccggctggggcgccgcggcggcggcgtcatgcggagtaccggggttcttggtcgtcgtcgtcgtcgtcgaccgcttcgccgtcgagaacgtggagcacccgcccatggcgcgcctcgccgtggaggcgaacacgtcgcggccaccggcggcggcggcgtcgacctggtccggcagcggttggatgcctccgccgcgcagcacggtgtcgaccgccgcctggcagaggtgccagctcccgccggagagcagcccgaccgcgccgcccaccgggttgatcgtcctccccgccgcctcgtacagcagcgactggaacaccgtgcaaccaaccacgccatcccatcagccaagaacacgcgcgcgcactcaccggtaaaccatccatcgtagtacggatccccacccttacctgctcgctgcggctcgggga

SEQ ID NO: 76043 - DNA, 2046 bp, Oryza sativa
acacgcacccctggttgcaccccttccgcagcacgcggcagccgttgcagctcatcccagacgtcgcacacccacgcagcctcgacctcgagctcagccatgggagactcaccacactcgagtatataacacgacgaggtaacctaaccaagggggttgggttaaccgcgggttaacggaggtgaggttaccgcggcctcgtgggcggaacaagttccagcctcccgggctcctgggttgcggggggtgcggctccgcgtctccgcggccggtcggggagcgcgcgggccgtcggatcgggatcgggcggcgcggggtgcggacgcgagcctcgggtggtgcgcctcgcgttcgccccgtccgtcctgctggcttcttggggctgggcgatcgagtgtttttcgccgctgctttttggggggtttgcgggatgcgtggatccgcacattgggacgcgctgcgcgtggaatggatggatggatggagggaaccttgtgtgggggccactttgctgcggttgcgggtggctgcggctgggtagtcggtgcggtgcggagcgatggatggacggggcgcggaaattcaccgtgccaccgtatcagcttgctggtatgtgtaacgtacgtaagcatctcggctttcgtgtttacaagtctactacgcgaggtaaggtttgtaaatgaagagcttacccgacatgcaatctgcggtcaatactcatttcacaggaaacccacgtagtcttcttattactccctccgggttgataatattaggcgttttggaaaacctggtcttcaaaaagtaactttgacaactaatttctattataaaatatatagaaatttcaacaaatatatgattttattgaagtactttctaagactaatctacacattggttttcatatttttaagataaatattttagaaattattcgtagtcaaagattttaaagtttgactttacccttgttcaaaacgactaatattatcagcctggagggagtatattatttggaaattgctaaatttcaatcacctaaaatcttagggctggtttggttcgaggtctaaattaggcttaccaatatttggcaatttcaatagtgtttagtgtatatttggtttgacgccaaattttggcatgcctaagaaaataggccatttgaatagtgaacttagacaattttggcttcaatccaagcacaactttgccttaccaaaattagtcataccaaaacttgataaaatttggtaaaatctatatttagactacaaaccaaaccaacccttaatctatctatttgtctgtctatctgtctatctatctatttatctatctatctatatagacttttatactagcttgaaaagaagcccccatgctatcttcgtggtttagaaaaattaccacaataattttaaaataaaatctaagctgttagatcgtgttaggaccaaattataacaatgtatgttaatagcaatagttgtatacaaaggcaatagaaactgaagaagatagttgtacattaaattctaattctactattaacatctacgtttataaagtatagcatatataaaaacatgagctaattgtccaatttaactaggacacataagattgcatcgggaaatttccctagtttgcagttaaatttgtttattgtataattcatgctaagtttcgtgacgataatagagtcttctctgtctctggctacggtaacgacaacgactgtgatgctagatttagagtttagatatgagagttaggggaggcgttggagaaggggaaaaaagagggtttcactggacttggagaaatgaccgtggatgacttgcaagaaagacatgcggcatgagggcatctcgtagtcgattggacgtacagaggagaggaagagaaaggggaggaaggaggctggctttctggggctccgcccgtgctagggaagcggcaaactcaccgccctggaaagaattagagatgtgataagctatatatcaaaattctctttggctgtactggtagccacaa

SEQ ID NO: 76044 - DNA, 11222 bp, Oryza sativa
atagctacaacggatgattaggaccacacctcaaaaaacatatacaagagatttgcggctaccaatacagccaaatagtacaacttcacaattttaattttgatatatagattatcacatctctaattcttcccacggttgtgggtttgtcgcttcccatcctagaatttgcagctacaaacctacaacggatgattagtactacaccttgaaaaaaatgtgtacaagagatttgtgattaccggtacagttaaaaagtacaaactcacaatttaaattttgataaataacttatcacacctctaattcttttcaccaaggcgggcttgtcgcttttggccccttttgggggaataagaaaaaaaaattttccctgaagcacacagtacagctgccattaattttgacaattcgaccatttacaaaaactaattttacaaataaaccgtcatcaaaacttatttcaaaatgaccattttgttcagcattaaatcatatggacgctgaatttagacacctcggcgccaaacagcgtgacgctgaatgtacgttggcacgctgattcagcctaccatctacggtgacggcgatttatttataaaattagtttttataaaggatcaaattgtcaaaattagtggtacagctgcagcctcagcgcaagtggccaaaggcatcttggctttctgtttccgccgcactctctcaaaaggctccaacgcgccccggtgcttcccctcgtctcggcgtcctggcaggtcgccatccaggggacgcgaggaatcacaatcttcttctccctctcatcctcctctggtagtccggtggccctggcgtttagcgactcctaaaaaaatctgatacgagagtactggggaaaccgatcttctgtgacgtttctagacgactagaccgggtttgcgggcttggcttcatggttgacatgctgcgagctaattgggtgttcgatgctgtcgaagtttgattggcaggtgatcagattcggctttggatttggagtgcggcatgccgttttcatcctcaaaatcactttagggcctgattgggaaacaggacttattcacatcggatgtttgacactaatttagagtattaaacatacattaattataaaactcattccataaccttggactaattcgcgagacaagtcttttgagtctaattacgccatgatttgacaatgtgatgctatagtaaactttttataattatggattaattaggtttaaaaaattcgtctcgcagattagctctcatttataaaattagtttttttattagtctatatttaatactccaaattaacgtccaaacatttgatgtgacatggactaaaaagtagttttagccccatctaaacacccactaagccacctcttgtcatgctttctccttcttggaagcataacacaggtacttggggtaaggctggatctctgctcgtggacctgtggtaacaattttattggaaaaagtatacccaaggtccctcaacttgtcattggtttatcgtatacgaggtcatccgaggtccctaggtggttttgaccccggttttgatctacgtggcggctgagtcagcgtgggacccacatgggccccacctgtcagctggccacgtcatcactctctcccctcctctcctcctctctcactcttctcctgtttgggtaggcagctggggaggacgtcggtgggttgctgccttcggtggggagaggagggagaggacgagggcgtcggcggccggcgacgggcgacacgacgacggcggctggcgactggcgacgcgccgccgccattgctctcgtccgccattgcagaagccacaggcacggaggcggaccgccatcgagggatgaggtaggcaagcaaggggggcggggaggccggcgtcgacctcctcaccggccgtgacgtcgccatcaagtccttccccaaccggcgacgtggcggccagcgaggggagcaaggcatcggcgggggagcaaggcgtcggcggcggtgaggcggttcttggccgcggccagcttgacccggagtttgaggttagaaatcaacacgaagaatcaatcaagaagcattcagattagcacattccaattggcaacctataaacgaaagagtgctcctaataatcaagcaaaaaatgagagaggttcaacctctgaggttaattagaaatcaacatgaagaaagaagcattcggattagcacattccaatttgcaacctaaatgaaacagtactaataatcaagcaaaaaaaaaggaagtgagaaaccaaatgggatggatggatggagtactgactcggtctggcggatcttgtcgaagaaatgggcgtcgtagacaccggcggcgtcggcgaagtggacgacgccggggaagtagtgcttctcgacgtgggcgagcgcggcgttgcgccgccgccgctcccggccgcccgaccgcgtcgtcgtcaccactatcagcatccacctcgacccgctgccctcctcctcctcgtcgcccacgtccaccaccgcgccgttcccgaccccggccgccttcgccgccgccgcatccggcacaaggctcacctgctggttcacggcgacgtgggacgcggcaagctggtggtgcggctggaataggagaagaacaagtagtgcgaagaagaacagcgggcagcgtgacgcggcgacgaggacgacggcgcccaagcccgctcgccccgcgggcgccgcgaagaacttcatggtgccgacgatctccgcggcggcggcaagccaggcgcatcgtcgggaggcacgaatcctacggggacgacggcttcccaatcttcaccgagaccaagtgcacatcggcgccgcgtcgtcgccgccgccgccgccttgctcccctgctctcgcgtcgtcgccgtcgccgccgccgccggccgccggacctcctctcccgtctcgccccgtcggtctcctccccacccgtcggccggcggcgccggcctacccacagcaccagagagaagagtgagaaagagaagaggaagggagaggaggggaaagagagaggaactgacgtggacaggctgacatgtggggcttacgtgggtcccacgctgactcagcgccacgtagaccaaaaccgggtcaaaaccaccgaaggacctcgggtgactggttttgtatagttaagggactccgcatatctggttttgcggttcgaggacgttttttatcccgataacaagttgagggaccttcagtgtagggtttagggttgtgcgcaccggatcgtcgagagactgcacaggcccaccaaacatgggctgtgtttagatccaaagtttggatccaaacttcagtcattttctatcacatcaacctgtcatacacatacaacttttcagtcacatcatctccaatttcaaccaaaatccaaactttgcgctgaactaaacacaaccatgaaaactatcgctaatattgatggtaaacgagggtggttttatagttctagcaccgtgcgataaagtttggttcacgctaaaattaaaattttggttaaaattggaacgatgtgatggaaaagttagaagaggcaagcacccactcaactagatgctaaacatttcattaggtcgttctgaggtggaatcgaaccactctgttgcgattattaaggcagggtgctactgtaccagtagtagagtggtcaagtttgtatgtgtagaaaaattttgatgtgatgaaaaagttaaaagtttgaagaaaaaatttataactaaacttggccttactttattattactaatccaactaggattgtactgatatggatcggcttataacctgctaactacgagtaagttttattatacctgttcttaccaaagtcttgtgcactgtagcatgataatacttgcacgtagtaatatttggggcttttaactatagatttggcaaataactatttgccacccctatcttaatgacatatgggtccatatgtgtctatgacatatgagtctagtggtaaaaagttaattgccacatcaaaatttgataaatggttaaatatctcagtaatatttggtcgacgtgcaagtggaattgtttcggaacaggatcgatcatgcaggcaggatcagcgagaatctgtagaatctggcagccgtggcatggtgctccgtgcacgcaggcttagcctcgctagccgccctgcagccgtcggcgagtttctctgctccctgctgtgctgtctgcgagcgctgcgcccgaggccgccccgacaccgctgagtcgctgacacctcgcgacaagcctggaccaaagcaccggctgcacgagccgaacgtatccagggctttggctcgtactcgtactacgcccagtgcatcatttaactcgtcacagctttgacaggaatgttaaaaaaaaaaagctttgacagggagcaggcaacaggagtatgtgaatgttcatcgatctgcagaattcatctaacctggacaaagctcacctgttacagctagtacctcttcttgctacagtagcaatttcctgatgaactttgcagttgttgagtttgagaataacacagtactctacagaatggtttggcaagatcaatgaaaaacacagtactctacagaatggttctgaattctagtccaagtgcatccaattgcacaccctactacaccctacaggtcaactggaaactttgagctgttctaaagatttcttgtctcagaatctggacgaaccaacaagtctacaatagcgtgcacttttgtgcactcccaagagggacaaaaattcagtagctatagcagctactagtagtagagagttgctggaacaatacactggacggagggggcgcccagcagcagctgctggctctcagtaatatattgagagggtgcggtgatgtgacaacgccatgttctgaacgccacatgaccagagccatagatcgatgtcaatgctcagaagctgccaagaacaccaagagcaagagcaacgttagttcctatagttaaataaaatagccgcattgactgctttatagtatgcctcaaacttagagttacatggataaggtgagaaaactcctactagatgaatgtcttgaccgtaaactaaagcagaatggtcaattttgctctttttcaatacttaagagtaaatataatataaccttttctgattgctcatcaatgtagcggagcgtgcagtgactaggggtgtgtttgttgctggccacactttaccacaactaacgttaggcaaattgtgatagccacaaaagtgtggtggacaaattgttagtctctgacatgtggggcatatgctattgaaaaagtgtggcaaaccacaactgtggcagtaaaccaaacacatgcctaacaaactgcggcagacaaaaaatgtggtgtggcaaagtgtggccatgaaccaaacaccccctctttgtatctaccaagaaatggtatgaaagtattaggtgatagtgattcagatgtgcctacctgctttccaaacttcttgttgatgagctctctcattttttccacggcatatacagaacaagcacgaatctccacttcctcttcacttccaggcacaatctcactgctcgaatcaattgagcaagataagttggagccatatttcagtatgccaagctccctcaagacagcaggaacaatatagtctgcaaatatggtgatggacttgatgtcgtggaactcgccatagttttgtcccttaaaagcaccccacagatcagcaacaaatatctgagctctcttatacaagaaaacctggtgtcctttgtaaagtgaatgatcccgaaaacctgccaaaattatatcttagaacaatttatatcgctgtacagatgtgcttactgcccattgaaaatagcaaaatgaaacaacgcagtatgaacaggtgaaaagaatggtggaaatgtaaacatgctaagctggactgcctctagcaaagaattccctattaggctaaggtgagaggtggaacttggaagctggaagcagacaatttaatgcattagtccttattttcaaatagacattaaaaaggaaataatcataatcatgataaaccggccaggtaatataaacataaatcttcaattctactcaagcttctgcaccaagcgaaatgaaccaagaatcaaggaatcaatgagcaaattactcaaataagttctaaccacttgctggaacaatttcattttaaagattccaatcatcaggcattcaagtaaactaataaaaaaagaatgtcaagaacaaaatggctgtagtcagaacaaagatttgcttgacgagggacttttctaaaagggaaatcaaaatgacttttaaaacaatcaattggacatggcatcagatgacatgtttgaaacacagcctatgcaggggtgcatggcccacacaagattaagctacatgcctggaatgctgcaagtgcaacctgaccacaccaactcattactgtgtcctcccagatccacagtagcgggccaaatctggatgcacaaccagtggttgtacggccatttctctagtcctgtttcactaccatacatctcattggcccattggacaaatggcccatctacagaacaatgctataatcctctcagtaaatacagctcccctcgtcagggatatggtgtcttcaggggcatctaaaagcctacaagaagttctcaaaaaccaagcttgcaacagtttagatcagacagatcaactggggtcagatagtatcttcaatttttgttttctctctctgtaatatagctggacaaatcctggttgggactcttggactagttaaaactagtgctaccaagtagaggataagtgtaacggaagatttaccaggaaaatgacgggtaataagttcgattagagtagcagcagagtttccagcagacttcactagatttgcagcttcacctccaaagcttctttcaagttccataccaacctaaatgcatccaccagaataagagataatttacaaataagagattcttggatgtagccatgtagcctatgcaattgcttggcaacaaacctatggcaaaaataataactattataggagcataattagatcctatcaacaatctcaagatgattccagaaacaactagatgactaaattcatcataatagagatggtgagtgtctttatgcttttaggtgatgacactgacaaatttcaaaatgcatgaagcagaatacagggttctagagatcaacttttcaatgaaccaattaagtgcgacagaacagtacctcatgaagaagccgtactctttcctcctcaattggcagtgggcgtggccagttcagcagttggcggagctgaggccctacattttaaaaacgttttttttagtttaagagatacttacagagtattcaaaatgcatctcagctaataaaaaaagaatacctcccactgtcccaaaatataagcacttctagagtctttcagtgagattaaggagaggtgaaactaaatgatatattgttgtgattagttgagatgaggaagtaggtggagaagttgctatattttgagatagagggcataacttttttatgatagaaggatgtagagcgtgaataaggggcctgagaagatctaaagttgcaccatatgcaggctatcataatgtataactattgattccatgtcaccacaactggtacaataatcccatatttcagtatactgatgtcaataaaaaccataaaatatacttgttatataatgcaagatgtccgtatagaagaaaagttaccagtgtaactctggagacgatctgcatcaagggctgtcttatctttctctaaggctaactttagtccagaagccaaatggtcatagctcagatccttatctgtttcagttacaaacattatgatattactgatcatggttctacaagaaacaaacatagaaatgaaaaaggctatactgcagcttaatagtaagaacatcaatttcaggtcactggaagctagtagtagcctagtacacctataattcatggagattacagaaccactagtacacaatctggaaaggctatagttgatacaggagtaaaagaattgaaatcagataattacagtggttgatacttgatacctgttggtcctattttgtatatccttaggtacgagtacgactaacttttacatgttcgaaacgatgcagcattgctagaacttatacctggccagaagcagaagttcagagcatccaggacgaagaggtactggacagtgagggggccatcgtcaaaatagtgaattccttcgaagtcccattcaacttttggaacatttccttggattttgtccaccaccttctcgacctctgtaagggaaaaattaataaaaatacatgaggattgtacatgcgctttcctttgcaaaacaaaggaaacattagcgtcaatttgtaggcactaatcaaaagcatttgcttcccacaaaatctcaagttcttctctcaaaagaaatacttggaaactatttgaaacaacaaacacccagaaaaggataaatagccaacaaggaatttcaggcacagaactctgaatcaatcagagatcgttgcaaggctaactaaactactagagtcaactactcattatctaaaataaatctagaacaactatggcatgcattccagaccagaaatcatactgctacatagacagacaacatcgagcaatcccctattttctttacaaaaataaaacgttgggggtaatcctaaaccctatcacctgagaaacatccggaagccgcgagcaaaaagagagagagagagagagagagagcatacctaacatgtcgaccttgacgtgggaggagcggctggccacccacgccgccgacgcgcgcacggcctccatggcgagacggagacggcgaggcgattcggataaggcaatgaggggagcgcggggttgggggaggcggctggagggcgggggacggggggcgcgtggttttagcggtttccggtggtggtggggttttggggtggtttggttggggtatggctcctgtggtcgctgtcggctcgggctctcgtttccaagggcctcggagaaattgccgttcgcgcggcccagcgactggctgtggtggtgcgccgtgcggtcggtcggtcggtcggtcggtctatctggtttgacccaacggccgccccagcgaaatgaccgaactgccccccaatttaaggggtacgatggagaaggtggtgaggtgacaggtccctggcccaactgagcccatgacccatttagagcatgcccaacatgggattataagtttaagattcatcgtagaacttgttttttaaagtccatttaaagataggaacgggcatcggttgtagcaacaagctcaaattagagtgataatctggacccactcgtcaaacactcaatgaccataagcttataagctttgattctcttttgctttattatttaactagaaaaaatacctgtgtgttgcaacggaataaaaataaattatattaaacaacaaatttgcaaggttccaatttcttcatgatttaaacaaagcatatcctttgcgtggaattaccaattaacctgttcaaaatagtctaaatcggctatgatattagcacgacacctacgtggtatcttcagtaagctgacacataatacagtcgcaaattaaagtctgcatcaaatactacaaaacatgatacatcaaagaaattatagttagttcactttaattctaacatacgccatacattaactcctcgacccaattccatgtgatgtcaaaccaatcgatcaaatataattattttagcgaatgcataagaataaaagaagatgtcatgctgagcttaacgggttctctcttccagttcacatgtgtcgaaccctccatcaccataagagcccagaaaactgaaagcacatgcaaacaaatataactgcatatggatttggacactattcattgaagtaagattctataatcatttgacttgaaaactaattcttattaaaatttaccactgtttcgccaaataaaatttggagtaagccttttactgttgagcgtgcatggctcacgtgcacgatatgggctcgaacttgtgcgcaggcgaccacaggaccgatctagacgcgtatgttctgcgcaaacgtgtttctctcctactccaacatggatgcacacacccattcgatcatcgtgttctctcctattcctgcacggacaacgaacgaagcggagagccggagagtacgaggatgtgggatgacgcgcgatgatacaataatgggtgacacacgaaattttttccggaatacttgcatatttttaagtaggtaggtatagaattaaattaatttacaagtaaaataagtgtgggtaaaataatatgactggatttaatttttattaaattacttatgattaattacactatttagaattttctaggatttttcagagctcaaatgctaattttaataatacaaatataattatagtaattaatttaaattaaaaataaactaaaaacatctcctaagtcagggtcaaatattgcccattcttccttcctcctcccccaagccggcccacttcctctcctctatcttcttctccctcctaggccggcatccttttctcatgctcggcctagcccaagccactcccatctcccctactgatgcatgggacccagtgccacagtgtcatcttcaacctccagaccaaaatcccgacgttgtacatcgatacgggagtcgcatccagttctgaatccggcctcgtcgctgcttcccttaccaaattggatgcgaaaacggaatcccctaatcctcctcttactttccccattgaaatccccaaatattctaaaggaaatcacgtgaattttggcaatgtttctaatccagagaactcggtaaaaccctagcctcaataggaaagactcggacaaacaacgggcttgattaggattcgagtcgacagacgaaaaatccaccgaaagccttatgtattttgtaagtaggtatagatatagatgcgtccacttataggatggacagggattctatacaatgctaaacttttcatccaattgctcttaca

SEQ ID NO: 76045 - DNA, 569 bp, Oryza sativa
cagactgttggccttcagagcagtgtccactaatctggccataactctttagtgggaaattcaaatgacgaacggtttgttgggtgtgaaactagactcaataagctttctataatatgctcattcaccttcataacttttgagaataaaaagttatgagtgtttatttcactggcccgttttgcactggactggtccgttctgagctgatcttgcttttgcactggtccgatcttgctgctccattttatcctccttggtgaacttatccatggtgtagtggtggcaatccgagtcaagtctctatctttaagcacaacgatatgctttaacctacaatcatacaagccaagtagcagccttgctcgatgaaaacaataagatttgtagttaagcatagcgttaaccttgcattgatgtgcaacaatcacattacatgtgaatggccttggccaggccgtatcacttcttagacatataaaagtaaatttaataaagcctaaaagtaatttatatatattatagaagtaacttataacaaaaagaaagtaactttaatgcatgctttt

SEQ ID NO: 76046 - DNA, 721 bp, Oryza sativa
agctatggaattcactataccgggtatccaaaagtactagaagggtatagtgactcaaactggatatctgatgctgatgagataaaagccacaagtggatatgtgttcacacttggaggtggcgctgtttcctagaagtcttgcaagcagaccattttaacgaggtcaacagtggaagcagaacttacagcactagatactgcgacagttgaggccgagtggcttcgtgaactcctgatggatttgccggtggttgaaaaaccagtgccagctatcctaatgaactgtgataatcaaacagtgattattaaagtgaacagttcaaaggacaacataagtcatctaggcatatcaagagaagactgaaatctgtcagaaagcagaaaaactccggagtgatagcattggactatgtccaaacggctagaaatctggcagatcagtttatcaaggggctaccacgtaatgtgatagacagtgcatcgagggaaatgggcttgatacccacctaaggttgcacaatagtggaaacctgtccattgtgatcggagatcccatgaatttggatggcaaaacaaactattgtgtgactgagagaagagacccttgaaaagggcttattttcatgatgtacttcttttctttcctacatggtaggatgactcatgccttaatgtgatccgagtggcttttccaaacagagattttgacctgcagaaca

SEQ ID NO: 76047 - DNA, 4606 bp, Oryza sativa
taattcctgcagcccttcagttgtggtctgatgtagctcatttcctaggtggaagttcaacttaacagtctccaccaaaaccctggtatatcaaataggcacaaccttgagaacatttcttatgagccttgaaatttggtggggattgttagaataattgggctaggcccaatttatcctattaaatctcaaaggcccataataagtgttaaggataataataccacctcaggatttaagcgaggaatatcttaacctaaatagggagttattggaggccccctgttgactggttgaggtgggggtcggaaagccacacgcgcgcgcgcgccgggccgaggccgagggctaggcgtggcgtggcgctacacttttgcaaccatgaacccacgttcccacaactgcctccgcaacggcacgtccacgatcccacgttcccacgactgccgactgcctctctcctgatagataaggaggccgcgagtccgatcagaacgattcgcttgcttctttcccgggtgttagttcctcctcctccgtgcctgtgctgctctcgcttcctcgcttctaatcgcttgcacgcacgagagatcggaaggagcagggcctccggaatcacaccttcgcctgagatctgcaccgggtaggcgggtgatcaggtttttggggagtgcttcccgcacgactgctcgtcctcgcccaccatgtctgcgcctagagccggcgccgctgctgctggaggagatggcggaggtggtgcgccaggagctggagcctgtgccgcgaacaacaacaccaacggaggcaattctgcctcacaatccagtggagggccattctcggggtatatccttctcctgttcctgttcccgttgttagtgctttactgctatgttcctgttcctgatattcatgatgcctctagcatgctactgcgttactgctatgttcttgttcctgatattcataatgcgcatgatgcctttagtatgctactggttatgttacatgttgtcactagatcaccctacactgtttatgccatgattattgtcttaacattttggattaaaatatgccgatttatgaccatatttccaacagccattggggatgatgtgtctggcctcaaaggcgacagatctagcttccaacaaacggagcagcaaggggtttaggccctattggcaatgactacatggggatcttctcggggtgacaataccggtgacgaccatgcatgttgggaagagcccctttggggcatggtagactagcctgtggttgcagtgtagatcgggtgaagaggagcttggcggtccatcttgggttgtgacaagggcctcatggtatgcccctcccagtcgcctacccctactctgttgccgcctctgtcctctttgaccaaatcaccaaacaaatcacatgagggaaatataactaataaatcgtttcaggggaataccacctacaaatcgtgcgaagagaatgtcaccaacaaatcatgcaaagggaggaggatcatggcctctcccacaacacggtcgcgaccatgccttcgacgatgagtagcctcagtcccgccgagacacctgtgccctctgtagggcacttggatcttggctagggcactcacttgaccgacatagcgtgaaatcatcaccaacatggagagtcaagggcactctgcacgtctccatgttgtgtatagccttagtcaccaggaacaataatttgaataaagcactggtggagaaaccatctttggtcggtcggccgaaatccacaatagtcccgattccactaaaaaccgggactaaagatgatctttagtcccagttctagacctgtcagaccttgtcaggcccccgggatctttactcccggttggtgttaccaaccgggactaaagatcctaactttactcccggttggtgttatcaaccgggactaaagatcttgaagatttttagtcccggactaaaattcaacgcttaatatataatccttcttccctatcctctccttcacaaccgcctcgcacttatcctctcagatctcaatcaccctctcctccctctcagatcgatctccctctcctcctccgcctccgccttctccccttcctcctcccatccccggccctctcctccccgtactcccttcccatcggctcagatcgatctccctctcctcctcccctcctcctctcagatcgatctctctcctcctccccctccgcctcctccccttccccacccatcccctgccctctcctccccctcctcccttcccacgcagcaggcggccggctgggccgcgcacgggcccagtggcgagcggcggcaggcggcagccgctgccggcatctttttttttttttcaatttgtgattcactaagatgtataattttatgatttgttgcatgacctgtcacgaccggaattaacccaacgggcgtttcttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcagaagactagggcgacgaccataggcgcttgacggcaggcacgagccagacaccaaagccttcatcttccaggggctcctcttctgggtttgggaaaaattgagcaagactgagtacaaccaccgtactcaacaagacacacccacaagtgcagaataaatgcaagggagtacaagggggttataatataaagggttagggtttgcagtaaacagcattaaaagacacttaattgctcaaagctattttgtaaacacgattctagagctatacaatattattaatcaaggccgtgaacccacacgaacctgccttaacccaaggcctacgatgattcagaccgaactagcaacccgaccctgggtcccagctcgtcccaagctaacccaggccaaccattccacattttagttgttaagcatgttttaagaattaaaacactaacttgggtacattgctcggcttgcccataaccgagggcgcggctattcgaatagattatactctgatcagaggtgtacatctttacccacaagacacctcttcctcacgtgtaaccacgtgccacataccaccacggtatatggacggaagacgtgacatagcttccaacccatcctagccatagacaagagtaccgacccaaccccacctacagccgggacccccgggacaggtaggcaggactgagccccgagcagcaggacaccggccctgtgccatgacatctcgactaccgggccgcagctcgtgtagccttcatttgtcctagagatgtccatcgacccccgacttcgtccatctccatccgtatcatcatgttcattaactgagtctgttgagccagaacttgagcaagagttgggttcccttcattgttattatttccacttttattggcgcgagtgttcaccatccgttgcagattagagaagatagaaggagaggggttacgctaaagttaagaccttaaccatgttaccactgatctggtgtgtgtagaccattatattgttcaagttgattaagcaagcaacctagtatagttacacactcatcattgaaccacaccaatgacgggaatgcaaccatacctacacacaagcaagcaacaaacgttctaccctactaactattcttcaaggatagtttggcggcataggttctaaggtaggatccaaacttcattccatcttgaccacttggcacttcggttctttctcgatccacttgactgacctccataagtagacctcattaacatcttctagtttcaacaactagttttagaactactcaagttgaaagcaggaggggagaggatgataaaatgatttatagagaattctagagaaggaagaaaggaaaattttcacaaatcatgttttcggaaaatttgtccttaaggtttgaccatttggcttatcctacagtcgagatggctctgataccaacttgtcacgcccggaaattcacaagtaatttccaaacttatttgtgcataaaatcctcgtccaggaatcagccgaggtacacaaactgacaatttaatatacagattcatcaaattaactaaaacgataagtacttacttaagaggcacttagtcctcatcaagaagaaaactgcagcggaaaaataaaatctagcgaagctccggctccactcccacaggcagctcaactgggatataagccaaacgtcttctccttctggatcctttttcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccatcctgaacaaccatacccggctgtacagatcgggctgcaggaat

SEQ ID NO: 76048 - DNA, 10145 bp, Oryza sativa
gtctgttttcaacaacacacattttaatgtgccgcaaaaaccattgccagcttgatgtgttctcgctttcaacaaatgcaaaagcaacaggaacgacatggctatccgcgtcgactccgatcgcggttagaattgtccctttgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccatcaaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatttgtccaactttcacctgcttactatcataacaccagtgggcatctaaaccatcgtttaccttcatacgactcattgatatggtcgtccaatcatcgggtatgttagtttcgttgtcccacagtgttgtatcttctccttccactacaagcgcaaggtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacattttcaacttgtccaccttccaacggagtttcttccaccacggcatgacttgactcccccgatcgatcaacacatgttgtcttctgcaccacgccaggctatagcctttctcccttactttactaacaaacttcctccaactcccagttgacgcaacctccactactctccactgccatccatgttgacccctcactggccacacggcatttatgacaaatttatcgtgcactggatctaccccaaacatattatacaaccaccctaacacgtcattcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactatattaccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaacttcactgctggagggcgtcgccaaccctttcctcccggccggcgcctcctcggcctcctctccggcctgctatcccctctcctcgctccctccggcgctcacggcgacgatgtggcgactctcggcggcggctggcgatgtggtcctcaaaacaaatcgaactcgcggcctaggtggacggggctttaaaccggcctgtcgaacgcccattgttcgacagggtcggtggagggccctgtcgaacgcccccggttcgacaggcctcgcggcgccgggtggtgggccctgtcgaactccctccgttcgataggtgagcgtgtcgaacgccagccgttcgacagggctttgtcgactgcccgtcgttcgataggtgccctatcgaattgcacccgttcgacagggacctactttcgtgattttccccggttggccactacttttgcgattttccataaaaataatattaattctcaaaaaaatttcagcccagtcgccagcgcgcagatagagccaaacgccctccacccatagcctgacaagtgggacccacgccaaaatgtccccacatgtcatggacgcctcttgcctggctaccaagtgttcccctgcttgggaatatgtcgctcggccgacctctcgtattattgatgcgacttgcagcccaaaacccccaaaaagccacagaagagagacaggggagaaaaccctaatctcaaggccgcggctgtgagcgctcctcccgtctctcccccaacccgccgccagccaccgagctcgccaccgtctccgttgcctcgccgtgctctaggtctggatgcctgctccccttcatccctcctcttctccgtctaaagccgtcgtgtttagcctccaggggcggctcgccgcggcatcttttttttttctttaaggtggtagtgcttacatggcgatgctctatgtgcctcttgtgcgtggataggttctcggatggaggccgaggcggcggcgaagagggcgcgggagagcggtgacgcggcggcggccggtgccggcgagcaggcgggtatctctgccgtcatccctggatggttctccgagattagccccatgtggcctggttcgttccgctctcttaccctctgtagccctgttttgccattacaatgccacaccctcttgctttgtaaattcgctcgacatggactacaggttcgcttttaatttatataaaaaaggtttatatagtttataaaggagtatattgtttctttccagaattaatgtgtccagttgaatctccgattgggcttcttgtatcatgggacggagcacatcgttagggaactgataaaattctttgccattttttttaaaatttttagcttggttgggtataggggtgggcattcggttttcccggttggtacagttcggtttgttcagctttcagaaagattggtttttaataatcgcaagccaaagtgtctgtgagaaaaaaaataaaccgcgccgaatagactgatctaccttggttttcttgttcggttttcccgaataaaccgagaaattggctactcatggtacggaggtgccgcaggccttgtgcgcgcactgcacggcgacgtttaggctggctgccgtgggaattagcgcatgatctagtggcctctaggggctggtatgatgctatcaatgggcttttgcatggatcgatggaccgtggacgttccacctttcatagacatgcatagatcaatttcctggtttcttcgatttttggagataaaagaccaagcaaattaccgaaggcctaacaagggaaaaaataaaccgaagaggaatccgatgaccgaaaaaaccggctcttcggtttggattggccttcggtttccggtgattttatgcccacccctagttgggtattgctttatgctgttcaaggcttcaagcaaccgtgcagagaaacagatttaccaccctaaaaattctaaatatattaattatgcaacttgcgaataagattttttttctggccacaacacgtgattttttgcgctctagtaatttttgaaataatgtttttgagcccatggcaggtgaggcacactcattgaaggtcgaaaaggtactattccaaggaaagtcggactaccaaaatgtgatggtgtttcaggtaaagatcttttattgcaccaatgctgctttttcttcgtcttcactcaaactggagtatgaacctgtgctgttattttgctttctagtcctccacgtacggcaaggtgcttgtgctggatggagtgattcaggtcactgagagggatgagtgtgcttaccaagagatgattacccacctccccctttgctctatcaaagatcccaagaaggtaatgcatctaatttgcagattgtatgttgtataagttgtaatcctgctggtgtataacgagatgaactcttataattatttgtggttaggacatgcatgtgtgaaatatattagacataatattattagaccttgtcgagaaaagtttgctcgtattcttttgttcatatcaaccatgcacttccaagtactgatgatgataatattttttactgcaacaaacaccaacttaatgacaaggaacttgacaacatgattttggactaattcagagccaaacactggcaacatgtttgctaccctattttaacatcaagttttgagtgaaaagttccatggaaacacaagcaccatgtgaattctagggattcctaggattttcctgcacaaacgttgtcatgacccgaggtcatgacgggataaacaccgccgggaagatagccgggcggcgtcggctcctggagaagggatgtagattcaggctagggagaagaacattattgggagggagagattagactaattgatattcattgcttaacttgagatgaatacaatccatcccttatatagagatgatatgacttgacccataagaaactaactcaaactaactctatctaatcctatcctatctcctaaccgactgctacagtactcgtggtactgtttatccgctaggacttggcctcgtgggcctcggcctctctgcccaacgcctatgacaaacgtgaatgcatttttacattaacagaatcttgtattgttcttagttttgctacttgtcagcattcctattaagttaattcttctggccagaacataataaagtaccatttagttcctttttcttgcatcttttttaaatcgacgtggccaaacagttaagctttgaacaacagcatgtttaggactattgaaattgaacattcgaatacgacataactgaatttatcgttattagtgcttatataacaatgcagtttcagtaaaattttgtaacacgaagtaataataagtggccatccaagtttgttaaaagaactaaaggagtataagttacataaaattaagcaaaagagggcactatgaatttgttatatatgtgaaatatcaccattctgcatttatccttcataattttgtattgagttttaatttgtaccccgtcccttcataactataagggatttaaggctcttttggagagattaaggttacgggaaaaagataatgcccgtcaagattcggtgaaaaaaataaatgaagggttgttggattggctgagtagcactcaaaatcctttatatttgttgacagagggagtaatatgctaagtctctaatctttggtgaacaggtgttagttattggaggtggagatggtggtgttttgcgtgaagtttcacgacattcctcggtggagcaaattgacatatgtgaaattgataagatggtggtagatgtaagaacttttgtttccctggctttctttgattgcatgcacgtatcaattgactattggtcgatattcatatcttggtgatgcaaaaatttgttgatttcagcaaatttgtgttaataatctttaggtattttccccatatccattgtctgtatgtttggtcactctcatgtaatttgcagaattacttggcaatttgcctggtaccagtcaatgtgtagagtgtcactcctgttgttatgacatgtgaattgaattaaaaaggatgtaggaacttggaattaaatatttcttttgctgctaagtacattgaatcttttagaacgctaaatactggacaatgtttctcaaattaattatagtgatgcaatgaaatactttagcgctgaaagtggaaattgtggtccagcagaaaatatttatcccatggtttaccatgtcgtgtatataactgctaagaaatactacctccgtttcaggttataagattttctagcattgcccatattcacatagatgttaatgaatctaggcacacatatatatctagattcatcaacatatatatgaatgtggccaatgctaaaaagtcttataatatgaaacggaggaagtactattgacaaccacaaattgctacacatcatttacaccataaatcccaataatgaagggtctctttgctaatggcatatcattgtgtatttaatgattatatggtctgaaaccaactttattatcttagccctgaagttgaaaggatgaattgcctttgatgctatgaacttttgattatctatgtactccctccatactcacaaaggaagtcgttttggacagcgacacggtctccaaaacacaactttgacttcttgtttctataaaaatatttattgaaaagcgatatatgtatacttttatgaaaatatttttcaagacaaatctattgatataatttttacatttttaaactcaacaactcgagagttattcatgatttatattcccaaagtttgacttaaatattgtcctaaacaacttcctttatgagtacggagggagtaactaatagttcaattttgaagttgtgtttatattagtttataatttatctcgatcttattaagtttccagttcccttggttaatcaaatgaataattaattgaaggggttaaagaatccaggaccaaataaatgaaaagatactgattcaaatataaactttatggtgcctggagcttcactgctacagtcatagacaatgttgtcatgttgtcgccattgttgataacatgccactgtcagccgatggcagtcagcgtatgccttctcctatgctgggagtgaccgaggatggagggataagagagaagcattggtctggatcaccctttcagttctcttcacactgctgctaatagatctgcctttggggtagctgcggccactggagatctgccaaggtacccaaggaaagaaagtgaagagataagtgagcctgagggacaggcaaagggagaggggcatgcctatcttcactgtaatcactgtgtcatggcagtgtgtgttgtggttgttgtccttgttagcaatgcatggcagttagagccagatttaggaaggagcaggaggagatggtgattgaaagatggacttgttgaatgttgggctgaaagtgggctgggtatatgtattgggccacttctttctctttctctattttattgttctgcctgctccctgtattgctctgggctccctaccctatagttcccttatgccatgggctaacctgattcactgtaatgttgtgatgacattgctcgtaagacatagttttctgtgtgatttcattaatttgaattgccagtatgaatagaaaacaactccccccccccacaagtttttgctgtttcatttgttttgtcttgctatgttaatcatctgttcaattatgcacacaggtctccaaacaattttttcctcatctggctgttggatttgaagacccccgtgtgtcattacacattggagatggtaacaactttagaacttgttataccatgtcaatgtcaatgtctgataagcaacttctcctatttttgcaacatatttgtgctttgattaattttttgttgacgagttcatgcaggcgtggcctttttgaaaaatgctccagagggtacttatgatgcagttattgtggattcctctgatccaataggtgatttgttaatcatgtgagtttttgtgtttgtcattgatctatatcatcaaaataatcctgcctaaccacttatccaggaccggctcaagagcttttcgagaagcctttcttccagtcagttgccagagctttgcgtcctggtggtgttgtatgtacccaggcagagagcatatggttgcatatgcatattattgaagatattgtagctaattgtcgccaagtttttaaaggctcagtgaattatgcttggacaacagtaccaacataccctaggtatgctaactgattatttacatgtggctgaattgatatttccttagttcctaagctaaccatgcttccaatgcagtggtgttattggttttatgctttgctccaccgaggggcctactgttgatttccagcatcctatttttaacattgaggataatgagttctcaacaaaatcgaaaggaccacttaagttctacaattccgaggtgtgttctttgctccgacatggtactgccgttgcatgtcattgtggtactgttatctgactgtatgttattgttgttcagatccactcagcatcattttgtttgccgtcttttgcgaagagagtcattggatccaaggccaactagatcaaagatcactgagcccaaggccaactggactggaatccctccgacaagagatttggttgtagcagaaagagcaatgaccccttttttcccatttaaataaaaattggagatgtaaacggttatccaagtgcttttgaattttgtctcagtatgagaacgttttgtatttggtaactgttttcccgcatctcccttaccatttaccaaaatgagtattgctgtagttttcatctgaggtgcttcttgaattcttgcagtcagtctcattttcagctcgagtgagacggtggtttctttgaagggcttagtgctttgttttgggggtttggggggacatggatcctctacctttggctagtaaagtaccatccaaactaattgaatggacagatttgcttatagggagatagagaaggatatggtgtcatcaacagcttcacttaactatttaacgatatttcgacagttagtggtttgggcgttgagtatttgaaaacaattactccctctagataatatgtgctatattatgaaacggaggtagcaggtttctttttgggattggcaacctatattttttttttaaaaaatagaattgctggtttcgggaagtaaagaactaacattttagtgttcatgttttgcgtgaggattcataggggaaagggtaatccatctgaacccattattgccaaagaaataaagtaattcaaccatacactgcatggtggttttaaacttttaattgtttcttatatttctatgttctctgctcatgtgttgccttcaattatgagcgattggcgctatatgttaaataagccgttctaggttcattatgaacagatcgtggaaacaattagcgattggcgaatcccatcaactgaagaatctcattgcactagcagtctagcacgtacataacgagtaatgagatatagggtttacgattctgagatggcattccgttccgggcgccggcggaatgacggttttcgtgaaatccggtggaaagccagtagattccaaataaatttcataaaccaaaatttgaatacaaattccgagtttaccgatatgtttgtaaaaaccggtcggttttgacgaaattccgagcgaaatcatcgaaatttcaataggcaactagagaaagagacaaactaaaaaccgttcggtttgtggcgaaaaccgaacatgttttgtcgataaaccaatgaaaaaaccaaatttgttttagtcaataaaatgtaggaaaaacacgtgataattgaaaaaattcgtaaaaatgccatttcctttaaatttgataacctaccattgataaccaaattttctttttttttaaaccgttattcttttctttcctattgtaaagttcaggaaatacatgggatacacctttttttggaaaaattatatcccattaggctctatgatatcatactatttataggattttatttgattttttcctattttatcaattcaaatttgaatttggatgaaacccatcgaaattccaaacggcttctactttcgagccacgccgaaacctcgggtttccgcggaattcg

SEQ ID NO: 76049 - DNA, 1640 bp, Oryza sativa
cagatctaatctccaaaccaggagctaagcaaattattaccaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcccgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgagctaccattaaaccatcattaaataataatgaatcataagttatcccaacagtgtgctaatgtttctaagcatggctaagcaatcacatctaatatctagctgaaccaatatataaagctcaactagtcaaattataataacccaaggtatcaaggattaaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgatttcatatgaatttattatgaattttacaagatttaattccaattaaacctattaaacggagactattccaaattaattaaatcatttacaaatgatttatagctgagacagaagattaaagcaacctccggaaaagattggatcatatttggtagatgacatatattaaaaagaaataatatgccactgaaaagaggagaggatttatattgaccgagtcgactaagatcggatggcttggattgatctggcaagcgggcctcacgagataccgactcaacgagtcaattctacgtgacacgggatcacctaaatgatcaaccgaaaccggcgaacggaaccggcggctctgaactaaaggacgactcaacacggacgaacgaacgaagcacggggaacacctcattcgaacgaacgagcgaacgactcaacaacggctgcggctaatccggtggactagaaacgattcacagaaaagccccggtacgacaaacgatagaccggtaggaatttagggatgcacctacggctagacaacttgactaccgagcaac

SEQ ID NO: 76050 - DNA, 511 bp, Oryza sativa
aacgctttgagaactgcgggcgcttgcgtgccttcttaagaccagccttcttcctttcaactatacgggtgtctcttgtcagcaaaccttctcccctcacagtaactttgtttgcggtgctgatcttcaccagtgcacgggcgacgccgaggcaaatggcctgggcttggcccgagagaccacccccgtgaactttgacgaagacgtcgtagctgttctcgaaccctagggtcaccaggggtaccttgcagtactccatccacattggatttccttgcaaatactcctgcggatttttaatgtttgagcagagagattcacaaaagatattgtatgcttgtgcacaccattacaccaattccaggccattagtgtaaacttgaaagctagtgttttggtctatgtgaccacaatttatagatagttcacaataatttaaaacttatgcccaaaaccgtaatttgatcaatatcaatgttaggtgtagtttaggagactaattattttaata

SEQ ID NO: 76051 - DNA, 547 bp, Oryza sativa
gcttcgtccacctcttctgccattgcttcatcttccaggaattcagctacatctggatcaatggctggtagaaatcgtcggcagcagtcttttgtttcctggccttcttctttgcaaccgatggtgcagcagccgattttgctcttttctttccagcagcaggagcaatcggcacacgaggcaggccatgcagcaatgtggaggtcttagggggcattgtagccgataactagaggtgttagtccaccaccgttggcaggagtcctggagcatattggatgtctacaccgctgttgctgtgatgaggaggagaagattctgttgtctgcaaaagaagaatttacataaggttaaaactgatacatcggtttgcagttaacaaaattgacaaaagaaatgattcttacttgagggacagctttagggaaaagatttgtcaagtacatggaagccggttgatggaataaatgtttcttccactctatccatcatcggtcaaaagctgcacctctcagcatcctaaaattgatattgttgatgctgccca

SEQ ID NO: 76052 - DNA, 666 bp, Oryza sativa
acttttgcaattattaagagcagaaaataaattatattatctctaggcttgtgatttcttccgagtaatacttagcaccttgcgttactcggtccatccaacgagcccccgggtgttaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataataatgaagacaccagtcggcggcgacgaaggcggtcgacggtgaaagcgaagatgcccactaatggcggtataataggtcagccgtgtaagcggaaacaccagtcgacggcaacgaaggtgagccaacggtgaggatgtagacatccaacaacggcggcataataggccagccgtgtaggcggaggcaccaatcggcggcgacggaggcaggccggcggtgaagacggggctgcagg

SEQ ID NO: 76053 - DNA, 962 bp, Oryza sativa
aatctaaagcaatgaaaacatttgaccaatgtgaaggcttcgaacttcaggagtagcctgaacagtaaaaaacatttgcatacttcaaaaagctctactaagattatataaggcatattatcacatccgcaattgtatataattttactatcaccatctgtaatttttgacacgaaaatatttacagagttatgtacaaaagcttaaaaggaatttttttctttaatttacagagttatttaccaattcatatccataattatgggatggaaggttccatttgtacaacctacaaaatgcacaaatggttcatgaagtatttcatgtaatataaatgagcatttagatatgtggaatctgatatggaacctttggtggctataacttaactgaccaagtgaacttcacctcaaaatcagatgcaaaataagaacaatataatggtgtgtgccaaattcacttgagtttctagtttcaaaaaatcaattcgtccttacaaagcaaaccaaacctctgactgcacaggatctacagagcaacagatcacagctccaaagtatattgacctgcctgcaaccttgtggctccacgcattcagctcttttggtgtaactggcactcaacgtatgaaatttcagcatggaaaggaactgaaaggttcatttttctttcgaagaacaaataaaaaatgtaatgtcaatcaccaaagaaaattgtgtagaaagtgaaagagtatagcaattagcccacttagcagtttgtactgatttcaagttctactggagcaaattgcagtgtccctaagcagagcatgatgggtgtaggaatcttggtagatatttgcataggccatatcattaatctccgacctctaaccattatgtgttcaattcatggaaagaggattttgtgccatagctcaccacaacacgtttcagatccaatttatagtatttatatat

SEQ ID NO: 76054 - DNA, 703 bp, Oryza sativa
aagtgtgggttgctctacttggaaagcctctagaatctcagcacaagaacttcactaacttacctcgttccctttcggaggagaggaaatccttcacaaacttacccgggacatccacaatatgcaacggattctcgcgggcgacacctaaccgtctaggagatcatctccaagagtaataagcaccgagatgacagcccacgagatattccaagtgctcacccaagatctagtcttcacacatctccaaatcttcttctctccctctcaatctctctttctcacaagaattaggctctagattgagtggagaaggccagaaacacttgggagaggctagcaatagctctaggtttgaaaaatgaaagtggaatggccaaggaacgagctggaaacgagctgtatatgtataacggctaggtgacgtcatctagccgttactcacaaatttgaactggaaactagacaggaagttccggacctggaagaccggaacttccggactacacttaggaaaatctttttcacaagaccggaacttccggacctggaagacagtaagttccggacttgcatttttggacaaatggagtatttgcaaaaatgactcctagggaaacttgacacttggttcacactaagagcacttgatatatctcagagcatcacctggaaccccttttaatagtacggtttttcctaa

SEQ ID NO: 76055 - DNA, 710 bp, Oryza sativa
tctgaaggacgagatagcgcgcctgaagaaggagaatgctcagttaaagggtcttcccgcgccaggaggcgtccggatccgcactacgccccgcaagacgacgactgcacccgtgcgcatccagcttgcgcccaggaacccacctccatcagcagctcccgcagcacctccagttccgcccgcagctccggtagttcctgcagctccagtaccagctccagctcccgttcacgtgtcagctcccgcgtccgctctctccttcgctccagcatcagccgccaggggtccagccagtggcaacggaggttggttgtctgctactcccagtggcagccgcgatctcagcagcagtagctccagtggctcagagccgggcggcggcgagacttatctgccaggctccaggagtcgctcagagggacctggtgacgagcaggaggacgccttcgactccaccgaccgcaggagccgttccgagcattaggctcgctttccattagtttatcgactgtctagtttctgcttgttagtttgtgtgtttaggttgcttgcttggggtcagtcgacggtcgatatcatgcgcctatgatatggctgtcttaataaggatttttgcttgctttttaagtgttttaattcagatccgaacaattgcagtttaaattcctatataataaagcttagttcctgagcatctgttttccttcttt

SEQ ID NO: 76056 - DNA, 2934 bp, Oryza sativa
ttcaacgtttgaccgttcatcttatttaaaaaaaatataaaagaattaaaaagataagtcacgtataaagtattaatcatgttttatcatctaacaataatgaaaatactaattataaaaaaattcatataagacggacagtcaaacgttggcacggaaacccacggtttgtctttttttggacagagggagtaaatgttagtgttgtgtaataaaaaaattgatgaagtgaaaacattataagacttaaatgcatgtttagattcatagttacaggatactctctccattctaaattgatctacatattttataggtataccaagaccaagaaaagctaataactcttttatagtgttatattcactctagcaacaaacttcatgcatgcaccatctccactatttcctagccaatagaaaatcaagatattacatatgggttataaatacgtgtgtgtatggatacatacgttaatgtccatttactccaatgcataaataacgaatagatttaatgaatcaacacaaatacgtagatcatttaggaataatctaaaaaaaattatatatagatcaatttagaatagagagagtatatcatatcttgtacgagaggttgatttattctaggatgaagtaagtatctttaagtagcgggagggcagcgcgacggacggcgcaccggtggggcgatcctgtgttgttagctgctttcccgtttcccttcttcttcgttgccttttcttttttcttcttcaatctcgtcaaatggcttgatgtgcggtccgtgcctgtggcagaggacgccatggtcgcagacgggcttaagcgcctcgccgctggcgtggaccgatgcggttgcccacggccgcgtatattcgatgacagcggcgacagtggttcattggttttttttaattcgttgaatactatacgtggagttgcagtaagatgtagagtattatctagatggattacttataagaaaacccccctagcttcgggaaccatttatccaactaatttgtcaaacgaacacgtgaattgcgttcatatagttttaaattcatcatttattttgctcaaccactgcttacgcaagatggatctagccattgttttgatttcgagtgacacaaaacatagaccggggcactagtctgttttatagtcaatttaatttaaaatgaagatagtatatattgaccgttccgtcgtcaaatcaaattgtgaactgcaattataatatatggccgtctcttgcagtcttcaaaacaaaagttaattcaaatgtaacttgtaagaaagagacggagccatttagcaaacaaactccaagagtccacaactgcccgctcctcgagcggtgaactttttctctttttttaaaaaaagaagaagaggaatgctacagtagacccagccatttttcaattctaaacgacaaaagactgtttattaactagtactactagtctatttttagtgattttaagttagaagttaagagtgttactgagagcaagtttaatagtatagtcaactactaacttcaaatcatctatagtcaatgtaatagctaattcatacaatagttgattactatactattaatacctcgtcatactatcatacacacattacgtcttgtagtccgtgctacaactgactacagatctgtagcccgatgcttttttttctcttcttttatctctttaaaatatatttatagctggcttatagcctggcatctgctctaacgtgtgcaagttggatttcaaactttcttggcgtcaaattaattcaaattatgcgaagtggggattgcatcctagctcagcttgtattgattaagaaccttgcgttgaagtttggttcctgttcaccaagttgatatccgacccgttcgaggtatcgacacgaatgctcatacttttcttgaagttaaattacaccttaaagcaagtacaataatagactataagtcagctataaacttatatggagaagacaagagaggagaaagaaaaaaaacgggttacaaatttgtagccagctgcagcacgaactctgaaacgttacgtgtgtatgacatgtgggaccaattattaatgatgtagtatatatttgtagttaactattgtatgaattggctattagattgattatagataacttgaagctaatagttgttgtctatagtattagagcctatttggaggagcttaagattataaaaagcagctagttggaagccagcttctgagaaactggaaaagctgggtttctgagcttctggcttctagttcattttctggattatataactatatcttctcataatttggatcaaaagctggactgtttggggagcttctgattctatgagaagctgcagcagttagaagctcatcaaatagaccattaaacttgctcttatggttgtgtttgatacaggaattcccaactcccctctcgttttccgcgcgcacgcttttcaaactactaaacggtgtattttttgtaaaaagtttatatacaaaagttgcttaaaaaatcatattgatccatttttggaaaaaaaaactaatacttaattaatcacgcgttaatggaccgctccgtttttcatgcgtgggtgatgggttcccaacacccaccaccgaacacagcctatatttgcaaaaataagtatgggtagaaatcagattttgtacaacttactaaatagttatgctttgttacggataaatataaattgcccacatgatagtattgtttagaatatacttcgtctattccatattgatccccatataaatttttatcaaaaccaagcaaattttaactaccatatcggggtaatcggggtaattaaaagcaagggcgaagtgctcgcacgagagaatttgggacggcgtggacgcacgcg

SEQ ID NO: 76057 - DNA, 2153 bp, Oryza sativa
ttatcgacattttgggtataatctcattctaccatgccattaacagagtagttaagcatttatttgttttatggttaactttctgttatcagtagactatttatcgaatatgtcaatgggacatgggatttcatatcctaaaactctctgttagcagtagactatttatcgaatatgtaaaagaacctacagctatcactgtctttgtgagttacatgtgtccttttcttgtgtgatatttctagtgaagacaacttgagagcagctctcaataaaatgggaatcagtggtcatccattagaagagataatggataaagtgaagaacaggcactaccaggtactgcacctcacagttctacctttaataagcaatcttctaaacttcgtctgcttgaaccatctgagttatgaaatacacagctagcttgcacgatgacttttgaggcagaacatggtgtctcatgtgatactggaatcaatcatcctaatcagtatttcagtgaaagccagaaagtcttgaaagcaaaggtgggtcaccatagttgatttgcattcatttgtgcattttgtcagcatatgagatgttcaaattgacagtaatttcgttttattccacagaatcaagcagtgcagagccaaggaacaacctaaactgtaatgctgctggcaaaagtcagtccatccaaatgcggaatttcaggtttcgacactactagtctgtcagctgttgcgatgcattgttttctaatatctactggttattggcaacaaatttctaatgttcaattgtgcgaacataaacatcattctcaccctttgcttttttatagctatttttcagtattcagcaatcaaatccatgatatgtgtacaattggcagcaattctaagttatttttcttttaatttctgtttttagttttgatgaaataattttgctgtttttccatatgagatgtttttactcctagatttaaccatgaattaaagttttactcatggtcacattggacgattttcaaatgcccattttttgattcaacggtagtttctaggtttgcactacaaattttcccatttatctttggcttctaaattgcccatgaagttgtggctttgcattctgttcaagtgtgcctcgtcgtttggcctgtctattgttattggaaaggggatataactctatgctaagttctgatctagattttaagagagtatttttctgagttggtttctatgaacttcctgcaaaattcttactctaaacagggttcaaatatcagaacctgctattcctaaactaaggatcattgctgtaatttatacactacactagcaagactctttgaaacttgtagaataataataataccgattcatttgctaatactactgggatgtctgtaaataagatttgcgttaattgtgtaatcatgcccaaaaacagcatgcagaatttttgcatacaaggtaatttctttcctaggaatgctacaactaattccaactgtctaattattctatctacttgacagttcgtatcaagatttcatccttgctgctaatgatatggagaacaacaattactaatctttattctgatgcctagatggaattctattgctttgcacggtttcagaattccaacggctgaatatgtcatcccccaaaagtgatggatgtccctgtaaacatgacttgagcacagaaagtagatagaaccgtacaagtacgtacttgtcaaaaccaaaggaaaccatgattatggatatcaaattattgtttgtgttggtaagtggtaactatgtaaccatggtaactatgaccagggggagttgtgaacacctcatcagttaagttgcgctgtaatgtttctgtaatcgaaaacttgttcgacaaaacaattgcgcttccagatatgcaatttcattaatctgcttgaactattcgatctggctgccttgaccagtctgggctcatgatcctgactagccaaaaaagtctggaggtaaccattcaataaactgtggggcactgatgctgcaggagttctgatgctgtggtagtgcaagcaagcaaccccggcggccgcggcgcacgcgtagaggaagggagcagccccggcggcgacgggcgcggaaggaggagcca

SEQ ID NO: 76058 - DNA, 2805 bp, Oryza sativa
tgtgctggagctgcaacaggacgtggagcttgattacggatgttgttgccagcattgttgttgaagaactgacgctgcggacgaacaacagacgaagaacctccctgtggcatgggctggggtcctaaagtaagacgcggcttctgaatatttccctgttgtgtcttgaattgagcaatccgacgttttttttgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattgcgcacttcttccggagcataacgagcaagacgattgaactcgtgcagatactccgtaacagagcgagatccctgggtaagcgacctgaactccttcttcttgagagacactactcctgatggtatatgcgtcttccggaaagcagcggtgaattcaagccaagtgataggttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttctgtggaggtgcatggttatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatggacagggcacaagaagagaaaccggggaaactacttaggacagagaattactttaacttttattgatcttaactgagtttcattattacaaactaaagattctcacaccactaaactcaccaacttcctaacactcaaaagcaaacaaacgcatgcacttacatcccaccactgatgtaaatcacatgcgagccacacacaagcaaactttaagcaagcaaactaacacaacgatctaagacaacgacttaacaagtcactctagttcttccaagcatcggaggtcgattgaaggctcgtctttatcatcttgagttgctacccactcaatcttggaattgttgcgcttggattcttcttctccatcactacttatgatgatgaccggaggatccgcttgagctggggcaactttttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagcggctaacacagtctccgcatgactttcatccatagcccacaacatctcaaccaaatgcttcgtggtagcatcattctcaattccttcagtctcaaggtaactgccacggtcacttccctggggttggcgaggatggtagcgatactcagtgtcggccaattgatcactgtagcgatcacggagctctcctatggcgatccttgccacttcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgagataagttaaaacagttggaaacgaggtcacaaattttgtaattttgaataactggtttcaaaagaaatgaaagaaaattataaaatcaacatgctaaatttattttattgcagcaagattaaataaaacagtattgtaaaacttttgctggtaaatgagccattagtacagtaatagatgtacagtactaataacactggaataaatttttaatgagaaccattaaaagagattatgaagtgcatgtgccattagtttggtttaattaaaagagaaagggaggagaacagttctacttttccaatatttttagagggcttctatggataaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagatctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcaca

SEQ ID NO: 76059 - DNA, 674 bp, Oryza sativa
atgaactgtgaagagacagtaaattaccgtcgatttgaactgcatagacagttaaattatggttaaactctgttgtgttgatgccgcacttggtaacttggtggcctctgtacaccaccttttgttccatattttgtgggggcatgtatttgatattattgctgcaaatcgtctgtaatccatctgcacccatcctttgtaggctagcgtcagttttaactggaactctagcaattagttgtgacctgtcagatgcagtcatgtacaatgtgccggtttaggatcaccttgcattttcgctctacttcatttcttccttggctgtagctttgctgtgtgcgttgatctatggctggcttgtttggatggatgggatcaccttgcattttcgctctacttcatttcttccttggctatagctttgctgtgtgcgttgatctatggctggcttgtttggatggatggattttagattcattctctggtagaggtagattatggattcaaatctattctggtaaagcgatgagtatttactttgcgtcaggaatacagcaactagaatttaaaatatgttggattttgcagtgaagaaacaaggcaaatcgttctacgtattacacttttatccttgatatgaaaacaagcctttaaaccgctaataatataaacga

SEQ ID NO: 76060 - DNA, 795 bp, Oryza sativa
tatgtccgctcacccctccaaggtacatctccccgctacgtaaaaaaaccggtgtacactctaaaagatccatcaaccatgaaatgacctgctatcaatttttgaaaggaacttaatgtcgcctagaggggggtaaaataggtgttcctaaaaattatcacaacttcatatcatattagagatatgagaactttcggtttaaataggaacttccggtatgagattggaagttccggtctcaaccgaaaagttcggcggataacggaataaaacactaactatgaatttgtagcttgaataaacaaaatgtatatgaatcaaaaggtgacaaataaggtatctaagtaagatataaggtcaccagctatattaattaagcatacaagtagatcaggtaaaaacaagctcaagcacaatatgagatatggcaagaacggacaaaccaagagagtagacaagttgatttgtttcccgaagttcggatccacggatcctatgtctccgttgaggggccacaagaccgggtctatttcaaccatttcctcacgagattgcacaaatgcactcctcggtttcactcttgatttcttcccttacggaggcgaaatcgaagtcttcacaaactttctatggcacaccacaaccttgggtgatcaccgacgatgcctagccatctggaaaaccttagtccccaagagtaacaaacacaatcgaagatttacttgctatgaactcgagtgctcaaagtatggagtgaaactcactagctctcaacttctcaatctctcaatccaa

SEQ ID NO: 76061 - DNA, 5802 bp, Oryza sativa
aagccagtcccgtgaaaattggaatttcatatatcttaccttcttcgtttcttcaggaattttctaaaataattccgtggaaccctcctcgcaagaaaatacctaggtgcagttcctctccctctctttatccaacccttactaatcttgaggacgagattattcttaagggggtaggtttgtaacatcctggaaatctcgattctgaaatacggaattaaaaattcggaataataaaaaatcttttaaaacatttttgcatgctgggatttattatgtatttgtgtgtatttaggttgtgtgccaaagatctcgattaaatcttatctcctaaagggacgccctctctgtccaacgtcctttccttcccttatcttcacggtctgatttattaagtgctttagtactaaacaaatcacagatctgaatttataacccgaaaatctttccttatgtcacaatgcgacatatctttctcaattcttaccctacggttattttaaaccattctactaattctactcgataaatccttcaaatgtctacaatcgattggcgtaacgtatcatatgcacacatgccctcgcatgtacacaccgtgtacaccaactaaaaattatcacaaaaaattctagaaaaattcatacatgtactttcaatagtattacatctacgtgcaaagtcgcatcttcaaattcattctatatagagaataacaaaaaagataaaattttgacaaaattgcaaccttaaaactgtcagattttttgtttttttttgttacggctaaaatataatgaatttgacgttaacattttaaccctaggtgtaatacaattgaaagtatgtgtatgattttttctagattttttggtgacatttttagttggtgtgcacgtgtgtacacgtgagggcatgtgtgcataggatatgttgcctatttatttatcgtgcatcgattcaaatatattcaattctatttctaccgtgacaattggatttgtatgccatgcgtcttccctaaaatttctttgtgccacctgtgttcattcatgcaaagcgctcgcaaagggatcctaattctaacccatacggccttcttgccaaattaaattcctaactaccgtcatacagaccgatgtatagtcgctgtgcacgttcaagtccaagtgacaaatccattttccaacctccgaaattccccagggaagtacaataggactagcagtaccaactccaaataaaataatgcccaagatgtacaatgacctgcaccgtccacctatacgatcccattacccatatactgtccattttaccgtactatcacgaaatccaaaccgaactcaattgttcagataacgcttcactcatacagtcccattcccaagtatacaattcaccctaccatccaattacacagagccaaattaaatgtccaaattatacgatccatagtacagtccaatgcacagatcagttgcaagctcaaatgccactgtcatcccaatacaaaccctaccaaaaatacaaaagctcctattacaattgggccattctcctctctctcccagcccaacgaacaacccagcataagtctattttatctcccccagccgacctagcagcccacccctgttcccttgctcagccaaccaccagaagtctgctctgcctccctcaggcaacatgcatgcacagaacgtgtccgacaaattgcctacaagacaccacagggttttgcacccacctttgccggctcacaacagtagctcataaatgccatggcccctcccaaccaacaacgcctgcacccatgctccaaatccacaagactcaccaccaaaaaccaacaaacacagtgaggaaggctcacaccgaaaaacaacaccaagttcacagaggggaactcactttgtctcccatgcagatagccacaacaccaggaagcctatataaacaccaccacagccatgcacccctccatttcctcctccccctccctgatcgtcgagctctgtcgccaccaccactccattccctcacgcatttgctgcctcctctccatttgccccgccgtggctagcctaggctgagcttcgattgggcaaagggacgggttggccgccgcgcgcattgatcacctgagaacgactaacccctaacatttaacccgctaaccctttcattttcagtttcgctaacctctgactctttctttttgtttcgctaacccctaactcactaacccgccaactcctttactttcgttccgctaacttctaactcgctaacaaactaacctccaacccttatcttgcactaacccgctgacatttatcccctaacactgtgtgttcgcttgttgccgacgatcgaacacgtggtgtgtgcgaggacgaacagcaagcctaggatgatccgtgagccgaccgtcgacgcccgtcgacattgcacggtgtgccgctactcggctaccgcaatgtgagcaactcctccttcccctccttgctctccctcccatcgtcacccttagttttgttgatcgcctcctccttgcgtggccgacacctagccggaccgcgcaccatccctctcccacgcgcctggccgcgccgccgcgtagcctagcctggctaccggctaccgccgcaccgtcgcctgcgccgacacgcccggccgctgccccgccgacgtcttggcctcacccaggacgccgccgagtggccgcgccatatgcgcggcatcgccgtatcacggccacctcgaaccgccatggccaccaccctcgcaccaacaaactgaacaccgtcatcgcgccctccatccccaacccaacctattaactgaacgccgccacccccggtcccaacctccatccccgccagcaagcccctcccctctgcctgccgccggcgtccccattccccatggccgtcgtgccgcccctagcgccgacgagccgacgccccaggccgcctccccctccattaccgccgccaaacacatccaccccgttgccgcaccacccatccccctctcttttttgcgcatgaggagaagccgagggaggaaagtaggaaacagagcgagagaaagagataagacgagagattgagaaggatcgggagaaggagaaagaaaaagaaataaaaggtaggacccaccctttggacttccgttcgtgagccatctctcctccatgaagtctacaacacctccctgactcctccaggacaagcccaaacaccaaggcctctgttgaagtctatgttatcccctagccgagccgagagatggaaaaagtacaccgaaggtccctcagcttgttatggagttacaaaatcgtcctccaaccacaaaaccagatatctggtatcccttaactaatcaaaactggtcacagtaggtcatttagtggttttgtgcccggttttgtcctacgtggcggctgattcaacgtgggacccacatgtcaggctgccacgtcatatttctctcacttccctcctctctctctctcactcttctcttttgttctatgggcaagccggccagcggcggaggagaccaccaaggtaagataggagaggaggaggcggcgggcgacaagacggcgacgacgcggcggcgacgacgacacgggaggacacgcgacaatgacacgacggcggcgacacggcgacggcgatggcgacgatacggcggcggcgacgacgacgaggcctgcgtcatgacgaggtcgatgtcgcggggttctatccctgtctcgtacaattgtttgcagcagttgtacagtttcttacattcttggctctcttgatggtaatcctgctgactcccgtgacgggtttcattccgagcttcatcatggccttgcggctcttcttctcgctcctgctctgcttggagcctttatttacaactgcaccgtgctcaccttcaattcaaggtcatcaaaactgcaaatcaggctataaatctagctattagtaattgctacaagaactgaaggtaacaccgttaacgaaatccaaacaccacgatgcactaacacgtttctaatcagtaaaactactgcacgctgcctttcacatggacagattgcagtattaacgaagacgaaacgcaaaggaggaagagtgttaccgtcatcctcatcaccatcgtcatcgtcgtcttcatcgccgtcgtcatcatccttggcgtcctcgacgatgggagcatcgtcctccggctgcgccttggccgcggcctcctcgggtttgacgggcaccgcggcgctgctcaccagctccgcctcggcggtcgccaccggcgtttgctcgctgaccatgtcgaggaggaggaggaggatccgagcgaggctcgcggttgcaacaatgacttgcggtggtggcgcgcgcaccaggagaggctcgctgttgcaacaactacttccgccacgtccgctgcctcgcttctccgtctcgcggccgcagcgccgccccccgtcgcttcccccaccggcgtcgcgggcctcgcacggccgccgcggagctccgccgggctgccgccgtgcttccccattgctgccgccgcggccgccgccgaggaggaagagaagagtgagagagagaggagggaagggaaagagagatgacgttgcagcctgacatgtgggtcccacgttgaatcagccgccacgtaggataaaataggggtcaaaaccaccgaaggacctactgtgaccggttttgattagttaaaggatgccagatatctggttttatggttgggggacgattttgtaactcgataacaggttgaaggaccttcggtgtactttttccccgagagattgattaacctacataagtctacataatacccttctacagagcccatcattagccacctcatccactaaagtccacaacacatcccctatgcaacccagagccctctctgaaagcagctccccttcggtttataaactcttccaacttcgaaaatccatatctttccaaccgtaactccgattgactccgttcaacttccataatctgaaaacctctacggctcgggcgcccgatcatttggagaaaaatcgggcgctgacgtcagcgatttacgtgcagaaactactttaaactgatttttctcttaaattatttatccaaatcatgatccgattgcaccattaaattcgttgtaattaaatcttcaaaacaagaccacacatgaatatattccgatgaaatttttttatcttattattgaattatttttaaatgttgcacgatgttccaccaggtatatcagaattgtttcactaagtatatcgaaaatgtttcactcgtttaaatcgggtgttgtttcaccttatataataacaatgtttcagcaaatagcgaaagattgtttcagttcactgcaacatttgatctatacatagtgaaacattataagtacactaggtgaaatattttttggtggaacaaaaaataaaacaaattctcttaatagggggtttccaaaatatgtgggtttttttgttgcaatggaatatttcagttcactacaacatttgatctatacatagtgaaacatcgtgagtacactaggtgaaacattttttgtggaacaaaaaaataaaccaaatttccttaatagagggtttccaaaatatgtgattgatttgttgcaggtgggggtaggtattgtggtcgggtcagcgtcatcaacgcgcgcgcggggacgggggcggggggagcgaccgatttttcctccccccgcctggtcgcccgaaggcaagcatta

SEQ ID NO: 76062 - DNA, 1432 bp, Oryza sativa
ttggtctgtgtgccaagatgaaatatgactatcaaaagtagatggagggagtattaaatactccttccatttcatattataagtcgctttgactttttcctttgtcaaacttttttaaagtttgaccaagtttgtagaaaaatatagcaacatttccaacacaaaagcaaacatattatcaaaatatattcaatgttacatttaataaactaatttggtgttgtagatgctgctacattttcctataaacttggtcagatgtaaagaagtttgattaggaaaaaagtcaaagcgatttataatatggaacggagggagtatcaagtttcttgggtgccaagcatgagatgtacccccctccatccttatttagatgatgttttagggtattggttttgtttttgaatagctttttatgttttgtaggtattatgttcccaaattacccctaataaaagtagtaggtatattgctccaatgaactcatttatttctaaccactagcatatttcgtctagagcttggcttggctgtaacacgaccactagcacaatcctgttcagccacgcaccatgtctacttgtgatgaaattgaacaagctggactagcatagtaatgtggacagctcagtagaaataaagtatattaattaggggtaagacagtctcaagtaacacaattgaacatcaccctagcctgtgtgtttggcccaagatgacaagtaattcaatggagggagtagcaaacttgacttgaatccacatttcacgtcaaagttgcctgaattcgtatagcggtttcaactatatttacaacttaccgttatccactataaggtcagtactgagacaattatgccaaaaccagattgatcaatacataagagggaagataaacccctagttgtcgtttgctctatcatgcatgcatgccgccatccaaagtcatcctgctcgtttcacccattgcaacagacaacaaggagggcaggcagaccagggaagttcagaaacctaccggagtgtcagaaacgggcaggcagcattttgatgcagctctccaccagaaatactcacctcacaaatgttcgcggtaaagcaaccgatctaacacgcatccaggatcatgcatcaatggtattgtaatgtgctaccttttggtgttgaaaaaaggctaccttttcaagcattcccaactcatagcagccttattttgacatgaagcctgatgcttaaacatcaagttgggattataggcgagtaaccccccctaccgcggaacagataacctcgaacaaacccaaactacagcacgattcgacaacacaattaactgaaatacgaaatgaactgatggacaaaccctaggattggagccccccaacaccaaactaaaccaccatgattcgaacccaacacgccaaacccaaaa

SEQ ID NO: 76063 - DNA, 3032 bp, Oryza sativa
tatctatttcttaaagtacttgtcacctgtgctgtgtcctaaatactaagtataatcataggattttcgtttctcatgatccaaccatctaagaattatagttcactttcattcatcgtaatttaaccactaaaatataaattggttatcaaagatgagacggtaatgatcaacgctcacagattatttgagaacgggggcagtatataactatctatatcaagtataaaggttgagcaaacagcaaggagtgtggttcgtcataaatcaggagcaaacaatatgtgacagcgatcgagctgcatagtacaacattcttttcttgaggtggttctacgttgaaatgaaactgacgagctgcctcaagtctgttacacaatgtagtgatatggttatagatgatcgatcggtctagcatcgagtaatggagatatgattctagagcatcatgatcggcggtttctagtctgcgtccatctcctcgagcgctgcctgggcggctgccttcgcctgctccacgaggtcgtctggaacctgtattgacagcccggtaacagagttcatatttcacatgataagggaggttctatttatcaagggagaaggcatgtttatcccttgtatataccttctcatgctggcgctttgattcatcgcatacccagctcagctccagttcaaagtctttgtctttagcttcgtcatgcactccatagattctgcattggtacaaagaaaggtcacaggcgagaaaaagaatgcagatcttcattagcttggtcaacatttccttgtagaagttatttacgtttttctgatttgttcacatggtagatggtctattatgagtcatgcatgactcatgagtcatgagtaccaacagtcccactgacaagacaaatctatagcacaacaatttatgctcagaaaaaaatctcaaagctacatattattgtcaatctgtagtgcaatgcaaccaaaactggtgctcatagatcatggtacagtgattattcatgtgaacaaagtaccttctgtacttaaatcatccaatagatttttatttgttctagaggggaaaattgcattagctgctggtagtcgacaaataagtgcatagcaaattttaaggcatccatgacagtatgaaacaaactttcacttgtgagctctaagagggaatttgcagattatagtaaaaggttcaggacatacatctttgcaacctcaacaatgccttctctgcatgtaagctcagaaagattcagtttctctatctccctgtacaacatttaatagatgtatcagaattacaaaccattgttcatgagtcatgacaaatagacagccaacatattcaaaagctgaatcatcttttcttgaaccatcataaacacatctgatgattgccaacccattccttgataagcattaaaactacgaaaaagctaatatatggttcatcaaattataatctagagtttgggtcagttttcccttggcagtcattcaacaaccaacaccaattctagaatatctgtgatatattaatgaggctattgtctagttaatatatcaaaaaggtgacagaagtgcaagaagtgccaatgccaaaataagcatataagaaacaaagattagatcaacatcttccaccattgaagatggaatactacttaaggactactatatatgcaagatgtgaagagataacttgatgtatatagtaaaaatacaaaagaatatgctaagttctaaagataattatggatcatcaaatttaacaagtgatgaataagccaccactatttgcgtcctagtaatatgcaacaaaaaagaagttgggcactaatgcagaaatcatacaataaatagtactccctccgtttcacaatgtaagtcattctagcatttcccacattcatattgatgctaatgaatctagacatatatatctatctagattcattagcattaatatgaatgtgggaaatgcaagaatgatttacattgtgaaacagaggaagtatcaaaaccctaatagcttacgtttttgcagcctgtcttcctttccccagggcagcaccgaagtatttctgtcaaattcgattcagaaagtcattcttccacattaaagagtgcttcccaaagaaataatgcacatgatactaagcaagaaatacggtatctatcataaaagtgcaaatatgttcattacatgagtggatgagcccagccactaccataagatggtcaagttggtctttcagttgtaacaaataaaggtatgatagaagtgctacagtgtattagggtaaaaaatttacataggagagccccgaaggttcgatcatgtagagttgtggcccatccctatcataacctccaagaataactccacagccaaaaggcctgacacaagaggagtataaattgcatcaaacatcttaaccagggattgtattgaagaaaaatgttgaccgtcttacctgagccaccagtagagggtacataaatgtacatagctagctacacgatcagccaattcctttacaggcatgggttctccatacaccctggtgcagtacagcgttaggcaaaacacctaaaagaatgtagctatggggaaaaattcaagaattctcacttttcataactggctgcctctgactttgccctagagactatctgcctaccatccgcagctaaaccagcaacagcctgaaaatgagaacgtaagaagccaaaacaatttgaacaacaatgacaaaacagaacaaaagaaaagaaaaggaacactttacaaaatccaagctttatcacatatatccattattacaaagtgacaatgtcaaaaagaaagtgacaataccaaaaagaaaaaaaaaagtactgccagaaaaatgaaattacgctggaagctgctgggaaatttcagagctaaataatttgttgtgattggttgctcatctgaagaaacaaagaggtggaaaacaaattaccaagccagagtgtcggtgcacagagtggag

SEQ ID NO: 76064 - DNA, 628 bp, Oryza sativa
ccgttcaaccattgggctgagtgggaaaagcttggcgcacacgaaagagaatgagggcttagaaagacacacgggccccttacttggcgcgccagatgacgaagcatggggctcctcaccgggagaccgcgcaggcccccctttgccggttcggccgggggcgctaagtgaggttcttagcccttggtatgtggaatgttcgcgagagagcaaatgcacaagacacggcggatgtagacaggttcgggccgctgagaagcgtaataccctactcctgtgttctgatggatctgtgtgtgaaggagttacaaaaagccggagagcaagagagttcaaactctcgaacccctctcttctggttctggcctcccatcctcggtgggcaaggtcctccttttatatctcaaggggataccacatgcaccacttctacctactcttcttttgggtggggacccaccctatcttgaccaaaacttggctcgcatcttcgcctaaaagcaaaatcatagcttgtccttgagtgaggcccagcgccgtcactcgcctgacacaggggatcaccctgtcattccttcattaatgggtggagatttgcaatggccactgtccgaatgaccctccgata

SEQ ID NO: 76065 - DNA, 3335 bp, Oryza sativa
tgttacggaagggcctctggatcacacgataagtggtgtactaaacctcataacataagtacataacatcctaagtgaagatttgagttattgatttacaactgaagctgactgcccaaaccttttaacaaatccctttgtccggtactttgtaacgaggattaactgttaatggcagtaaaacaaggacgaatcctacaaattgacaagaaggggcttttttgctgccaattcagatatcgatttgcgccttagtcctgtcatccccgaatcgtaagatttaaactaaaacaaggccgctaagagccgagacacgcgggaagcaatgcaagcaatccacccaatatgagtacggaacagctgcgcagcaatccacaaaccagaaggcggcggcggcggcggcggcggcggagcgcctcgatcccacccgcaacgccatgaaccctcgcgcctcggctaactaactaggaacgaagataccggcaagtattcgggctccccaatctacgcaacgccgtgccggtgccgcccgcgcgcgaggcgacaatgcgcccgccgcctagatcccccggccgcgccctcgacgtacggaagaggaaacgcggggggacctgcaagcctaacacgggggagaggaagcgggcggcgcttaccgatgcctgcggggggtgagggggggcgtcgccggcggcggcggcggcggcggggcgtctcgtcgaggattccggcggcttcggcttgtggcgcaagaaggtggggggagtgtgtcgtcttggcttgggggagaagagagaggaggagacgagtcgtggtgcggtttaagttgggaggagggaggcggcccgcgtctgactcgaaccgggactcgactcgacgcgatcacgcgacggaggcaggaaggtgggccgggccgtgggctggcgttcagttgggccggagaggtgaggctgggctttttgttcctgggctggatttggaatagagtgttgcctgtacaaacattttttttttgaaccagttgccttgtatactacctccgttgcaaaataagtgtattcgtgggtatccgtagccaatgtttggccgtctgtcttatttgaaaaatttatgaacaagttaaaaagaattagccacacataaagtattattcatattttattatctaataacaataaaaatactaatcacaaaaaaaattaaataagacgaacggtcgaacgttatacatgagcagtgcaaaactgcatttattttgagacggtgggagtataaattacaaacttagtactaacagatacttccttcatttcgcaatataagttattctagcatttttcacgttcatattgatgttaatgaatctagatagatgtatatgtctagattcattaacatcaatacgaatgtgggaaatgctagaatgacttacattgtgaaatagagaaagtagattagaatagcgggtctaagaaaacagtttctctcagatgcatatggaccaaataatccgtggcgataattcagtgttcagataattcgctgtaattatactcgctcgaaacactcaatatttctcaactacaaggcagagtttacactttcacttcaacagctagctcccttcggtgatgtacaattgaacatcgccatttcttccttgctaattcatctcctcattgcgtcaatacgcagatccgtctcccctcttcagcgtcaccaacttaattaacaccacgaatcacaagcagtaattcacaaactttaattactctgcaaatgcgtatgttcatatgctgaatcagtcacgagaagccgtcccggcgatcctgctcctccgcctccttgttcgccgtctgcacggccttgaaccacaagaatccctgcaaaaaaattttaaaacaagcaatcaaaatccatggaaaatttggattcatgtcctcgcaatggagattggcaatgagaggatgcgtacggaggtgggtatcccggtgaagacgaagaaccctaggagcggcgcgtacagggcgctgtcggggctcaccacgccgaacaccggccgctggttcgcgtactcgaagatggacccgatctgcgcgccatggttagggtttgggattcgagaggaggaggaggaggagaggagttgaaggggtggagaggcgtacggcggcgatggcggtgatggcggaggcgagaaggtaggcgaagaaggggagctcgacggcgccgggctcctgctggcccccgccgccgccgccctcgcgtgcccacggcggcggctcgtcggagcccgggcgcgcccacgaggggacctgctcgtccgcctcccccgacgacttcgccgacccctccgtcgccgccacggccaccagtccgcccctcctcctcttctcgacgacctccacaaccgacgcgaggcgggctcgaggagggcgccccaggatcaggcggaggcaccgcgagctgcacgcggacacggccgccgccatggctggctgggttggcgagctcgccgtggcgcgcgcggtggaaacgaaccgtggaatggataggacgcgggtggcgtgcgcgcggcgcggggttcctcacttcccatcacctcacctttttgggctgggccgaattcaacagtgtcagtgtgtcacataacatatggccatatgtttttgtttctttattttcttttttttttggacaaaaacaccctagaacattttatatctgacttgtattatgtaaaacaagaggtagtacagaacatactatgtctaaaaagaatattaaaaccaaattaaaaccacatccaatatatttccacatccctatcgatcttgtcgccggtggaagagaagaataggcagagatctgaacaaaatatgaagaatcattgcaccgtggctttttaagatcacagtaatcatccgacctgaaggatgagtccgtggaaccgttgaaaagacatcggtaagttcatgcctcgatctcgaactagatttgctcccacgtaaccacaagtccacaactcttacaagccctttactaatgctagatagaccagcagtgaagtagagagagggagagagagcgtgcgtgccaaagaactgttattctaaagaatgttgtcttcatctccatatgtgtaacaatgacacacaagacacatagccaatcactatttatatatggaagatacagtcgagacaagatatgaacgatgaacaaaactaaaaaaaacataaccacataaattctcatttgccttgaacaatgaacactttgcgaattgcaatttgcaacccagaaggttcactatttcatccggatatcgtgtgatt

SEQ ID NO: 76066 - DNA, 662 bp, Oryza sativa
ggggaggagaccggagaaaattagaaggagaagaagagaagcagggagaggcgcacaaaaacaactcacattgatctatttgctggtggtgttccgaggagattagaaacttctcggtgactcgcctgcagttcgtgagcaagcgcgccacagtgagattaaatatctctcatcgtcgagccgatgtcgcaagtggagatgatggtggtagatggtaagtatgataaataatcctctccaaccctgttggtaaaccagtcgttctaatggattatcggagtacctccttctcatcaattggagcgctttggaaatcaaatcgcctccattttcttgaagcataaacttggatttgtctaatctgcggattggattatcctcgtattttttataatcaacactcttatttttatggtgcgcatgccgggagcgagccctaaattataaacaaaggaggagtggagataaaaaaaaaaagatatatgctatgttcatgaccgacgaggccaagcaatgcattggctaaagctgaaaaatgctatggctgttatatatgtctatttataggcgaaaccatggccgagtgctgacaaggccaggtcactatactattaacacgtctagtctaaaatgaacgggagccggatacaccgttgctgggc

SEQ ID NO: 76067 - DNA, 889 bp, Oryza sativa
ggcgatcagtgaccacctgcatatacaccatatagatatatgttattatacacacatcgatcgatcagtgatcagtaatatgcttgtcgattcatccatcgccatgttgtcatgatcggatcatgattctatctcttatatagctaatacaatatttatcttctttgcaggatggccggcatggaggcttacttgttgcctagaagctcatggagcttgatgatgaactcgtcctcctcctcggtgaaattacctcgcttgaggtccggtctcaggtagttgatccatcgcagccggcagcttttcccgcaccgcagcaaccctacacacaggtaacactcagtcagtcaccgtcgacctctgaccatgatcgccgccgccatgcacgccatggccggagtagcatgattttgtacgacgttgtatatacctgcggccttggggagcgacctccagcatccctcgccgttggccttgatgtaggcgatgagccgctggtcctcctccttcgtccaggctcccttgttcgtgtgcgccttctcgcagcatggggacctccccatgctagctaggctacctagctcgctacacccagatcagtccctctctctctatatatatacacacacagatcgagggaaagctctcttgttgatgaagagaagaagcacaggagcgagggagggaggaggaagatggagatgagcgggggctggttgcaggtgatgctttgtgggagctttttcgtgagcaaggagagagaggagggtggtggttggttggttttatacgagggagagggagaggaggggagggccccattgacccggatccctctgggccatttgaccgagttggtgcgatgagacgagaggaggagcggaggttg

SEQ ID NO: 76068 - DNA, 699 bp, Oryza sativa
ctgatagccagcttgatggtttctaagtaagttccaaagttttttccacataaattctttggtagatctattatatataaaagttagttttttctacggtgttgatagaattatttttttaagagttgtttctttctttgttggtgcctacttatttgtcacgttttatagtcttctataaagacataggaagttttatctatcgcgttgtcgatgatccaatcggctcgttgactttagagtctaggtcaccaatttattcgatgacactggtttatatactttttggatatgccggaatcatatctctcgcaacgttccaagatttggagtttctttgttctatttttggctcttaaatgtctccttctaccaaatggttagaataatctcttttatttaaatccaatttgccctgtttcaggaggggaaaaagcagagaaagtgacgatgaaatttattattcggcagcgcttgtaatattattgcaactggcaggtcagcttctataatgatgtccctatgatatgcaatatgaatttatgatagacttcacatggttggtatatcattgtgaattccctagcaaacaacaacataatacacttaggtcgtcgtactaggcataattaaaccaagaactcatcaatattggttggagataattaagagagcgaggcccccacttactatatatgc

SEQ ID NO: 76069 - DNA, 993 bp, Oryza sativa
ccttaatacctttaaaactttgctatgtggagttaccatcatttatattagaaaatatgagaccttcttaaattttaataccttctaaaaatgataaaattgcccaattaattaaatgtaggtcatttcgtccagattttattatattatgatgataccttataaaccataccaaaaccaccttccctgagcctatttcgctcgtcgaagttatttgttgctgtctgcaaagttcggagatcaagactgaagtcatcttgattaaatgaccctgttgaataaaaataagtacatgacagcagtcagcagcccaggatatatatgcctgatcagatcggctgattttacagcctccagtttatcagccctaaaataataataaatgtggtggggagtgcaatattacgtacttagcttgttgcgatccatgtgtgttaatagtctcttcatcacaaattataataactatattttttatatatttttatcggtattcaatgacatactatgatcattaatgtattccatattatgttcccaacaaatatgaaattagtatcatatgaaagtactttaaaatataaatatagtgatataacatatatatatatatatatatatatatatatatatataatacttagcatatactacctccatctcaaaatgtaacaatgtccagattcatagctaaaaatacttatattttgggacgaaagggagtatgattagtctaattattagacaaaagttaccgagtttgatttttcttaaaaagatgtcgccctatgatttgggatggaggacgtacatcttactttgatcgaatcaattaattaattaattgactgatccattctaaagtaaatacaatcactcacaacctggaaaaagaaatgcagaggcaagaggagttacatggcattagtggcccttttgctggtctcctccagatgtgaatgacaaaaactgcaattgctaatatagcaacag

SEQ ID NO: 76070 - DNA, 568 bp, Oryza sativa
ctcgcccgtttgcggcgcacgaggtggatgtgcggccgtggcagtcgagatgggacatatcgtgcgcgcgttaactacgctcgccgaccgacgcgccatcatcatgtctccaggcgaaacgaaccggctcgtcccgattcgcgtgctactcgagtaatgtagcggtcttgaagaaggccgctcattattgtcggtcggttttcccttgctgatgcgcgcgatttgcgaccgctgggttcctgcccgcctgtagagaccggccccacctgtcaccaggcctaaggagtggcgtcacgcccgagcgcttccctcgaggggggcgatcgccctggcatgacgccgggggctactgtcggtgacatgggaccgagagtatcgtgactagaggcttgggcagccgcggtcacccatgtggcctgaccccctcggggggggggggggcgggccccagggtgacgtggcctcccctccctctgtattcccgaggggtcgggctgctcccctttaggccccgagggctggggctcccccaccccctgtggtattggcgccacgtgtgtgggttaag

SEQ ID NO: 76071 - DNA, 1528 bp, Oryza sativa
ccgttagagatgaatcaaatattattatacttcctccgttgcaaaatgttacaatctaaaatgagtcaagacaatgaatcttaggatggatcaaattccatactttagctccctttgaattgaagggaaattggagggataacaaaggaattgaaaccctacactattcatgcattttattcgtagaaactagaaaaggaaaaacgtagggaactttcctatttctacgattgtagaggaaaaacataggaaagttaacatccactctaacctcttggaaaactttccttgagtctatctctcttatctgattcatgcgtttttcctgtggtccaatcaaatggttattcttgtgttttgcaatcatctgttttacacttgtattcctatcagaatcctgtgtttttcttattcccccgttttttcaatcatggattcaaggggcctaaaattgcaacattttggtacggaggcagtacattacaaacttaataaatataaggaatatagaacaactatataaaacattaaacaatggtaatgtagaagtacttttaggaaagtcacacttttgtgccacgcgcgcatgattcataagttgaaagtgcatcactagtttatgtcaaatttcaaacagagtccaccaaaattcgcaaagtttcataaaactgtcactcttctggactcatttcaaacccaaaacaagattcgcttgaatcatatcgcatatacttcttcacatccattaccaaggttgattaaccacatggatatctttcgcaaacaaattaagcatagaaaaacaaaacaaaacaaaacagctagtagtattactgctacttgttgttcatcaacaccttgacgaactccttgtactcgacgcggccctcgccggcgggatccgccttgcgcaccatctcgtcggcctcctcctccgtcagccggtcgccgtgggacaccatcgcctgccggagctgctccgccgggatcaccccgctccgcgcgtcgtcgaacacgtccaagcacgccgcgagctccttctccgtcgccccgcgcctcatcttgcgcgccgccaccgacaggaacgccgcgaagtcgatgtctccgccgcctccgccgccgccgccgctggcggtggcgtccgccaggaaccgccgcgcctcggcctcgtcgacgttctggcccagcgaccgcagcgccgtcacgagctcgccggcggcgatgcgacctgcggatgacgaggacgatcagtggcaggttggatgacggggaaactaatcttggtggcggcttaccgtcctcgtcgctgtcgaacaggtcgaagatttctcggcactcgtccacctgttcttgggtcagcttggccgccatggatgagagagagagatcaagaatttcgcctaattgctgtgtcaaagcgtcagctggtagcaaattggaatggaagatttctggaggaattgaaaagaagcaaaggcgtttctttttgacaggtcaaaagagaattaaaaacaaattcatttgatta

SEQ ID NO: 76072 - DNA, 2353 bp, Oryza sativa
gcccagataggactcggtacctaaaagataaaaaataatactctcttcgtcccataatataagagattttgagttttttgtttgcactgtttgaacactcgtcttattaaaaaaaattagaattattatttttttttgacttactttattattcaaagtactttaaacataacttttcgttttttatatttgcataaattttttatataagatgagtggtcaaacactataagcaaaaactcaaaatcccttatattatgggacggatgagtatctatgaaatagaatctaaataagaagagtcaatttaaaggtgtgacaaatcattgaaacaatgttgaacacagactagagctaccacctctgttcaaaaagacataaaaatttcactaattttatgcttatcacctgaagtgggaagtggtagctagtgacggatctaggcatattttgtagggtaggccgactccacggctttttttaaagcatcctacaaaccttgattttcatgtataaattaacaaaatatagtgaaataatcacacttaaatacaaactaactaataattgatcttacaggattggattaaatttctgtttccgtcactggtggtagtaaaagccaagagccaacaaaccaaaccggtagtcctgaatcctgatccagcttagctcaacagcctggacccgtaccagtacaccacttgtatccatgagtgattgtgctcgagcatgtactgagattccagcaatgaaaagcattcgctgtcagggtctacttttcgttgcttcgtttggttccagcctactacctccctcaaaaaaaacaaaaaaaaaaactctaaacagattacgtgtagattcataatactataatgttgtcacatagcattccagatttgcttttatgggacaaaagaagcagacatgaaggcttgacagtggctatcagtacttgactagtcctgatcaaaggaaagctaacactacacattcagttcgtatgcatcatatatgcaccttggcatactaatttgtgaatgcctcgaaacataggagcacaaaatatagttgcgataattttgcagacatcagctaaaattcaaccaggatcaccgatcatcaaaacatggtcacatgggtagcctcaggatgcgggggatggctgcaaccattcaattcagcacgcaacagggaagtaaagatgatgatagaaaggaaccaggcaatgcatatctgcacaacgatccaagaaaaatgatgaaaccccaacaaatcctatgctccggcaggcgcaagataagcatcacaatcaaaagaaaccaggcatctgatgttgtttcgcatgactagaccacctaacccgatcgctactcaacattaccaccagcaaagataggtacttaaaaggaacatcacaaagtacagctttgttgtaggccctgacagttttagttcacttcagacagaacttatttaatgggaaccctcctcacttggccatcatgaccttaacgaactcctcgtagttgatctggccatcgccatcgacgtcagcctcacggatcatctcgtcgacttcctcgtcggtcagcttctcaccaaggttggtcatgacgtggcggagctcagcagccgagatgaaaccgttctggtccttgtcaaacacacggaaggcctccttgagctcctcctcagagtcggtatccttcatcttcttcgccatcaggttcaggaactctgggaagtcaatggtcccattgccatcagcatcaacctcgttgatcatgtcctgcagctccgcctcagttgggttctgaccaagggaccgcatcacggttccaagctccttagtagtgatgcaacctgcacaatgtattcagagatcagcacaagagagtactaaatggaacatgcgattatctcgttcaacgcttataaaattaacacaacatggtcctttagtgctgcaatattgtaatattgttttatgtccacaaagtacaattttaagaccaagaaatcaaagttgtcctgagtcctgacaacagagtacatacacatcacaaaaccaccatcagtatcgttatcactttcagccaatttatgaacctatttcacagaatgatagtgctagatagaatcattgaacatataatacaaatcacagaccactatatgctacagtccagatgagaatcatgaaacgataagaatgtgatgcctaggtttaacagccacttaggtagcttcccgccaccgcactagcatacgatcaactcataaacctacatcaataattattgtgtacactagatgtggcacaaatcacaaaccagcccagcttgcatct

SEQ ID NO: 76073 - DNA, 1737 bp, Oryza sativa
atccctctcttgactcattttctcatagagttcaggcttctaaaacatcatgctacaacaacagcttattaaagaaacaaagagagaaattaaaaaaaaagttgattgctttgatcagcatcaaacaacaagacctcctgcatttcacttatgtacattgtcagttaccatgagtttaaccaccattctttgttcgcttcgccgtggatgaccttcgcagcggcttgtacagcacgaagcttacatacttggattgaaaccggtgagtgactccaagagcaagcagcgactgcgatccccatcctttctcgatatacaggtggttgaggacaacatgctttggcttcagagtttgttcttcagagttatcagtatcaccaagaacagacattacaagctgaggtggcagtataggtggctccttggcaaactcctcatcacctgggagctggagatcatagctgtgttcaggcgacggaggagagtcgaatcctgccacgctgcccaggctttctgggatataatcctattcaaaacaaagatgtcttcagataaaaccaagagggaaatgcacatttttttttgcctttgcggttttaggttctctcaattttgattgctaaaatcaataattagcatattcttactgacatggacatcgaggaggttggcaacctgccctccctcatcagccacatgaggtagttcagggacatatttcggttccccatcgacgatgatcctgtaatggtatacccctgatggcagaactagcaatatggtatggtctttcccagacttctctaacaccctcctgacaataaaatgccggatttgtattttagcatcttatttctgaaatgtggaaacaatctgaacatgaaatttcattgttaaatagcatgtaccttgatgtccagttatcccatgatccttccacaaacacctcatttcctccttgactccatgagatcaaagttggaattcccttctcctggggatggttattggtggattcatccgattcatttatccatgaattgttgaaaacaggagaaaattcagtaggtatatgcagtggggctactggaacctgcaatgtgcacttgcctgtcagttcaagcaggactagcaataatactcaaacatgtgagttattctcactcccaaataaatacagattagcaacattcttaatatgaaagatggcaaaaggtaatagttgccaacttgttatggcacagttatagcaaactgaagcatgagctcatgacatatctcttccaatattacaggaactgaaacagttaatgatgtattgatgtgtaacattccataggtcaaaatgaaattgatgagaaagtgtgtgaagactggacgctgacttcattctacagggaaaagggagagcagttttaactgggactaaagactctaagagtaatatataataactgaagttgtacaaacatttgtaattagacagatcaaaatactagaatatattcctcatatgtaactgaagtattccctgttaaattacttgcaactcatcatctcactaacatgttggtccagggctcacgtgagatatcagtggcaaataagggaacatggagtctttcaaactttcaacgctaaaaataaagaaattgcccaaatgcagaacaacacagttttcaggattatgaactagtattactccaagaaccagccatttgacctttgtgaattgta

SEQ ID NO: 76074 - DNA, 2440 bp, Oryza sativa
tattgcggtgaagtttttttatatagcaacaaggagtcaagaacacactctttgagaatatcggaaagagatacaagttgcggattagttatagatctgtaagctttagccctcagcttcagcttctgctacccactaaccctacagttgaaggcttgaagcaaagtgagctgccatttcaagtttatcaacactggatggatcttgctgaattctgatgagtgaaagaagtgaagaggattcatagaaaattcacccccttttgtgtgtgtgcgcacaaccaagctcgcaaatcgcaaccagtgctaatgctaaattgccaagctaatcaaacaatctcgacaaaaaacaagaactcgacatcatcgagcgagactaatttagcaaggcacaatcgaggaggaaacactcttttacggttttaccacgcaaaagccaccaagaacatcaaatcaaaaggaagtaaaaattaataaaaattaatcaccacatctcacctgcggcgtgaagacgtagggcaccgggggaggcagctcccgcatcacggcgtccggcggcataagcggcggcggagcccgggccgctgcccccgccgagccagccactccggcggcggcccccgccgccacgtgacagttctcctccccttccttgccgctcgcgttccccataccccgccgccaggatccctcgccgaccccaacccacagctactcgcctactccagtactcctcccacctccaccaatcaaaccaagcaagcaagcagcccaactcccaccggcagcagcagcagcagcagctcaaaccagacacgacgagaatgcggacggcggagggaggagggcccccactctcgcgctcctcgccgacgtggtcgccgcgaatctcgcctcagccgccggccgcttcgccggaggcaggggaggaggaggaggaggcgatataagaggcagtttggcacgtgggtcacgtgactcgcacgccgcgccacgcccgcacgctcgcggcgccggctttaatttccggcggatttcccccgccgttggatcggccaagtttatttttcacacatatcccacccgttgcaataagcgacaaaagaactagaatactttcacgttattaaattgtagttgtaattattttctactttaaacactccccagatatttatattcctaccaaaatgcttgtattttaggatggggagtagaaataaagttatttcgagattaacatgagaggtgaaaaatggagctatcctttaattcgttgtcctaggattagcatcttcttctagattgagtgtttttacggatgaagtaattagtagtctggattaggatgatgcttttagttggtgtgtttgcggggatagctattcaatttagtcaaaatttttggctttgcgatgagaatattatttttcaaagatttggatagagacagcgagaaaacaatactagtactaccttatagatgtgggaatttcgcatttcagcagtactacttctggatagggcctgcttttctctgatttgttgcagtccttccgagagaggtcatgtactactactatttaccctatttatcagctcactcatataataattaacttttccctataaatatatggtacacatgtctgtctcacagattttcttggttcctatatctaaaccggctgtaaacttacagcccgcttctcatctctcttctctcctctctcatccacctcagcattcaggcttcttatagccctctattatacttgctctaagcacagtgaatgatgacattcatgatttttctttttctcttttaaaaaaaagaacagcttttaatcaacttaagtcttagttcgttctgattgtattttaagtcttaagatgtagattgtattttggtttttgttagcatgttttaaattattaaacgatatgtttcgtacaaaagttttctatatagaagtttctctaaaatatcaaataaaggtatcttttgagtttgtaataattgaaacttaattaattatatgttattggttttcttattttatatgctcttaattttgtccaactataggttacaagtggacattaagccatcaccgttaatacttggaggtgtaaactttagtagagttgaactagtatgcttaataaatgacacgaccgaaaataatatggatgctctaaatatgaagccgggaaagaatatcgtaataaatatcatggagagattttgtgaaggacctactcggaaggcttataattggtccaatttcggtgtaaattattcatgtaattttctttactaaactcaaaagtctgcttgattgaccgtgcatgcctagatcagtccaggattatacacttcagtcattgtttcgtttatttatactcttatccgaatcacatgttatcaaataaaaagc

SEQ ID NO: 76075 - DNA, 19058 bp, Oryza sativa
  unsure (1)..(19058): unsure at all n locations
caaatcgattcccgcccatttgcgggtgcgcgcgtgggcgggaatggcggggagggcggcgacgtggggacgcggagtgggggtgcggatgcggaggaaacgggcagcgtggggaggtgggggcgccggcggttggagctcggctccaaccggctggaggaggaagacggggccgataggtgggccccacctgtcggtgacccggagagaggagggagggagacgtgggccggcccagcaaggaggagggcggcgcgggaagagtgggccgacggcccaaaggaggaaataaaagggggaaaaggaaaaaaaagaaaaagatttttcctaggattatttattgcggtttattgtttttaattgattaaaaatatttcgagagctctgaaaattccactaaaaatcttgttagcgaatttcgacatgtagaactcaagaaaaattccacatgccaattccgattattatttgcatttattaatttgaggaattagctctaggttaaattaaacaatttcttcggacgatttattttatgaattttaaagcaaggagaggaacttcagggcgtgacattgaggcattatctgttgtccaatgaatgcactgtcatatgtaaagccgatgttgttaagtacatgtcggctccaattttgaaaggaagggttggaaaatggatattttctttaactgagtttgatcttcggtatgagtcaccgaaggcgatcaaagggcaagctatagccaatttcatcgttgattatcgtgatgattcaatcggctcggttgagattgtgccatggactttattttttaatggatcagtttgtactcatggttgtggtatcggcttagttataatttcacctcggggggcatgctttgagtttgcttatactattaaatcttatgcgactaataatcaagctgagtatgagacagttcttaaagggttgcaattgctcaaggaggttgaagccgatgctattgaaatcatgggggattctttgttggtaatcagtcaattggcaggagaatatgagtgcaaggatgatacgttgatagtttataatgagaagtgccaagaactgatgaaggaatttcggctagtaactttgaagcatgtatctcgagagcagaatattgaggccaatgatttagctcaagaggcatcgggatataagccgatgatcaaggatgttcagattgaagttgctgccatgacggccgatgattggagatatgatgtgcatcaatatttacagaatccatctcagtcggcttctaggaaattaagatataaagtgttgaagtatgctttattggatgatgagctttattatcgaacgattgatggagtattgcttaagtgtttgagtgttgatcaggctaaagttgcaatcggcgaagttcatgaaagaatttgtggtactcatcaatcggctcataagatgaagtggttacttcggcgtgcggggtatttttggccgacaatgttagaagattgtttcagatattacaaagggtgtcaagattgtcagaaatttggagcaattcagcgagcaccggcctcggctatgaatcccatcattaaaccatgaccgttcagaggatggggaattgatatgatcggcatgattaatccaccatcgagtaaaggacataagtttatattggtggcaactgattatttcaccaaatgggtagaggcgattcctttgaagaaggttgattctggggatgcaatacagtttgtccaagaacatataatctaccgatttggtattcctcagactattacgactgatcaaggtttaatctttgtgtctgatgagtttgttcagtttgctgatagtatgggtataaaattgttgaattcttcaccatattatgcacaagctaacgggcaagccgaggcatctaataaaagtttgatcaagttgattaaaaggaaaatttctaattatcctcggcaatggcatactcgttaagccgaagcattgtggtcttataggatgacttgtcatggatcaatccaagttcctccttataagcttgtttatggacatgaagcagttttaccatgggaagttcgaatcggctcaagaagaacagagttgcaaaatgatttgacagccgatgagtactataatcttatggccgatgaacgggaggatttggttcagtcgcgattgcgagcacttgcaaaagttactagcgataaggaacgtgttgctcggcattataataagaaagtggtgcctaagactttttcggaaggtgagtttgtatggaaattgattttgccgattggagctcgggatagcaaattcggcaagtggtcaccaaattgggaagggccattccaaatacataaagttgtgtctaaaggagcatacattggtgtagagggagcagagcgcgacgcctcttgcggtggcggcggcggacatctccttggcgatgatgcaggtgcacctgccgacgttgaaagggagagggcggcagaggagggcgcggttggggagcgtcgcccatgacgaggccagcgccgcctcgttgtcggagaggtcccaagcctcgtactacgacgacgtcagcggcggcccaccgcctgccctgctcgcccgccgcggcttcctgttggggacggctggcgctcgcggccggatcggccgccgccgcaggccccattgccggccggcggcgggataggggggagaacaaggggaaggggcggcggcgaagcgccgtgggtaaggggatgggaggatagagtttgggagtcttttactcctatgccattaaaaaagtcgctgctgacttatgtacccaaaaaagtttggagtcatctgtatgccatgagaaaaactttccatttcgtccaccttctgttagaactgaacggttccatagctctgacatgtgggaccatgtatgaaaatgactaatttgcccttaaggattttcagctctattctcctctcttgctatctcccgagagtgcctgctctctccccgttgcgctgcacgccgccgcaccctaaccctagccgcacgccgccgccgccgcctcgcctcgtcggagtcgtcgtcgccgccgccgccgccgccgtgcgcccagggcggcgcgcccctacgccagaccgtcgcgcctcctcctctcctccagggcccacgcgttcccgcgtcctccctcgtcgcgcggcgcgtgggcggcacgcgcagcgggtggtggttggtctgggagggcggcggcgtcgccggtcgccgggtggtgcggcgctagggcgcagattggggccgtcgcgccctccgtcgatggccgccaccgcagctgagcgaatgagatatttgcggtggtcacgtaagattcgaatcacgatgtgctagctacggctactgctctcgtgctatctctagatctctcgctctcgctctctcgtgtggggtttcgagatgcatctgtatatagtttggagttctcgtcttttgcgagaaacggaatttggaattatgcgatggatatgccttcgtcatggatgctgcagctttctctctctgtgggtggaaggtttccctctgcaatctcgaagcagagctccatgtccagatttgatggagctggaggaagtcgtgctaatgctcgcagttggtcactgaccacctttttcgctgggatattatttttctttcttagaagtatctcctggtggtttgatgatgatgtcattctggctccttcatgtgttttgtgagccgccaacttagaattggtgccctttggaagctctatgtgtatgcttgattcgaagcattaaatacaaaaaaaaaagggcatatgcttgtgttagtgcgaagagtaaaatgtgctgtcgatgattattcattttttatgtattggacaataatacctgcccacatgaattcctgtcactcacaccaaactacaatatttgattacccgttatttgtcggtatgcaatagttatgcacctgttttttcttttttacaaaatttatttccgatttttccttattttttccaccattttctaatttttcccacattttccttttttttttcccggattttaaacatttttaaaatttattctcacttttttctgatttttacccttttttaatattattttccattttttctgatttttaacgcctttcctaaattatttttcacttttctgattttttaaacccattattatacaaagggcaaaattgtctttacacagcccctaacacctctgttatgtctccatacattcaaaatggcacacaggtcaacgaaagttgggctcatggcatacatgtaactccaaacttttttaaggcacacaggtaagcagcaacttttttaatggtataggggtaaaagactaaggggtgggagctggaaggggaggggataaatatgatgttttttcgtaacaaacctcgtatttttcatgtttacagcgctactcctaggagtagaactctatcttcttcgtgttctatttctataaaatacaagggttgtttcgtataaaacggaatgtggtgttagtcgatgggaggacgttcgcgctattccactcaaacacgagttgttttttttcgcataaataccaacacgtgtcatttgtttcgaggagacaaaacgtggcacgcatgtagtgggagaccggcagaaccggtggagaaaccgaaaaaaaaaaagaggaatggctccacagctcacccaatcgaggagcttctacaccctacatactacatatcacacctaacgaggagaaaaaaaaaattcaaataagagcaaggataatagtataactcacttcctactattagctcattttaaagccaacatatataatagattagttataaggttggctatatttttcttctcttctctctatctctcacttatgcattcaatatatttgtcttggagcttgtgataagctagctcttgcatgagagcccacacctttgattttttactatctctctcctccacctaagtttatagtagacttatagctcactattatacttgctctaacaccacacaacacatgcagtccaacacgtaatcaagcacgagaagccaaaacccaatttcaaatacgtgtcactagtaccgaggagccaaaaaaattaaaaaaatgagaaaatcagtagcactaggggttttattaattgatgaggtacgtagaaaacggagtggtcgattagcgcgtgattaattaaatatttattattttaaaaaaatggatcaatataattttttaaagcaaatttcgtatagaattttttaaaaaacactgaattttttaaaaaaaaaacacacatcgtttagcacatgattaattaagtaattattttttaaaaaaaatagatcaatatgattttttaaagcaactttcgtatataatttttttaaaaaaaaacatatcgtttagcagtttaaaaagcgtgcacacgataaacgaggaagatgagttgcaaaggtcaggaaaagaactcaactgggctacatcaccattgtttggtactatgtcaactcacctcaccatttgctttgccttttttttttcttcttttggttggagttcatctgttgtcctacaaaattttgcaatattcattttcccacttggctcctaggttatttatttgaggaaaaaaatcaaaattctaatgtgagctttcttcttgcaacccaagttattttaaaccgaacattgagccccctaaagattctcaaaagatccgagcaacccccaagtagatttgcttacatgctgcattaagccattgacccaacggttttcattgctaacaggctgacctaattatatcttggcatgacgctacaatctttgtagttgtgacattgtattatggtatttctagtgttgtcaaatacaaggttacggttttctgtttttcaagccaaagaccacggcttaaaggtgcgtaactgcacagtaaccacgaccttacctttaagatttgaaaatttcgaattcaactttttggatatgaaattcacgtggttcgtgataaccaccgtaccgaatgtgggatgaccgcagggccggacacatcctctaatgcaacgtgtaccatattttaggaaaccttctgctgcactacatgaaattagcattagcaaacagtgctacgatgttcatcgacacattgttcaatcacatgaaaattaaaattactcagcgagacagttaagtacagtcaacatacagatgcaacagtttgcttctatttggtctttatcccatcagtacctttagaaccaccatcatacgcagaaaggaagaacgaactctgattcttctgcagaaacctaccatgaattcccaattgatttagtgagcattttggcataaagtatgcctaactatcagggattgctacaatctggttagcacgtgattaaaattatggtattgaccggaaaattaattgtgtgggacagattttcaagcatgttttcaaaagtcggctaacttgagagatgctagtatatatagaagaaaaataacggctggaaattgcatgaagaaaatgaaggtgctaacatgatcttgcacgatatgttggtggtatatgtgaatgggaacatgaaaataatgcgtgccgtataggtgaatgtgacaacccaatagaagatgcaagnaaaagatttttgcgttgacttgaaagagatggtgccaagccagattttnctgcgtagtgagtgttgtngtgaggtggcgattcttgctctnccatgggttgacagcagcgnncaagtgaagcgtgccgggcaaatgttcgacgtgcagagagtcagcagaagaaaggtgaagcgcctgttgcaagacagttgtgactcttgccgttcgcaaagttattcgtgtgctcgaacatgcctagccgagcacaaacacatctcatcgttaaaacaaacatccttngtatttcattcaaagctaatgagggaaattcgcaatttattcatacttgtgaacaattatccagactctagttcaaactataatagaatacacaagggtcacaatagtcgattttaccctcttcaactatagccctaacctaaaaatcaaccctcaactatgaaattggacattttcaagctcaactaccaaaaccagttaaagcactaccaagagcaatcctaacaatttgtttgacatggcaactatttctacattgcttgcaaactaggtgccatgttagcaaaaaagtagataatttggatgccaactctgcaaaagaaccactgtacaaatcagattggactgatcttaaggggttcttttgatagttcaggggtgtacaccgtattgtttcatggctaagaattgatttctagactcaacacaatagatgaggagggtaaaataaattttactcagtcacaacaatgaattcaaaagtgaaactgatataattggtttcaacaagcgaataagtttagaaatgaaataaaaccttgaagaagtaaatttatatgttacattcaggaaggaagtaaacttttgaacagacaataaaccttgttcctaattgtttccttactttactgaataatcattcattggtggatatctcatgtaatcaagaactgcacataccaaaaaggcgcagtagatgctcagctccatatatagttgagggcgaaacatcgcctttaacctcttcagagtactgctgtcgctctttcttatacaaaagcattgcaggcaatgctttatcaaagtagcatcgcaatcctttcaaaatctcagcgtaagagtcatttatccttcagtacaaagtacaaacaatacaaagttttaatgggtcttttcaagaaaaataaatattttttaaaaaaacaagcttgacagacacagatgatgcaaataggttttggataagaataacataaaatctaaacctttgttgcataaggacagaatttccataattatggttattaatatgaatattaaaatgattttaggacatttcgatatagtgaaatttaaccagaaagagttaaaggtcagttgatggttttcagcatagtacaaagaaaaaacggcagaccagcagtctgaccataggaaaccagaattggcaacctcaatggttctgtttgcttcatggactgttcatgcaattagacaggtaaaaacaggcaaattctgggttacatgtgaaatctatgaaccatgaaaatcttgaaccatgcagccaatgtgcaacatgaaacatttgtccagggcatggaccaataaatgctggaactctccttgtgaaggcacacagtacaacagaaataatcccaccggtgaggcccagccactgaaccagaacagatgcatttcaatagctggtttgacttttggtgctttggttttcagtcatgttaagtaagagaatgacatgcacatagtaaacatactgttggattatgctgcacataataatcagtaatcaagcgcacagaacacataggatgaattacaaaccctaagctaagagtgggaattctgtggttgtgctgttgcaaaacaaagatagaaggtgccaggtgcagcaattgctgtttgcaatgttcacatgtgacgtggttacagtagtccacatcattagttgatttatttaagttaaatttatcctttaaccacaacttacaaagcatgctatactcagcattgttccacaaagatataattggccataggttttgtataactttggatggcaagttgattaatggcatgtgggtcatggggccaataaagtgtgtgccacactgccactaatttagcaacaaattggcctataaatgtcaaatttgcataagttttggcatattatgggtatagcacaaagatatgaatcaacaatacatgtcattcccatgtccgatacatacaggatacagccatatgcagcattccagtgtatctggacatgtcagtcaagtttagcatttaaaattaacaaaatgagatacagcaggcccaccatctgcgtctcataaaaatccacaattagcccaatgtcatactaagcccaaatccctctgtggaagcatactagaaaacttgagaaaactaatgagcattcttgaggaaatgcataatcagaaattcagaataccattttaaggtcgcattattcctagaagctatcctagggtgaaaacatattagttgaagattgaagggaaaggcggcacaaagacctgtccaaaggtgatagtccctgtctttgttttagattatcctgctatatgtggtggaacctaccacaattcatgaatattcatctgaatagccattttttgataaaaacctataatatactacacaaacgtaacttttcctagtttgtcagtgagtaatcttaaactcagcgattctcatgcaccaacatcctcctttttttttctgtttatttgttaaaattagagtaacttccaatattttctgaaaaatacatcaattctaattcaaaaacatgttaggctataatatctttccgcactttattttatcccttcttcaaattaagagaattataacttttctgcacctctgaaagtttactcgttcccttatttgcggctcattctctcaatgacatgttggtccagggtccacatgtcagcaagacattaggggtaaagggatcacatggatttccgagtagcaaataaggaattgcactaatgacactaacatttgtttaaaacatcatggtgtatgcctcaatacctacagtagaattccgaatcccgtactgtttataacttgctgtgtcaaagatatgccaataaatcagaatttatgtttatatagaatgcttacttgttatccttctttgtccggtgctccaagtacttctttagaatatcatcgaccgtgggggaccgaggtagcttcacaagctgcagtacaaggaaattggctcaggaaaggaactggtagaatgataaacagttacagttaactttggcatacatcactgaggacaaactcatcgtattcgtagttttctaacaagtaccttttcacatcagggattagtgcaacataatgacttgaaacactcaagtctatctagttgttagtaattcttacttcttgaaatagtaacctttttggggaaacttaattcttataagtttccttaacatgagaaatgaacatgacaacatattggcatcagtcaatcatgttcaaaaagatgcagaaagtccagctccacagatacacgaaatatacaaaagatacacaatataactaatgatctaggtaagtttgagtggtatatatcaaggttgcttatctaacagtaaggtggtatatgtcaaaatttagctgcggaatgtacaatgaacaatatatccactggtcaagattgctagtctttttttctgaacgaaataaagatttcaagtattcattctcttattggttcctatttgatacaaacatgcttctcttaagtacctgttgttcccatgccaactcagacacaatattcaattataattgaacaatgaaggttgtgatttggacataaataaatcaaagacagctcagggaaagatttgaataccttacccagctgcgtgacaaactcccaatcatcaacaagttgcttttttagcgttgaaggaaaatgtgacatgaagagactctcagatgattttctttctttctcctggatcaaccagggcagagttgtcattatgtttacaaatataccacaaaacaacttgatagataaaatgatctaccacatgcttgccaaatatagctgaaagcttcaaaatgttaagtttgtcagtctccataaccataataggtaggtaacgaattctcttcgcacaatgtaaaacattagttcatagttccaaactaccaatttaaatttaacatgtgttctaaatttatccatactaacaattcttacacagctagattatttttgctggtaagcaaacatcatgtagtccagaaatcggattgttgtgtaaagaactaaacgaagcaccgaagcagcaagatttcctaaaattcatcattacaattttagaaatgttgagaaaatgaaatagtcatcatcatacaacaaaaggtcaagaactttaagtgttatacttatattgtaaaaagagaagaaaggtccatatggaccatagaatgttcccattttccacatgtatgatgaaaaatgaacataactgccaaatcatgtacttcctccgtttcacaatgtaagtcattttagcatttcctatattcatattgatgttaatgaatctagacagatatatatgtctagattcattgacatcaatatgaatgtgagaaatgctagaatgacttacattgtgaaacggagggagtagtactagaaataaaaagagaattaataaaaaagtattattagttcaaaggagcagaaatatgcttaatatcagtagtttagaaatgatatctcaaaaggcaaattgcagtatcataattgatggaaaatgaacttcatggaaatcaaatacttcacaataaaacatatttgaaagtgagagacacctcagtcccaccaggctgacttttgcgtttcttccccttgactgcagttttaacatcacagagatcaaatgtaataagtatcacacaaatgagaagaaccaagaactttgaaaaatgtacgagtgaacttactaataatcttggtgtcttctttatcagtttttgcatctgctgaatgcaattacaataggtaagacatatttaagaggaacaaattacaaagtaagacataaaatggaaacccatcctttggtggaagcatgggaaaaattttggtataaccactataacagcatgggaaattccattctcaatgtagcaaatagagtggtagcaccccattaagaattcaacttcaaattgaatgtgtcagaaacaaaaatatttgttgcaaataggaacttctattgcaaataggaacttctatgttttctttccctttggtttaccatttgtcatcatttcttatttctagaagtacaaataaaattgcagttcaaattcaataaacagatagtttaacaactgaaaagaacatatacaacgttctgagagttttcatgctgaattggtgtcaaagccatggcagttttcatgattggactgagagatagtttccaccataaaaaacagaaatatgatcatgagttcataaccacaccgatatgaaaaaagatgaatgggaaatttcagaatgtcctatatgcacagtaccaacgcccataacagtaagctaccacgtacttgtaccagaagctatcacaaaattactccaagattggttcataactccaaacttcggaagaaatatctccaagggtgaagtttgagcttaatccatcaatgtaaatgatcacagcattcagttataaccatcacatattcacaatctctttgccatttggcatttctactcttttaagtacagattaagcactgccaggatgatgcttctattagcaaaatacaaaatttatcatagaaacatgacactcacagctacagaacaaattaaaaacaacaatttggcaaaatagttcctagaaaggaagctcccagtggaatagtctagacatgatccaacagcacaaacattgatttaacatacatctagcttgtcatggatagaagtaaaaactattgacccagtaaaaaaagcatgtgtcatcaattccaatggaaagaagagggaggcataagctaaccattagagccttttggcttatgctgcgctgaccgtccagattttacgcttttgtcaactacttggctcttttcaagctcttgttgtttgcggatattttcgtcggtcaatttcagtaagcgatcatttgtgacccattcatcccagctgtactcattgaaaataaacatattaagaagactgtttacttgaattaggagagcagaaagacaactaaatagcatcagtgcaatgatagaaacaagcccctcaacaggattcatgaaaatactattaagaaaaaaaattgcaccgtaagggcaaagatgtgagactacccaaacatggtggtagacaacaatatggcactgccagaaaaaaaataatacattagaacatgcataaggtcattcatatccaactcaaggtccaaaatccaacttagacacttttaaactgtcaagggcctcagtgaaatttttcatccagcacaactattaaaaaaatttgtgttgccatcacttcaattcacacgtagaaaatggattggtcatatttaaatatatgtcagtcatccgggctccaggcactcactcgtatcctaaaacaaaagtcaacaaaacgggtataggatcacttccccaactgagacacagatcatgttctacagatgaattcatcaacataatcattcaattatcatatttaaaattatgttccataaacgaatctaatggtttcatttacaagtgaatctataaatagcatttgatatattggtggtcaaaactataaaagtttgattcgatggttttaaaaaacatcatatatttccattacacaacaaagagacacagagtagccagagcctgttctgaattctatggattttatatgatgctatgatgtagttctgaattaatcagattgaggccagtgagatgcacgagaagctttgcatagtttcactttcacatatctcatgctactatatgtaataataatatcaattgcttgatagaacaaacatcaaatgcatcatataagtacaggtacagatattccttgtacggttaaaaaaatattcacatcaacataaagaactcgaaagcattggtaataagttattagctaagcatggaagacttatcgatcatccatggtatgcacttgcctcttattccaaccctacaaaagaaaagagaaagattcgttggttcctcgatatcgaaagggaacacccaaagttaatgatttatttttaagcacttgtcatggtgtacaatggcgacagagacttaggggacttacaagataatggacatgataccgccactcatcctccttgttttcggacttttgaaccttgagaaatccaaggggggagggaaatgaagacaatctattagggaatgcaattaacaagcaaaagaaaggctaggaaatgatgaacggaatagcacagtgcacagatatgacctagactagactagcagaaaagcacggcaagcagagggaatttaatttcctggtgcggaggattttgcacagtaattagtaaattactaaattcccttggtaaatactagtaatactagtaaaaatttcaaagtatcggagcggagcagcgcagctatggaggcgaatgcttgtttgtttgattgttttgtttggtctgcatccgaattgggtaaatcctagcgccatttcttcgcaaaattaaacgaaaccctaggttggattggagcggaatggaacgggagatagggggggagaagagagggattaaggagcggaccttggcctcgtagaggagcgggccgtggtaggcgagcactctctcgccctccttgaacgacggctccttggcagcggcggattccgatccagcttgggacattggtgggggtactttgggggaacaaacaaactgttgcttgtattgaggtttagggttctgaaattcggagaagagctccttcttcttccagatctagaagaagagaagctagggttaacgaacgaacgccaggaacgacgagagatgaatcagaaagaggatgtggatggatgctcaccaggatctcctcccctctcctgctctgctcgccaggaacgacgaggagacgggagatttctttcttttacgcacgagcacgagtcgtccaagaatctttagagagagatacttcaatacacagcactcacttatcaggaaaaatagagaaaattgtgattttgctatcgcgctggaatactattccttcaaagtgattcattaaaatgcaactaagggtgttcactgaaatgctattttgggtctttttggtttctagaaatgatttagctctattttcatttttgttcggaccaaaatacccttgccttgcctcagataggtttttaccggatggaatcgatctcatcccgttggcatcgaagctaactgaggaggagcgacatcggcagcggcgacatcgtcgcgcctccgcattgggtccggctccggcgccggcgccggcccccgccactctccgacctgctcctcccctccctcctgccccagtccactcgcgccgccacctcggtaatgacctcggcaggtgtcgacgaagagcgtggaggcctcaacgatggcggccgcggaggcgttggcgttggcggcagcacaggtgggaaggagcgcgccgagcctagcggtgttgacggggaagccgaggaggagcgagtcgcggagcaggtggcagaagcacccctccccgccgtcgccactgggggagacgccgcggaggaaggccgcgcagcgggcctccgagggcacgggcgcgggccgcgcgggcggcgccaccaccgcgacgtgcgccaggcacggcgccaccgacactatggtcgccgcgcacggcgtcgccggcggcacctccgagatgacggggctgtgccgacaccaccccggtgccgggaagacggggacgtgcgccaccaccactgctgccatgttcgtccgctcgcgtcgctgggtcaccgcggctgtcgccgaaacgtcggggtgctcgctaggtagacgccggcctcccctccccgccacgcctgctgcgccctccccacgcccgccggcggcagccggccatcgccgctcccgagagaggggaaaagagagatgagtgagtatgacaggtggggcccgcatcaggggtattttggtccgaacaaaaatgaaaatagagctaaatcatttctagcaaccaaaaagacctaaaatagcatttcagtgaacacccttagtttaggatagcattttaatgaatcactttgaagggatagtattccagcgaatccattcttttgcgatagcaaaatcacaattttctcggaaaaataggccaagtagaaatactccctccgtgtgaggttataagatattgattttggttaaaatcaaactgctttaaatttgactaagtttataggcaaatatagtgatatttacattaccaaattaattttattaaattaataattaaatatatttttataataaatttatcttggttcaaaaatattactgtttttttatataaacttagtcaaactgactttgacaccaaagttaaaccatcttataacctaaaatagagggagtagtaagttttagagggttatgaccgttgcaatacaaaccgccaatcagagctcttttatctagcgagtgtgttcttttggatgggttagattaacacatgattaattaagtattaacaataaaaaacttgaaaaataaattaatatgatttttttaaataacttttctatataaaccttttacaaaacacgtaccgtttagtagtttgaaaagtgtacatgcgcgtttgaaaagtgtacatgcgaaaagggagatgagtttcgaactcattagagagaaggggctacgttcttttgttgaagatctcaacagcaaggaacgaacgcaacccagaagttccgaggggtcaatgagattcgttgtaccaggagtagggagtaggtgagaccaaacaacttggtttggaatttcttttattttttagactttgttatatttttttaattttattaatagacatttccgaaaaatatttttgagaattgaaccttttggacacgctggcatggcaatatgacattgctacgctgctacgcgtggcgtaatttagtaatacacttcgaaaaggtctattaataagataaaaaaataaaaaaaagtctaaaaaaaaactccttagtttgacatccaacttcacctcttctaaagctaaaaccgaactaaataattttaccaataattttacctccacccaaaagggagcattatttagctccacccaaaagggagcgaaataggctagagtgttctcatgaaatgaattagagaggtgatgctacattgtagaccgaactaaatagttttagctccacccaaaagggagcgaaataggctagagtgctctcataaaatgaattagagaggtgatgctacattcattgctacgtttcacaactccactctagatccagctatgagaattaaatttaaaagtagagcaatgctaacattgtgttctttgccctaagttcctaactcacatctatcgttttccacgcacacgctttttaaattactaaacagtgttttttcaaaaaaaatatctatagaaaaattactttagaaaatcatattaatttatttttaagttgtttatagctaatacttaattaatcgtgcgttaatccatagctctgttttgcgtgtggagattgattagttcccaaccctcctccaaaagaacacagccaagtaggccctagaatactgacttaaaggttgaaaaaaaaggtattttcttctttgcattggcattatcctattcttgaacgggtggatcgaaatgttctggtaatgttgtactgccagaatatatagatgtttctgtatcgagtgaaacccccatagtccatactatccatgaaagtaaatgcaaagcacaacataaccagatctgtacaaacgaagggcaatgacaagatgcctaatgaatcagtgaagaacaaatagtttgatttctgcatcctaagatggtgtcctagaaatccataataggcactccttcctaagaggagaatccgcaaatattgctttgacaaaattttgtacctgcacaaagtaagcagatttgtgtaaatttagcctaattatattttcagttttagaaaactgaagtatcaaaataaaacaaacatgatagtaaacagatttctaggactatcaaagaaaactcgtgactccaaaggtagcccaaaaatctactcgctcacctcagacgatgtgaaaccacaattagttaactccccactttcccaagcggccgtgatggatttcaacgacatatcaagcagctctgagtaatattgtagatcactttagtattttcttgaggggaattaaaaaaacattaaacatatactatgaaaatcatagcaaggtgaaatatacccgctagcttccggaacttcttcaaaggtcgtataatctcatccaactcgatccaagtttgatggtccaagaactcattctcaaccagggacagaaatagtgatgagaggttttcaagagccaaatggataagaccttgcagctgtccgcatatcacatataataaatatcaagaatgatgagctcaaaccttccaaggataatatgtctcacctgtaatgtctcctctgctgccatgtcatctattaggagcatatcttttgtaattctagaaaagacagatccaaggatgtaacacatacttctcttgtaaattgatcttggcagtatcgattcccacataatgtgtattttttctaaaatgaacacaacctgaatggaagtcaatatataccataataatgcatcaatgtgcagaagtatgacctatattttgtaactcaaatttgaagaaaaatcaagacatttagttgacagattgaattggttgtgattgatgattttgcgctagataaagaagataattgtgattccattgcaggacatggataagatgttaagaacaaattctattctactgttgaccactccaaaagtacagtaaccggtctaggttattcactactatttctacaaggtccaagtaactgacatctttgcaatgaaacatacctgctcaatactgaattttgctgattcataatgctgaggttgg

SEQ ID NO: 76076 - DNA, 3556 bp, Oryza sativa
attcctgcagccccgctttttttggtttctttggaataatgggcatgtggtgaaccagtcatgagtaaatgtgcttgggacaaagtctcaaaggggataattcaatccatttgtcccagacagcacatttggttggggaaagacgaatctttatataatatggagtactccagatctgattagctaagggtgctaccatgaagaaacttaaaaagtgtgtgcttctagaggctcataccacatatgtaaatatcatttcattcattttcatctagcaaaaaaacacccaatgcacctctttcctgtgcatacaaaaactcggcacaccgaaagaaggcaagaatcacaataaaagaacacaaagaaaccctatttttacatgtgtatgaacaccatctctacatcgcaaagactccaagaatacagttaccgcagaatagatcaactgtatacatactcatccgattgtatgatcctaataagctcttgcagattatcaaatacgcgccttccagagctctcagctccaatgtagttcaaaagctgctctgtatcctaaccacccagcaaggaaatgatcataataacgatcttagtttatggggaaaatagattaaacaaacattacaacaaataagcagccagaataaaacattaagggggaaaacataccttgtgcaacaagtagattgcataggatgccttagtggggtcatcttcttgacattccacgaaaagggggtaaactgtcagttttgggtcggtcatgttgatacatgtacgctctgctgaagcaatggatgctgtttcagctgaaggcaaacaatcactcacataagatcgcgatcctccaaagtgcaaagggtatcggaggggaacatgaagataggaggctatgagcaaaattgcctacaaaaaaatataaaaaaattggcaactggtaactctataacccttgagaaaaaaacaagcagtgatccagtatgtgcatgcaggaagatgaatttgaacatctgccatcattccttccttacaaatgttcaacactgtaatgaccacaaattttgaaaagcatgcattggcttattaattttgtgtttcaaaaagaatagaaggatgtatcttaaggccatctacaatgttaattgtgttaattgcctaatttgagcatgaaaatgagcatagctaggttggagcatccatgctatcaagtaatctttttaagggcaatgctacatcaagtaactgacattgatgttttatagtacaggacaggagtgctgtgaagacttacatgcgctgcatatcccagaacagctgcggaccgctgaagatccttctcacatatatcattttgttttcttctttgcttaccaatttgccaacccaaaaatgtcaaagcatgtatttgtggtagtttgataacattgagtagatgtgttccattctcttctggaagtgttccattttcttccgaaagagacctatgtgctcctgaaagtgttttgtagtttaacagaacgaattaggaaagaaattttctgccactgttcatcaatcctcggtagaaaaatgtgcactatctgacaggttaaccggtgtaattcttatgtcactgatatgctgtatgcaataatgcaatgtagtatgcctatgtttaaacatttttaagcagtacactccaaactctccttgtttgcagacaacaatatctccaaacagaatagcatgtggaacaccttcgccaacttagacatagacgatgcacgccataacgatgagggcagagcaataagtacagagatgggtagattcaacattaactcaaggagtgattcagtgaacacacatgtatataaacacacctggaaaataacaatagatacaacatccagaagatatcttggtctcttgtagtctttaccaatctaccggaaaagaagccattgaataaaagggcatggcaaaccaacctatgatatattcctagagcataaacctaaggcatcactctgctggttagcaatgtttaaagctccatacttctcatcagaataaacatacatatgtattagaaccatgcatatccttggagtgtcattgttcaagacatgagattattggattctcaccattagtattggaattgaggtttcgcccatgcggcagatcatggaataccttcacagggtacaatgcagcaacctggccaatcatactctgctgcctcatccttaacagcctctgcaaatccccaagccgcgccttctctccagacaacgcttctttcgcatcctgcaatcaacatcgaaaaatctccctgtaaacgcaggaacaggaacacacataggtactctcaattctcaatgcacgcggcatttgtgtcgattacctgcagccgccggctcgcggcggcgacggcgccggagaggcgcagcacgcggtcgatctgcgcctggagctgctccctgcggcggtcgacgccccgggccgcgtccctcctggcgaccagcaactcccccacccgcgcccgccggagctccacccgcgcccgcatctcgtccagcgccgcgccctgccgccgcgactcctccctcacctgcacacacaccgaatcaaatggccgaccgatcagccccccactcacgccaatccacacgccgccctagcaaagcaatcgggcgcgggcacgcaacgcgcgcacggcgcacctggagcgcggcgtggaggcggcgggcgaggcacgcgcgggcctcgtcggcggccacgagcctccccccgaggctgccgacgcgggcgagctccgacgacggtgggcccgccccggccgcgtcggggctcatcgcggccgcgggccacccgcggcggcggcggcggcggccatggaatggtatcgaaatggaatcgaatcgaatctgcgtgaagcgggatgcgttgcgggggagcggaagcaaagaggagagcggggtgggtggggtgatgacgtggcgcggcgcttacgcaaggggagggtgcgggttttggttttggagttggttcgtctggtcgattcgctttcacagagtttcagcgagtccgcgacgacgtcaaggctagtgacgttttcaaagccacgatgactccggcgagacagtgatgccactacctcctcaaaataaatctatttagcatctattttatagataccaatacaaaggaaaaagatctataagtctataacaatcttcctttatcaaatcccaatataattatttctcattttatctactcgtaatataattattctctaattttacaaattctgatgcaatgattgctttaaaaatgaacttattttgagacaaatggaaagagctactggtgaacttaatgtggaacggaggaagtaggtttcatcagttaattatgtttctcaaacagttaaacgatataattttttaatgataattttctatatataaaagttactttaaatataaatttatgtttcaattttaaaataattaaaacttaattaaacatctgacaatatgtcacacgagggggctgcaggaat

SEQ ID NO: 76077 - DNA, 4343 bp, Oryza sativa
tcaatggcacaacattgcaacatgtgccagcaaaatcttttgaattcgacagtttaacacacacaatagcagatgaaattcaacatagcacgcatggtaatttcgacatgaagaaaagtaaaggagtacggcaatatccaaactggaaatcctaataagagagatagcaacgactggctcgttcacgagcttcatggaataaaattcttggtttcatgatgagtttatccaagagagcagcaactcatgacaatctggcgtcagttacctggaattgcaagaacaaatatttttagaaaaaggatgatttcaaccataagcaagttctatgaaacataacatgccatcacaagttcacctttagtatccaacttgttttccaaaaacaattcatttgtgtcttcgaatatggatagattagtatcattcaaatagaaatatgatgtgaaatcatcttgaagaggtggagcatctccttcatattgtggcactaccagctcattagaggcagccatggagttatgtgcttcaaaaagatatcaacaaatcaacagctaaattactatataagtaaaagatgaaataagtaaactatacgaaccgaaagaaagttcaaagttatgaagctcttccgacgatactggactattgtgtgtgtaaaaatcaagatcttgttcccgatatcccttgcataaagggagttctgaagaatctgccataccttcacatggcatattaatagtaggactcaaactccctccagaaagctcttctttcatcaccacatagttcaatacatcagtatcatttagtaattcttctgattgatcatttaataaagcaaagtttgttaggtgcatcgcataagcccttgagtaaacgaactggttgtttggatcaaattggattaaagggagctccatctgcaaagcatcagttgtggacaaagcagagagattgccatttgaaataccatggttggcaaagatagaggctgcaaaagatggcatggtcttatcattagagttagtcacaaagtgatacgaagtcaataccaaaagcttatgtgtagagtggtttaggggatagctcacctgatggaaatatgtcattgttcgttgttttcaacacaggaagtggaatctcatattttgctacaacttctatttggtttctttgatcttctatggagtcataatcttttgatgcaagtctcctatcaagtatattactgatggaagcatctgaaaactggggtgcagaatacatactagtagtatcttctagatgattattggtcagcttctccctaacgttggggtcagcagactcatgttgatcttcattcaaagcatcgttgcatacattagcaggatacaaaggcgaacgattgttcttgcatttctttattcgagtgttccagtagttctttatttcattatcagtacgccctggcaactgagaacatgtggtcaagttaataacaatgataatagatagaacaatgcatataacagtaacaatgttctaaaacaacaactaagatagttatatgcataaagctagaccccaagtttcactttaacttttagcttgtcccacggctccttattttcagtagaactaaaccaggccgatgattgcaagtgcaatgaaaagatactagcagtttactttaaatagcaacccctaagccatacaagcaaaaataggctacatttctaagataatttcaaggatgggactttgacaatatttatatctgctgattagggttgatctgatttgtgatgataatcatattttaggataaacttgtaatgcaaaaactaccaaatattaattgaaataaatgaaatggataacatttgtttagttgaagaaaataacttcaccaacatttgaactacaaatattaataatacccatacctccatgtaaaggttgcaaaacatatttgtaatgcaactggaaaaaaaaactacccaactttaaattaaataactttaccaatggatgaactacaaatattaatatccccgtacctcccctccatgtaaaggtcaccaaacatacttgtgatgcaaaaactattaaagaacaacacttttataaatggtttcaagagatatatattttgagagcaaaagaaaaaaaaatgaactacaaggtaaacttacatcagcagccatccgagaccacttattccccattttgcgatgaagattaataattttattctcttcttccttgctgaaagcccccttctttaggttaggcctcagatggttcatccaccgaagacggcaactcttgccacacctcaagaggccagtgttcttctgcacaagcttccagttcctttcaccatgcttcttgatgtacttctctaagatggagtcctcccaagatgtccatggacctttcttcaacagcagggctacggtgctccttctgcaatctttatctttatcaacaaatgactcgtcatcgctattgctcatataccagtgtgtcctgtcagaatcaggatcgctgtcgctctcgtgcatcctgtcacaaacacgagttgaactatcaaaaataaaacagaaatatgtgtacatgaaaatgttaggtcagtggccacggctagcagagattaacaaatttatacccatataaaacttttacaaaaatcgccaaggtataaaaaaaaacggatacaacacttaatttctaaaatcaagaaatggagtgacgcctacttataaaaaagagtaaaatgcatggagggtcatataacttgttcagatgtgtcgtgtaggtcactctactttcaaaatgcacattaagtcactaatacttcctccgtttcacaatgtaagtcattctagcatttctcacattcatattgatgttaatgaatctaaacatatatatctatctagattcatcaacatcaatataaatgtggaaaatgctagaatgatttacattgtgaaacggaggaagtatcagttaagtgagtcattagctcatttaactatccaaatgatcacacttttttacacatgacatgccatctaggattgaaaatttgcttctagatatgtgcaaaaaaaaaaaccctgttttatttcccttctcctaacactaccccttgccaatacgcggaattcacaatatatatcaactcacatcgatcaattcgtggaagctatatgtactatttatacaggtatcgtagccatgaagattgcttgttgctaacacgttgtgcgctaattccgggattggctaatgatgtacggtaggacttaaacaaaatcacaatatagagggtttttctgcattatggagactattcgtcaaaacagccataagtgaaatgattcgattaaattaattaagtatggggttatttatgtgcagaagcaaattttcaatcatatgtggctatgctcatatttatagttaattgtgtcaataactcacttaactcacattagtgacctacatgtgcattttgaaagaaaagtgacctatatgatacacctaaacaagttagatgatcctccatgcattttactctataaaaaaataatgagatgcactcacagttccaatctcaactgagattggtaatttcagtgaagtagattgaaacgagcacagattagtagattacacaacatatcgtgcaagaaacagatccactaaaatctcttaggactattcccaacaattcaccgatcaaaccactaaatatgaccccccaagaaaagaataagcaacgccaccggtccattttttacctgaccaaaaatgcagggtgacggagcggtgggctgtcggagtgtggagtgtcgccggagccgggacaaaacctccgccctcccaccggaaatggtcaccggccgccactctctgcgacggaagagacgcgatgtgaaggggagttcgctgaggcgagatgggagatggagatgggagatcgcctcccccggcaatggcggagcggggagtttcgggggcggcggcgtgagcgcgagcacgagtatatgtgcggcaacgtcgcgtcggctgagcggtggttccattccaagtctatctcagtccaaatgatttttctttttttttaagtaaagaaaggaacgaattttatttttaatccaggccgtccgtttctctcctcttgacctagcgaatcagacggcttcggagcctcggatgcccacctgaaccggaagccgtactctctgttcgtataatcgtaccaaccgagatttgactggggagtactcctaatacaacaaatcattatgcccagattcattgagatacgtcacatcttgactctt

SEQ ID NO: 76078 - DNA, 9003 bp, Oryza sativa
atatatatatatagacacacacacgtatgtatgcaaatgcatatgtacatgtacaaaatagacacacacacacaaacacacacacacacatatatatagatatatatatattaaagcacttaacattttatgtgcatatatgacctatatatatatttacactaaagtaaatgtgtacatatagaaaaatagacatgtattaactacaattcattatgtcctagctaactacgacttcgatgtagaagtcgttagctcagaagctaacgacttatgaattgtatttccatcgtagtagaattcaccctcgggatcaaggacttgttcgttgatgaatcctatgagttgttcttgaaccgccgcgataaattccttgtgtgtgaggttatccctcgtgcgaataacctatgaatgtatgaaattaattagtaaacaacaaatcgatacgtacgcaatgaaattttgaatttatttgtacgtacatcgagctctcttgtgggtgatgatttgggttgtaaggcagtggcaatactcgcatacatagtagccgcacaagttagttccctggtcttgctttgtacagtatatatacatcacaaacggcgagagatttaattaatatacacttatatttgagttggagattcaatataaatgtagagcatgtactcacagcaaatttaaacttccgcctaagtttttctttccaattgccgcagaccaaatgacagaactgataccaagccctacatggagtttaaagctatgattcgtagtagcaattaatagcaaaaatcgtaataacattggaacttatgacattacctgtctataagttcaaaaaccttgtcaaaagtagactcttttttatccattgagtcatagacattgactatgcaggcctccaagtcgaagagtaaaaggacccagtggaatctgcaatgtgcgtcgggtgcatgacatatgaaacacttagcatgtatgtacgggaatgaaattttttaggaagacagtaaaaactaactctgtgttgtacagcaatagtgtgaatgtcttgtaatgttgctccttcaggagatggatgagattgtcctctgtggcttgcggatatttgtcgatcatttcgacgtttactttccgagggtcgatgaatccactatcgaaaaccccccgccgtcgggccctttgaatctccattctacaatgataaaaggaattattatatatggtgtacttatatacaaggacctaattaattaaaggaaacgtaataagaaatctaaccaaacgatacttacaaaatccaacaactcagaagagagacgtcgagggcgtccagctggtatagttcgtagatacccttgaaattgatccggataatatcttctccttgcaagaagtccatgtgcctgatcctcgctccgatcatctctctaccggtggcgctcatttccatgtatagttgatggaatttgtacatctgtgtcggtagggactgcagctgctcaggcttgacaagcggtttaccgagttcgtactggtgtctcacttctgcctttgggattggtgcacctcgtagcaattgagccctagttagcccggtgtcagaaataaattcttttattccaatttcttcctcggtcaccaacggctcgacctcctggtttggttgctccccaagctgagggactggtttggactttctataatatgctttcttaagtgttcgctcatagtccgttagctttatggccttcttggctggtgcaaatatacccctgaagaagttcctggcactcgggtctataggaatcttcttttctggactccgaggcttcaattgcctcttcacttatgctgccacataagcgtcaagctcctcttgcgtgcaatcgtacggcggcggcttgttttctgcggtgtcaactttcgtcttctcgctgcccttgtgtgggcaggcggtggagcttggtgagaccttgacttggaaggtgccggacgaggagcttgaggaggagtcggcgcaggagcctgtggaggagtcaatgcagaagcttgagtaggaggagcctgaggaggagtcggtgtaggagcctgaggaggagatggtggagccggaggagatggtgcacgagatgccgcttgtcacccaaggaggatgatgtacctcttgcgccatagtataatggcgtggtttgtctctcgtagatgcgtctcaccgtctcctccagggtagtccaactcgaggtcctcgtacgcggcttccaccagctcaacttcgaccctcgagtatcctgctggaatcgacctgcagtggtaagtccctgaagggtccgttgggatggccattcccgacgccaccttcacgtgataagaggttatctattagtaatcaacctaagcagcaacttgcgaaatgtacaagtcaaaaatcataaaacaacgagcataccttgattgataagttcttgaagggaatatgcagctcacatggtgtccgctgcgtgatctcatcaacggggcatgtggtttcgtcctgagtttgcatggcgtccatgctctgtgatcctacctgccccgttgaggcgcagctgctacgattgcttgatgggctgaccattgtaggaggaatgtacggctagggatcctaggaccgatgtgcgttcatgtgttcatccaccttccttgccacctcctcttgcatgctgagctcgttgctcgatgccctatactcaagatctgcaatcttcacctcggtatctctcttgctcctcatcgaactcctgtacgtgtggatgtcctccttgaatccaatcttccaaggaaccacgcctttccctcgtgttcgtgctggatgctcgggagtctgcagagcgagtgacagctcgtccttctctctgtcgggttggaacgtgccctgagaaaaggcttccactgcgtccattagtcgactggcagcctcgcgtatctgatcgctgaagaccagggagccatcaactgggttaagtgttccaccgtgagcatagtaccagaacttcgatcgatctggccatttagcggtggccggttcgatacccctctcaatcaagcttgcctccatctcctcccacttcggcattgcgacgctatagccgcctgaccccaagtggtgatggtacttcttcttggcagcattttctttgtttctgtccatcatctcttgcccttgttgccctgtcttgtaagcaacgaactcgtcccagtgatcccttagcttcggtaatgtgttgaagttcagtgtctgccccttcaggatgtatttctggcagagatctcccttgaagctctgaaactgttctgccattttctttagagtccacattttcactatgttctctgtacccacaggaagggtgaacgtctcgagcattgtggtccacagcatctctttctccgaatcagggacaaatctgtcatgatctccgcgtgcccttctcctgcgccagtacaccgtactgacatgcacgttatccctcacaacccagtcgctgtgtcgtacgtaattcttggctgcttctgccggggcactaggtcggccgtcttcgtccacttcagttatgatgtgttgaccctctatcttcttcgcggcacctcgttgtccgcatgccctcttctgtacagcggagggttgacttccactagcctcctcctcctcgttcccctccgcatccctctctacgttcccctcctcgttcaagtacttgtttggatcctcgttcgactcttcttcgttccagtactggctgcttccctctgcgattgtatcgtatagtatctgttcgtcatcgcgatcagccatctgttcatacaagaaatatttgctaagtctataggtcatttttgctaagtgtaatattcatatgttaatactctaaaaatattatattagaactcaaataatcatatatgctaagtctaattaagtttcttatattacaactctaataatattaaatgctaagtctaataatcataaatgctaagtctaataatcacatatgctaagtctaataatctaataatcttatgttaaaactctaatggtcgtatattaaaactctaacaatcatatatgctaagtctaagtgtcgtatattggaactcaaataatcatatatgctaagtctaagtgtcgtatattagaactcaaataatcatatatgctaagtctaattaagtttcgtatattaaaactctaataatcgtatgttaaaactctaataatcttaaatgctaagtctaacactcacatatgctaagtctaataatctaataatcttatattaaaaatctaataatcttatcttaaaactctaacaatcatatatgctaagtctaagtgtcgtatattagaactctagataatcatatatgctaagtctaggtttcgtatattaaaactataataattgtatattaaaactttaacaatcatatatgctaagtctaactgtcgtatattagaactcaaataatcatatatgctaagtctaagtgtcgtatattagaactcaaataatcatatatgctaagtctaattaagtttcgtatattaaaactctaataatcttatattaaaactctaataatcttatattaaaactgtaataatcatatatgctaagtctaacactcacatatgctaagtctaataatctaataatcttatattaaaactctaatagtcataaatgctaagtctaacactcacatatgctaagtctaataatctaataatcttatattaaaaatctaataatcttatattaaaactctaacaatcatatatgctaagtctaagtgtcgtatattagaactctagataatcatatatgctaagtctaggtttcgtatattaaaactctaataatcttatattaaaactctaacaatcaaatatatgctaagtctaagtttcgtatattagcattctcgataatcatatctttacatcacttgcctgcccaaattccttcgagggctagctaccacttctgcttgagggacgacgacgacttcttttttgcaacatgcaaaaaaatgtattagtctaaacgcaaaggaacatatattttatgttcatgttttcaaatatataatcatatatatatgctaagtctaataatcgtttaattatctcgttcgtactcgtttcgttcgcgttcgttcacacgtttcgttcacgtgccttcacgtttcgttcgcgttcgttcacgtttcattcacgttcgttcacgttaagttcacgtttgttcacgttcgttcgcgttcgttcacgttcattcgcgttcggcattgacggggcggtagcggaacggcggggctgtggcgcggcggcgtggcgaggcgggggcggtggcgtggcagtggcgtcggcgtcgttggcagtggcggccgcatcgcggggtcggcaacgacgggccgggccgggtcagcgttacgtcgtcggcaatggcagccgcgtcgacgtcgggatcggcatcggaaggaggcggagtcggggtcgggttcggcgtggcgctacggcgttggcaggcatcgcaacaacgacggtgatgaggcggtggcagtttggagagagagagagatcgagagagagagagatagcaggcggcggtggcggctctcaccccagagatgcggcggcggcggcgacgacgatgatgacagcgagacgacggcggcgtcggcgcgggggatgccctaggtagtggcggcgaaggagaagccgagatcggagaaaaacttctaagtgttggtggagaagatgagggcgcaacgggaatatatataccccgagatctttagtcccgattgatgagaaaaaccgggactaaagattttttcccgctattttcaaattcttttttaactcggttagggttaagaaccgggactaaagataacagcactacatattaaatttcattacatatgggtttctaaaaaagtaaataatgcattaaaatgatttaaagtcacaaaattaatgacaaaaacttcaaaatatattgttgtctatagtaaatgaagtggataatatataataagcacatgaatgatttaaaattgttaaaagttctaataattaatcatatataattagcatatgcatgatttaaaattgttaaaaattttaattatcatatgtaaataccacatgcatggtttaaaattattaaaaattctaataatcatatataactagcatatgcatgatttaaaattgttaaaaattttaataatcatatgtaaacaccacatgaatgatttaaaattgttaaaaattctaataatcatctataataagcatatgcatgatttaaaacttttaaaaattctaattatcatatataactagcatatgcatgatttaaatttgttaaaaattctaataatcatacataattaacatatgccatacaacaattgatttatatggatattcaatacatccaaaatagtttatatcgtgtacacaacaattacggcaatacatcagcggtgacggttgaccgcacgtactttctcctcactagtgttccttccttgtgatcgctacgtgagtaaggggtgtctttatttgataggaggatgctagggtgaatcatcgccgtgaaagggggttgctcatcaaactgatcataatcctcgtcagtcttgtcctctactccgacgatttttcttttgcgtgggagaaccacgtggcgctttggctcgttaggccctttgcccttcttccctttgctagacatgtccttcacgtaaaaaacttgcgttacaacattggcaaggacaaaaggttcgtccgagtatccaaccttgttaaagtcaaccgttgtcatcccactgtcatcaatcattacgcctccaccagtcaacctaacccattggcaccggaacagagggaccttgagaggtccatagtcaagttcccatatgtcctcgatggcaccgtaatacgtgccagtggtaccatcgtgtcccacggcatcgatacaaacagcactgttctggttcgtgctcttaatgtcttgggctctcgtgtagaatgtgtacccattgatctcatatccctggaatgtcgcgatcgagccagatggtcccctcgccaggaaggccagttgttggttaatcgtctttttacccatgagatgttgtcacagccacgcggggaaagtatcaatgtgatgccgtgtaatccatgcatcggacttaccgatgtttctggcacgaactagagccaagtgctcctcaatgtaaggagccaccaatgaagattgttgcagaaccgtgaaatgggctttacggaataaattgttgtctaccatcattattgctttccttccgagagtcccctttccctgtagtctcccttcatggtgtgattcaggtaccccgattgggcgaaggtcttcaataaattctacgcagaattcaatgacctcgtctgttccataccccttggctatgcttgcctctggactagcacggttacgaacatacttcttcagaacacccatgtacctctcgaaaggaaacatgttgcgtaggtacacaggcccgagaataccgatctctttgacaaggtgacaaagcagatgcgtcattatattgaaaaattaaggtggaaatatcaactcaaaactgacaagacattgcactacatcattttgaagggcttctaatctatccagattgatgaccttctgcgaaattgcgttcattaaagcacatagctttgttattgttgcccggacattgtttggaaggataccccttattataactggtagcagttgtgtcatcaacacgtgatagtcaagagactttaggtttgtgaacttcttctctttcgtgcttattattcgctttatattcgtggagtatccaaatggtaccttgatgctctccaagcattcaaacatactttccttctttgccttgctaagagtgtagctggctggactcaagtaatggcttcctttctcctttggttccgggtgaaggtctgttgatgtacaacatgaggcctgggagatctgcttaactccagtacaggtccaaaacttgcctttgggtgtgtaagcatgccagttgatttgatcctgcaatcaacaagaaacaaagacaaagaaaccgcggttaaatccataaacgatagccggccggctaattgccaatgacatatcatttatctttgagcctgtgtcatatatgcgtcgatcggcagtcattaataagtaacaaagaactaaatctactcaatcagctgtagatatcaatggtatataatatttatgtcagtatatgcttaaatcaagtgattgggatagatcggtcgctatgccgagacagtataaatcacttagatcgaaatatatatgaataatgagattatatgtgttcatagcatagccgatcagatagatctagtatgtatcggctaatactccgatactactctatattaagatattaaagctagaagaatataccaaacagaaagcctaatatatttgaatgcaacaagatcttaacataaagggcatacttaacatgtcaataaagtgtataagataaagggcatactactctaatcagcaaccaaagacaggctagagattgagattctaatcacgactcataagttcaaactcaactgatgcagctataagtatgaaaagaaggacaatatatagacaatcaagccgttggatgtgtcacagagtggtggatatcctatataatctagagaaaattccttgtgtacacctcaaaactctctcagtcccttctatgcacctgaaaaatactgaatcccttgtgtgtccttgaaagtttgtttggaacccttgcatgcccctctcgtcaagtctctgtcagccccagttccttcggaaatggtaagatctttgacgcagtctaaatattaatttgcttagaaatgtccattataccctt

SEQ ID NO: 76079 - DNA, 3079 bp, Oryza sativa
accaaaatatttcaaaatatctcttacaagcatcgcacgtgcctcaaataacacagatcaacatgacaaactatatcacatatgaaacaaaataaatgttatttacatcaatccataggaccaatctgaaattcttaatacaaatacaatttctaaacacaaggttagagagtatctatttgtacagtgtgtataaaactatttgccgcacgcttcatccattgatgagataaactactgaataatcatttttgctccaagacaaactcctctgcttgcatatgcgtacatttgcattgtatactgcagtacaatacaagtcttgaatatgtaaaaaattatagtacctgcagttgatgaacatgaaggtatcttaatgtcagcccatagaaatttacatggaatcgtatacatcaaacaagtacttcgctacagattgaattaaaccaaagaagtaactatggcatatactgaagttgttttggctcaaaaccaaaatctcaaaaaggctccattattttatttcttattctagccaaaacaaggtacagtctagaaaatgatatggcagcattgttggggtaaggagaaaagctggaaagagaatttagaaatttttcagaacaagatttttctaggaataacaccgggcagtaatgactttgaggaacaatataaaggcagatttttaggagacattttaaccagagtgcactaagctaataaaaatgttggatgaataagaacttctccacacatattatacaatgcaatactgcacctttgatatccattatctatgtggatcagatctgcatttgcatcgactttttatttgcctaaacctggccctgaactagactactgaggaagccatgtaaggatgcaaacaaagaacgttgagattttactgttttttatcacatccctctgcagttagaagcaaatgactatgagttttagaaataattggaactgaaacaagtcactattggagaagtgatctttgctgggtgagacaatttccacaatagttccggtttcaaaaagaaccgggactaaagaggttttttagtcccggtttattactccaacgggactaagggatctttaccgggacaaaagttgcacaactttaccaaccggaagagatgaggagttctcctagtgagttttagtactacaatattacaatactagatcttggttcagtaaactaaacaacattgatgtcgctccaacataatgccctaagacaacattcaccctagcttactgaactacagcttgtattagtattaccatgctagaaatcagttccgtaaaataaacggcatggtagttgctccattatatggaggcaacattcatcaattcaccctagtttgctggatcaatctaaaatactaatttataagcttatattagtatagtaactctagatattgctgattaacatactctgggtttctcctacggtcaacgaagatcagcaacatcacagttgacaatcaagataatcattattcagtaatagaagtaaacatcgtcgtaactatgacataaataggtagataaatactatattagcatcgacagtcagaaacttcatgtttttttggttctatttaacctcagatggataagaaaattaaataaatttgacaagttcccgtaattcacaaattctgtggccatatattagtaacttagatgtatggaagtgtgtgttgtgaaatctcctaaacagttgaagacaacattggtgtttaatgctttgattgctaaaattaaagccaagtattgttcggaacataaggaatctgacaaaatgatgacgatgaaagcttgcattacctgcttaattaggaagtaacgacaagtcatcgtggcccctgcttccactccacccaaaatataaggggaaaatgcttacgtatgtgataaataaattaaagttgtgaggaattcagcattaataaataaaccaagtaacttacggtttaacagaaagtaaaagaaggcatcataattatcatgccgctaaattaatcactaaaaaaattaccactggactgcccccaaaatctttttttattttttttatctttatcattctagctctgcttgcaaccacatgtcaaaacttgtgccgcttgatccaacgtgctgggaaggtggagaaaagcggctgagagctcggtgcttcagcgtcggagctcgaggagggggtaatgccataagtggcctgcgtgtcgacgttgggcaagcaggttctggtagcgtcggagctcggggaggggatgacggtgtagcatggctggccggcgacgtcggggctcgacgcgggcgagaagagaaggagaagaatcggccgtgggagaaaagagatggaagacagggcctacatgtcagcgaggtggggacagacattttgggcaatacgaaattgagtctcattctggtgccttctacttgtagtagaaagtaatccaaaccgttgatcttatttgatcaaagggctgagatctgtttctactaccaccactcttaatggtagtggaaaggtggaggggtatttttgtccacggaaaagattttgtagagggtgtattcgtaatttatcactccccgaacctagcagccattctgtgtgtcgttcgtcgccaccaccccaaatcgcttccccccgccaccgcctgtcccccgccctcgccgcctccaccgccctctccgactcagccgctggttccgccgcctctgccgattccgcctcctccgattgcgacgaggagatgattagcctgttgcgccggtggcggagcggctatggtgtatggcgaactgcatggcgttgacgaggttctcggtgcgagtacgagccggggcggtagctgatgcacgtcagagacggggaagcttcctgccctgcgtcatcccgatatgtaaggtttaatatatcgcccctttgctttgctgttgagatggtaggctttgtgcggttctattcatcaatctgttgatcgagatggtaggttttgtgcggttctattcatcaatggccagctacaatatggct

SEQ ID NO: 76080 - DNA, 11975 bp, Oryza sativa
gtgtgatggcacttttgtgcctggtaattctgaacttttgtgaaccattatgtgtgcaaggaagctagacgtactcttgttgtccataggccgtgtttagttgccgtccaaatttttttttttgacgtttcgttacacacaatcgaagtattaaacgtagacaaataataaaacaaattacagattttgactataaactgcgagacgaatcttttgagcctaattaattcgttattagcacatgtggattactgtaacacttatggctaatcatggcgtaattaggctcaaaagattcgtcttgcaatttacagtcggactgtgcaattgtttattttttgtccacatttgatgctctatacatgtgtccaaacatttgatgtgacggaaaaattggaattttaaagaaaaaagttggaatctaaacacagcctatgttgatatgttgatctgaatttatatgttgaatttatatcacttaagaagtatataatcatgtgaacaaagtctctgatacaacaaaataaaaagctgaagaaacatcaatggtccatccccaaccttcaattgtgttgatgcttcttacacatgctccctctcatagctccggcttggggattacttcgcaagttgcaaacatgttcaggaaagtgaaaaattctgtgatacaagtgaatctggcaatcgcggctgctttaaaatctcatctcataatgaaaactaccatggtggtccgcgcagattacgcggctagcatcattatattttctctcatataatagcatatatgttttctcattatattattcaaatatattgaaatgacaacataattttaaattttacaataactttacaaaactacaaaactactaatgtgtaatattcatattatattttatatacgtgttagttattaattatttttaatatcaaattttagttagttgtaaattatatatattcctatatagactctagactcgtcttttaatatttctttttttttaattctgaattttctgtaaattgtatttctatataaactctatgctcttccttcaatattatttatttttatttctaaatttttattatttctaattgtatttctatgtggactctaaactcatctttcaatattctttaatttttaatttcaaattttagttacttctaaattgtattcctatatttgtattcctatattgaccttaaactcttcttcccatgtttttcttaatttcaaattttagttatttataaattatatttttatacagactctaaactctaattttaattttattatgtttattccaaattttagttagttttaaattcctatatcgactctatactctacttctaatattccttattttttaattccgaatttctatttttttcttaattatatttctatatggactctatactctacttctaatattccttatttttaattacaaatttatattatttcctaattgtatttctatatggactctatactgtggacccccgtttttataacaggaatcaatcgtgtaaacagtaccatttccctggatcaagtagtctggtacacacgaattcatagctgaaataccaaatgcacatacacgaatgtctagtacgaattattacatcataagcccgcaggcatagtcttaaatcatcggaccgagcggtccggaatacatccaaaagcagaaacaggtaaggcagcggaatttaggcagcggcatgccattgccacaggcaacgaccgtactaagacctactgggcgccatcgtcttcatctcccttctggtagtaggcatagggatcctccgaagcttcatctcccgcttctaattaattttatatttgcaagggtgagtaccaaccgtactcagcaagccaccacagcaatgatgcacatgacagaggaattcaaaggatggctatggttcgtttgcgcaaagcaagttttgtaattcttttcacaagcctaagacctagcatagactgatcaagttttaataccattgttcatattaaacaatgacggttctgtccaccatccattgtgatcccaaggatagcttcccgccattgagtcgttatgattttctgaggacgtccatattcccgcctctcaggagtggctccatgagcataaaaatcatcatgccatattccatcccacacaagttaagaatttagagtctagccaagtgtaatacatgtcccggtgctcattaaccgcgagcacggctattcgaatagatttggtttactcacactgcagtggatgtacactttacccgtactccgcgactacccaacacatgagcctcgtcccaacacatgagacgcgtcacggcaaagcttttcgataaccttgtattggcagtacccgctccatgaactttacatcctcatgcactccaggtgtacacggtttctagcagtgagaggagttctggcgcacccgggagggaaagactcacatgcattaagttataattatgtttaaattctcacatggcagtcctaccaatggcgacaccactatagacacccgtctcgcggttctacctatggctgccccaccgtagagcccctgcctcacacatcaagaaaccactatgcatggatactgcctccgctcagccatctactccgctaggtctatacccatacgagaagcggggttgtacgggggtcgtttcatgcttaacttcatggctcggtccctaattgaccagggacggcattagccttttccggataccacccaaatcctccgtccgccccagtcgaaaatagttgtttagttttatttctcttttcacaaatcatgtcatcaatatcatggcaatgtggcgctcatgtctccacatgcggcatctcaattaccttcccaaaggtaattgcccaagcataaagcattttgataaatatgagtatgcatgattctagaatagcatttctaagcaattgtcatagttgactagggactcatacgtaaacatggttacgaaggaataaggggtaaacaataatcaaggcatggcataatcacaagtaggatgttcatcattgcatgcaattttattcgtaaacaaaacaatttcacaattgggatcaacatgttcaaggaatagtgatgacttgccttgctcgaggtcttgcgggtcttggccttcacccggatccgcggctccctcggtctctatagttacgtgcgtaagaacaatttgaattcgattagaattcaaacaaaatccaaataatgaccgaattgaaaaacgagcgtgggaggtgaattctatataggctactttattcgcgaagtggaattattcttcttcctaagatattttgtgatttatagtcatgtcctaagactcatcgaattattgagttcttaattacatataaattagtaccgcgaaattgatttcttatggagattactaaaaataatctataatctataggaattcatctaattatattctcattaatcctataattaaatgctagtattttaggtatttaattagtaagaattcatctaacaatatgttcattaagcctatgattaaattctaatatttttaaatattttaaaatttctcttaaatttttcctttcctttctctccctctttcttttcttttctcttttccctttttcctttcctctctttctttttctctctctctctccccctttttcctctcctctctttctttttctctctctctctgccggcctctcttttcctctccctctctctcggctctctcccacccgagcggcggcggcggtggacgcgacgggaacggagggcggctcaccggcggcggcagcggcgacgacggaggtggcgatggtggcgcacggcggcgcgggagcggcggcacggcggcacgggaacggcggcgcggcggcacgggaacggcggcgcagcagcacgaaggcggcggtgtggcagcactacggcggcggcgcggtgaaaagggaggagatggaggggaatgggtgtgggggagaagagaagggctgggggttttatagggtgtgagagagggaagagagagggggcggtgaaggggggtgatgcgacggcggcgcggcagcgcggggcgcgaggcggcaatgggacgcgcgcggcgacgggacgtgcgcggcgatgggacggcgcggcgcgacggcgatgggacggcgcggcgcgacggcgatggcgacggcggcgtagggctcgaggcggcgacggcaacggcacgtggcgacggcgacggtgatggcgacggtgcgcggcgcagcggcgggcgatgggacgcgcgcgcgacgggacgggtggtgacagggcggcagcggtggcgcgcggcgtgaggcgggtcgcgatggcaacggcgacagcgccgcagcggcggcacagggcgcaaggcgacgtgacgtgtcacatcctgatttttgtttcaggatttataaattatctaataaattattattagaatttatattaaatgttctttaatttacaagtaaagttaaatgtgggaaataaaatttcctaaatttaaagcatggatggatttaattttcattaaattctccatgattaattatactctctgaaattttctcggatttttcggagctcaattcctaaatgatacaaagaacagttcagtaattatttaatcattaatgatctaattataattatgttaagtgcttttcttgtttaaaaaaatccttaatttataaattgttgtctaaaagggaattattagaaatgatcttaaaagcctaaaagagaagatctaattaataaattccaatataaaatggggccagataaaatttcattaaatactttgcttaattctataattcctagatttttctgggatttatttgagtaaaggaagtatttttaataaatggaattgcatttcatgaataatttaaattgaaaaaggtttttaaaagtctcttttggctttgggccgaaagtcggcccaaaaccttctctccctttccctcggcccagtcggcccagtccgcagcagcagctgcccgcgcgagcgctctcggtcgctgacaggtgggtcccacctgtcggacccgtcgtcttcctccggccgcccgtcgcccgaaccctagcgccgcgccgccgccgtctctttccaaattcggccgcgcctttccttctccggtgaaatcaattgagggtaatgtttcccgagatctcctctaccttttcccttttggaaacatcgtctaaatcgctttggaaattcgtggattcgagttcgattcggatcgatctctctcctccgaaccctaaaccttccatcgcgttgccggtcgccgtgggccttcgccgtcacctcttagcccctataaaaggacccccggtgtctccgctacccgtcgccacctttgccttcgtctctcgccgtcggtagcgccctagcaccgtgagacctcgcgccgccgtcgtcaccgtcgctccagccgtgcgtcgccgtcactccagtcgtcgccgtcgctcaggaaggccgccgtcgtggtcgccgtcctcgtccgcccctccgtcgttgctatagaccgccggagcaccgccgtcgtcgtcaaggcgatcttctccgccgccttttccacgacgccgtcgccgtccgttgatcttccgccgccattttggtcaccggtgagttcgccgcgtcgccctctatgtgctgtgtcctccgtttgtgccgtcgcgccgtcgttcgccggcgagcttgcacgctcgagccgccgccggtggtgacgtcaccgctgacgtcatcgtcgtcgtccatccgtgagccacggtggatccgatcgatcttggccgtccgttttggataggatcgatctcggccattcgtttccgtgagccgccgctgtgcacccggtccaccgtgaaccctagccgctgacgcaataatcctcttttccttttcaagaataattcattattgcgtcataattccattaaaacccatataagtgttttaatccgatttaatctttaaaaattcataactaattcatcttagctcggatttagttggttcaagtctctaaatttttctaaaattgagatctacatgttaaaaatatccacatgaactgttcatgcttgtttatgtgctgttttggtgttttgctcctttctgtttagattccgacgtttccggagagtccattttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggaattaacctactgtttgtttatagcccttttgtttttgattactttattctttgataccttgggttatgataacttgactagttaggctttatatattggttcagctagatattagatatgattgcttagccatgcttagaaacattagcacactattgggataattaatgtttcactattatttaatgatggcttaatgatagctcacgatggccaatcgtgattggttaattaattacttgccaactaaaacttgataatggtgggttgtgagcacatggttttgagagtcgtgctcatgacaattaaggaccggttcacgattttcggttgtgaaatattaaccgtgccaaccacaagccagcgtgggcaacggctttaccttttgtatagcatggttcattgcggagcaccagactgagaagtggcggagataagcccacgggggtcgctggggagtccatgccttgtttataagggggtgactatgatccgggaacggtgcactgtggtggattgtgttgtgcgaggggtaatgtcacagctcctttccgaggtaccgtggtggtattgaggcacatggtgacatgttgtggggctgtgtcttgtgggtacagtggtacacctctggccagagtaaaactataaaaatagccgtgcccgcagtcatgggtgggtctaacaatgtctttcgtggttagtctcacacttctcaccataataaatgatgatataattggtaataatttgtttagctcctggtttggagatagatctgtgcagccgggtatggttgttcaggatggttgggcctgtgcagcatgggtgtgctgttcagtgttgattaaaatttctgattaattactccactgttttacttctcttaaatgttttgctaaatgctgcttttgcaattgagcctatattatgccatcctttggtatccttgtgcacttgcatatttgctgtgtggcttgcttagtatgtcatatgctcaccttgcaataatcaatcaaacctcagttgaagacaagttgcgaaggagaagacgtttggcttatactccagttgagctgcctgtgggagtggagctgaagccatcgctagaccgttattccgctgctgttttcttttcttttgtaagtgtgtaacgttatttttatgatggatttgaatattaaattgtcagtttgtgtacctcggctgattcctggacgaggattttatgcacaaataagttcggaaattactagtgaatttccgggcgtgacatgacgggcgagcggcgacggcaacggccgaaggcgacggcggtagcggtggtgcgcggcgcgaggcgtggggcgcgggcgcggcgtcggcgcggcagcggggcagggttaggctaggggacctcgtcgaacacctggcggccgatgaatagtgccgttttctatttacccgatttaagcctatttatttatttaaaattgattctataaacctaaattttgtacaaatgaagttcactcaatatttgtgttattccaaccaatgggtccatccttgattaattttacccatattttatttttatataattttcttgaatttaattagagttaattcttattccgatactttcaaatttaattgatacaaatatagtcgtaataatattttactcatttctatcctcaccaaatattattttaatttgcactttaattatttacttagtcaatttactttttagggtttattcctaactaattatccattattcgcgattcataaactccgaaatcagaatccaataaaataatcgaacaaaatcggcatgatgcaattttatttaaaaagtttttgaaggctcatatttttgggactttgatttttgttggtcgaattttcagggtgttacatatactctacttctaatattccttatttttaattacaaatttatattattttctaattgtatttctatatggactatatactatatttctaatatttcttatatttaattctgaatttcaggtattttctaattgtatttctatatgaactctagtctcatcttttaatattccttattttttaattccgaatttcagttatttcctaattatatttctagatggactctagtctcctcttctaatattccttattttttaattccgaatttcaactatttcctaattgtatttctatattgactctagtctcctcttctaatatttcttattttttaattctgaatttcagttatttcctaattgtatttctatatggattctgctttttctttttcttcgattaatgtgagaatttctaggccatgagagcgaacgtgaaggctcttttttctattcctttaataatataatagatattctagcaattaaagaatatatatcatgatgatttatgagcatgcttgtggacattcatggataaattagtaattaatactactccctccattccaaaatataaggcacaaccacccttaacccaaagactaagaaataattattatcaccttgtagtttggatcatcctaataaatgtaatgcatgcatccaatagagttagagaatgtgagagtgaaggatttaaaaaagtagtaatttaatggagaattgtcatagttaatggcatgcatgcatgtatgccttcttatattatggaacatcttaaaaaaaagtggttatgccttatattatgaaatggagggagtattgagttagtaactatatggaactgctcccaaaaaaaacaactcaggaactgagtttctaattcagaaatgttccctcaaatgaaaactcaggaactgtgtcaacgatcctaaaatcgtgagtattttcttttcaaacaatacttttagatttttagaaatataccataacagatattaacagtcaaaatagtattttatacatactctgaagttcagagattcagttagaactgtattttgttcaaataatacagtattataatagctagcacattacatcttcagaattaatatattgcatccagcccgaatcaaaattcagcatccatccatatcaaattgacatccaataaatcgaattggaacttgtatacaacgctatatgcaatctagcagcagtagcagtagcaggttcctcttcttatcaacaacgaagaaatcaaattcgatttggagcaaacgcacaagaaccatgataatcgaaaataaataccagctgttcagttggaggaggaggtcaacgcggatgtggacgcggtcgtcagggcagaagaaatcggcgtggccgtggtcgatagggaggagatcggcgcagatgcgcgtggtcgccagcaaggagtcagttggcacggccgtggtggctagacagagatcagcgacggcgggaataccaggggcggaggatggcaggataatcgaggtcaccgacggcgagataaaacggcggcggcaggatgaacgccggctaatcgaaatgggtgccaccaccggaatcgggctgtacaggaacggacggcggatggatgcggcgagatggtcggagcaatacgagactaaaacaaaaggaaaatacaaatacccaaattacccttaagcacatagtttgtaagtactaatatgcccttccaaatggatggttcagatcgtttctatttgtagtataatactaccagtagaaagcaccgtagacaagctctacgaaattacaatggtacgtggatccaacggtcttcagtgtgtagaaaatggcatgtctgatacaaatgaagaattataacggcatatttccaattaagtgaattgggatgatattttttaaaactggcaaatttataatgacgtggatccaattaactttttatttatctactaatacttcaatcaaatatctagtcgcgccaaatccacctccatggcggcaaatcacattcctttagcaaattaccggcgccaaattttcattaaggcgccaaatcattgcatatggcgccaaagccctctcacggcacacctaatatctcctcaaattcctcctccctgcccctttgccaatttttttgcttccttctctgtcgatctgttgcacaaaagtcaaatttcacccattattggttgtctaaacttacagtatgatatgaatcgctgctgatgttaggaacatttgtttattctttgtttaaaacatgccttaaacttgattttgtttgtgaagattttgtctcagttatatgaaatgcttgaatttttgtatgctcgaagtttataaatcttaatggtatgatggacatatcgactggcaattttccgccatatgttggacttatctgacgtatataatacggcaaatactgaatgtgtccaaagtatataaatctgaatggttacatggacatattttctaacatatgttggacatatctgaagtatataaaactgagaatgaaatgtccgctgtatgtaaattttgaggtttgaatgagcatatttgtctcatccatgatttgcctttgtaattgggtatttttcaatacaagtttgttccaaagtatgtcaatgtggggtcatagtgcttgtatacatgtattcagtactgatgatcgatttatgacttatcagcaggagaatgtatacagttctagtttcctgagcaatcactgggtataattagttttctatatcaattgataggattatgtactattgaattgaagaatggttcttaagtatgctgttgcagtagtttacataactattaggtgatgatttaccaccccttttgtgcatactgtacatgtaaacttttgatggtcatgccttgtattaaaaggttaattcctgtcatggaagcatattttcgtcttatctaccggtgttagctttgtttgcagaatttattcatgggacgctacttttttaatttaattctaaacactaatcatgagatctctcttttaagatattgattttgtttgcagctaggaatcagagcacataggccgagcacatcatacagtccacaaagttagaaatatgggagaagccaggttatgaagttgacaggaaattgtgatatttgtacaggaaaatatatgcgagttttcctggaccttgactaataaaccaacaaaaatgcattttcattctaaagaatgatgcaattgtgctaaatattttctactatgcagatatttcttgcctatccataatttgtgttgactcgcagcagtatgtagtttggtattatgtcattcagaagaatgactgggccaagaggccgatctgaccggggggcattggagaagagtgggaaaattgagagtagcacgagagttttcacttcgactaaaaatatcaagaatcattgcttggctcttgaaaaacaaccacagccgacgtggatacctactggcttatctcgctctcaaaagaggaggatacaacgtcttcgggccatagatcaaaaagaaaataaggccgaagatgtagagaacaaaacatgtaataatttagaacctcaaacagcacctaagcaaatgtggagacctaaagaagtaaaagttaagagaccggtgattt

SEQ ID NO: 76081 - DNA, 36198 bp, Oryza sativa
atgacttgcgaggacaagctccaccgcagcccgtgccaaggaagccgacgacgacttcacggcctcgccgacctcctccttcagcctctccagatccgccgtcatcccgtccagccgaagcgctgaagcatctaggctcccatagttaattttggtaattaatgacaagcgctaattgtggactaaccgttgctattgagataatattttaagttaggtccacgtcatgtgtgcacatggatgactatcgatggattaaaatttgatggcgcgaagcgaagaaaagaaaacggtaaaactagtgttttagttttaaaattgatcgaggtgaagggcgatcaaatttgctagtttatttgttagtttcgccgtactatcaaggggggtaatgacctagcaaagagatgattaaattgccacattaggtcattatgcatttagacttgtgctcacatttcacacacacacacacacacttcactgggttcggcctgaccaggggcggtcagaccggccacatagtggcggtctcaccggagtgccctggccggtctgactggccacaatacggcggtctgaccggaccataaggccgatctgaccggcggcatatgcgccgtcagaccggccccctggaggctgggatggtgctgctcggggtggccgatacagagccgacggagccgaagtcggtcagaccgagccgatggcggtctgaccgagccgaggccggtctgaccacccactcaacaccggtctgactggcaaggccgatggggccctctgacagcacttcaacggctagttttctagccgttgcagagtagcacggtctgaccggccacatatctccggccagaccggcaaagcacaatgattgggggatttcgcccccaacggctagttttggtgggtgggagtataaatactccctcaccagcagcaaggggtctctcttggcacccaattcaattgcatacatcccttgcacctctctcacacccacttgagctttgtgttcatccatctagtgtgttagagggttgattagccaagagtcaagtgcattgcttccatttgtagagttagtgtggtacttgattgatcatctccacgctgggtcattgcttgttactcttggaggttgctgcctcctagacggcttgtggaggagttgcccggtgacctctccgagaagattgtggaggaggcccggcgccggtttgtgagtggtttggagttcaccaccttcggagtaaaggaagaactaccctaatgatcgaggcttgggtagtcctcttcgtgggccggctcccgccttgcccaccccttgacgaagggggcgtgcggtggcttcgtggttgagcggtggagttgggctcgcctcaacagggagtaggaaaccgacgagtttccgaacctcggtgaaaaatctcttgtctccttgtctcattttattgtcgcatttacatttgtgcaatttacttttctagagacaaacttgagatcatatcaccctaggattgctaaacattgacataggagtgtgatttactttcttagagatataattgagccactatcaccctaggtttgcaaaacataacttagttgcttagttagagttgaccctcaccaagcctagcaacttaggttagttttgattaggtgtcatttagttttaaatcgcctattcacccccctctagtcgacatctcgatcctacaagcgcgagcgccggctgtgtgggcgggagcttcttgtcccggcgcacggagatgcccacccggcgtcccacgcactccagccgttcgatggcgtcggagagttggccaggcccgatgtcgttggtgaggaggggggccgcgatctccccggcttggtcctgcaccgggcgccccaggtcggcgagagtgccttgagccgcggtgagctggctgaccaactccgcgtcgccaggctgcccgtgcgatgccagttccttctcccaggcctccagctcggatgccctcgccgccatcgccgcgtgctcagcacagttgctttccagatggatggcctcacgcccagcaacggcctcctcacgcttggtgagctgctcgccaagctggcgcgccgccacctcgcggcggttcacctcggcctcgcgctcggcgagcgtggcatctcgttcccgccacgcctcctctcggagccgcagctcctctacacgacgggccactaaagcttcagcggcgagggtggtccaattgcgctcggctgtggcctcctcacggaggcgaagggaggattccgccttggccgccatcgcctcgtgggcggccaaggtagtctcgcgctggtccaacacgcgcgccctctcctcgagcgcccgagcccgctcctccagctcctgggcccgctgcgcatgttcccgactgcgcccctcctgtttgcgttggttgcggtcgagaacctcgatctgccggcgaattgtggcctcgaactcctgcgcggagcgcgtgcgctcgtccaaggccttgcgctcggcctcgagcgccaccgcccgggcccgtagcgaggcgtcgaccatcgatgcccgccgctcttgggccgcggccgcgtcgaggaccccgcgggtgtcctcaaccctcctcgccaggtcctcaccgtaggtttcatactgcaggcggatgtcgcctagcgcctcgtctaaggcgcttgagacgatgagcgccgcctgccgctcctcctccgtctcccgcatgaccgagtctagcgtctcctcgcgcgcctggatctctgctagttcggcttggcgcattttgcgccccacctccaacatgtcgtccacggcgcggcgtcccttgtcaacccgcgcgcggtccgtcacgagctgtgcgcattctgcctccagggccgcccgctcgtccgctagggattgaacttgggcgttgagcccctctcggatggtggaatcggcggcggcgagcacctgcaggagcggctccatgctcgcaggagtcggggaagaaaaggtcgcggtccgcccccgggacgacagagtacggctggacccccgcgagactgggggctgctctcggttccccttccacgtggtcggccccgagggtgccccaggtgcagaggggaatggttgctgccgtcgccccccacctcgggccctcgggattgcccccgagaagggcaccactgccgctgtcgcccacggcgggttgcgcctccccctccttcgtctcggtcatggtggactcggagccggacccggcgtgcggcccttgggccccgtcggggtgctgcgaaggctccgcagcaccggatcggccggatcccggccgctccggtcgctcggccttcgacccttgggaggggtcggatgccgagaccccttgggaaggaatcccgctacaagagaaccccggttgcgttaagaaagaaaagaagagaaaggaacaagaagctagaatggatgggaagcaccgggccgggctttggtgaccgtacctgcgaggggggcgtctgaaggtccacttcgggggctcgatgaagctcccccgacacggctccgtttgccctatcttccggagcagcttgttcttccgtcctgcctcgggcgcggcggaatgtttgtggcccgctggtggtcggtccactgttcgctcggcgccccctccgcgcggaggggagggcggccgagattcggacatcttccgcttctctttcgggtcgccggccgagtctccccggggccacggctcagaccgggcgccctggagccgccgcccccgccagagccgccggtccgactgctgcccgcggtcgtgccgctgctacctacgccgtcgccgccgctgccgccgccgacggtgccccggcgagaccgacccctgccagcaccgacgaccgacatcacagccaggatattgtcccggtcgtggtcgctgcagaggggaaggatcccgtccggaatcagcgtttgttcgacggtgtccaggcccagcacccgccgaaccaccgtcttcgcgtcctcctcgccccaatcccagcgcttgcccacgtgggtgcgcaatggggtcgttatgcccggtgtattcccacgcgccgcgggactgctcctagagaggcgcgatgcgacgacggaaatagtcgccgaacaccatcgccgccgtcaggccccggcttcgcaggcccctgaggcgatcccacaccgcatcgtactcctcgcccagttccgagaccgccaaccacccgacggatcattcgggagggccggcagggagccggagtcgcggacgatctggcagcgcggtgtagaaccaatccttattccaatcctcccacttcttgcggaggtggctctcgatgtattgccccgccacacccggccggggctggaagtagcatcctcccaccaccgcgcattgcagcagctgtgggacgaagaagaactggaacagccgcatcgtcggccgcaccccgacgaacatctcgaataggtgcgcaaagatggccagcgtcatcacagcattgggggcgagatgcaaggcatggatctcgtagaaatccaagacctcgtggaagaacctagagaatggcgggatcagccccaccatggcaaaggacaggaggtgcgcagaccgctctgggtaccgcggccgcgtctcccctgccctcacggcggcatcctctagcatgatcttgcggatgaggctaaggtgcctctccgccgtaatgcgcgatgccgggaggacggcatcgccagcgtcttgggccatggcagccggcgggaaacggcgaggagattggcgtacggaacacgatggagggagagaagcgctgggggctgaggagcgagtatgcgggtgtgcagtcggcgaaaggaaggagacgaactctccgcctcccttcccttttatctccgccttgctcgcgcccgcctcctcgtttctcgcccctgcggttgcctcctcggttctcgtgcctacttatcacgtccgccctactaaactcgcgcccggcgattaatgcgcctgtcagtggcgcactcggcgcgggatgtgcgatgatcacggtcgcggctagacgggcccaacgtcagtcccgtcgcgtgcctggcaggcgggggagtcgaggcagcgttgggtgacaattctgggtgtggtccggcaaaccccccgactttcactccctaagtatccccatgaacggcgcaattagtagcggtcaaatcgccgttatggccgatgagccaaccgggccagccggcggcggccgtttgaactccccgctaggcccacaaccacggtacgggaagtcatgaggcaccgcgccagaccgccctcaggggaccgctgtccgacgcggtgtcgggagctactgtcggtgatatgggcccgggggtatgtggagtatggggaagtcaccttcccatccagccacgcggccctatagcctggttttccccctacacctcgtacgatgcagaggcagccaggggggcctcggggtgccacgtcacacccctcgggccccgaggccctcgcccgaccgccacgtggcgggaggagcgagtggggcggagacccaggctgaaccgccatcaatgcgtagcgccccaaccgtccctcgctgaatttaatgcggcgaggggcgtgaccggattgtcaccggcctgtcgtcgggcacatccgattggacgggcggcagtgcccccacatcccgccttgtgctcggcggagtgggggcaggtatgccccgtcccatcaaggcatcgcctggaacgcctccacgtgagatggatcgccgaaagtctccgatcatttaaaggggaatgacaggggtgtcccccgtgtcaagcggggggcggcgctgggccccacttgacgacggacggctgcttagcttccgggcgaaggcacgaacggtcgtcggatcgaagcggagtgggtccccctcccgtggaggagtaggtagaggcggcgcatgtggtatccccttgaagtataaaaggagaatcttgcccaccgaaaaaagggacgactctcagttaacctaaaccccaggggaaaaaagagcgagagtgctccctggagtttaggaacctttgtaacactcaaccttaaatcccacgcacaggaatagggtgttacgctccatagcgccccgaatctgaataatctccgctctctcgcacggtctcgaagaactccaggcggatacacggtctcgttcagcgcgtcctttcctccggccgaactcacaaaaggggatgtctcgatcacccgctagagagggtcactcctcaacaacgtgcatttgtacgtgtatggaaaaaatgaaatcgtagcgttgggccgtatttctagcccaccacattcggtacgtgtattgacatgcataatttttttcatttttaatttttttttaatatctacaaacaatattgtaccggcgaaaatatttatagaactcccgagaaagtggcagggtaacgtgagggacggacaagatgaaaaaaaaactaggaaaatgtatctttggtaacgcgaaaattgcatttacccccttcagccttattagagggcggcaaaggacccaagtgcaaaatgcgcacaccttatcaccctagcggtcatttctgtaaatattttggatggtataatatttctgtaaatattaaaaaataaaaatttagaaatgaaaaaaattcttgacatgcattccgaaacagaaaaacgctaaagcatggcaacgcgttcgcgaggcgatgaggtcgcgaatgttcgcgaggcggatcgcggggccttacgcgccggagccgcatcgtcggttgggtcgcttggtacgcgtgataggtgggaccaggccagacgtgtccgacaaagcacgcatcgctggcacgctctcgtagtctgcggcccaccaccacctgtaccctgtacccgctgtcgctttggtacacaaatcgaaaaggaaaggcgagaggattaacggggtatatatattaattaattgggtatttacaaatttaccatcggtttttttcactactgtaagggaaattgctatacatacgacttgtgtccgaccaacactcagctgctgctcgaactgacccacacgtaaagaagcagacttatatggaatttatatggaatgcagtgattggctgatgaggcaggttggacaggagtcggacgatggggtcgtacgtatagcacgatgatgccactcgaatgatagctctagtggcagttttgtaataacaattgaaagtagtggtaaatttgcaattagcccttaattataagttgtttcttcttaggttgtgtttagttccttgtcaaaattttttatgcatatagacacacatttgaaatattaaacgtagactaatagcaaaataaattatagatttcgcctataaactgctagacgaatctattaagcctaattaatccgtcattagaaaatataaactgtagcaccacattgttaaatcatggcgctattaggcttaaaagatttgtctcacaatttacatgtaaactgtgcaattggttttttcttcacatttattgctccatacatgtatccaaatatttgatgtgacggaattttttagaagtccacatttaatacttcatatatatatatatatatatatatatatgtacaaatatttggattttttaaagtttcaagggatgtaaacacagccttactacttgagagggacgtgagtgcgtgacggcgccaatgcacgggtgactctatatgaaaaaaaagctgcacgacacgtatccagacgggccgatcgaacgggtcagtacgcgttcgcattaacaccgattaaggtggcgcattcattccccacgcctctaccacacggcctttataataatgatgatgatgaggaggagactctctcaccttctcacgcctcatcgctttgttctcatcccttgtcgattttctttgacctaaacccatcgtcttctccatacgcgacacagaacacgggcttccctccatgaactcctcctcctttgtcgaagaatatcttccagcaggtgagacattggatctgtccctgtcaatagctacgagcaagatttatcgatgcagcgttggtcaggggcctctccgtctatctgttcctatggaacctgccggccgggggctgcttccatgggagagaaaaaaaatagtctggcggtggttcgttccatagaagcacggcggaagtagtctggctgcggttcgtcccattgaaccggatctgacctggtacgttactgttctttttttcagttttcgagtatgttttttaatgttaccacaacggccggcgatatccatggatctctttctgctgtcaatagcaatgggtgagatcgatgccgcagttacccgccacaggccagatcgatctaccggcgtcagtgatatcgccgtcgaacagttcccatgttcgagatcgagatgaactaacggcggtcgggcgagatcgatctaccggcgtcagtgatatcaccggcggacggggttctgatctccaaggggagtaaagtctgtcctgtctggtggtgttttttacgatattgtatagaacaacggcgacggcaatgatatcgatgaaaataatttgtcgccctgtttctattcttcagatagatcgtcgccatgatctctccaaggagggggtaagttactatttcttgttcagtcagttttccttaactccgttttctagcatttaattacctatagcggcagtttgcgtgcagtggcttcctacactgtacgattttgactggagattgtgctctgcatcttcaatacagattgggtggttagcatcgtcgaatccaggataaaaattgagggtaggctggactgaaagtcttaagtctaagttaacaatgctaatatgaggcatacaccattatcaagtcaaatgttacacttacatgattaaatagaaaaacatagttataaaagaagtaacttgacttaccagtaagttgctaattttcttagatcttagcaaagagttaagtgagaagcctcctggatatataaatgagcaaagttagtaatgcataaatggtagaagtaaacaaatattaactaaagaaagcaacatactgctaagttgttgcattttgttcacgaggcaaggatactttacaggatactttacaggttttcagggcttggaatcgcttcatgattacattatcattgatacttttaaatatctctattacaaatctaccaacaaatcaaatattaggaaatgtaaatgataaatcccctcacttgccacgagttagtactcactaacaagtagtaacaaataacaatgaagtaaagaacagtatagcttactcactctgtcacttagagactcactggaagcagccaagtagcaagccgagcagtagcaggcaagcaactccggcggcctgctgtgctgctctgcgcttgctgccgcggggccaccagccgtgcgcccgcgccgccgcgcgcaggccccttccccttgcagcttgcgccttgtcggctttgccgcttgcgctgtgcggctgtgccgctgccgcaatcgctcgtcgcccgcagctgccacgcggccgcaatcgcacgccgccgcagcgccacgaaaaatccccacagggcaaaggttagcagccacacggtccaaactccaaaaccctaagccaagacaaaacagacacaatgggccaagtgggcttttgctaaagtgataaatgggccattttacgcgtaccggtttagctacatgacttccatggctcctgttcttcttcctcgccgccagagacggagttcttcgcctcttctcttcttcctgccttctccagctgtttccatggaagagatgctatatacttaaattttttttgcaaaaattggagggtaggctagagcctgatggagcctacatgctagaatcgccactggttagcattgctataatctttctcataatagcacatatactttcacattttattattaaaaaatattagaaacagcaatatgattttaacagcattaggatactgcataacttgaccaatatgattttatatgtctgatatctgattgttaatgtaagtcctatgtccataaagcaaatatcatggatataaaccatggtaggtggaagatcaccattaaatactacataaggtcattatcttcgctatcattaaaaatttaaattattagtggcttctctttgctatctgtagtgatatccttatacctactaaagatgatatgtcatatcttatgttcatatacgggttataaaaagtgttcataacatagtggaacagttataaaatattttatatcgtattttataagttatgaacactttttcattgtcacgttagtatagggttggacaatccattctcatctgttgtagttataattttatacagcttagacaatctagcctttatacaacttattaacacgtgaattcaaagaattttcaattaaaatgaaaacatcgatgtattattaccctctagaattaatgtatcactcctagtaaatcctccaattaatttaagtaagaatatactctactctcaatattatttacctagatttaaaaaagttgtcctcattcatgaactattttccttaaatttaaaatatttttaaattataatacttacttttaatctaattttaaaatacttttaagagtaaattttactttggaccatctttattgaccgaaatttcacattgggctagggctaggctcatgttttcacttaacaccacgtatagttaccgttgtttgcactttggacctggttttatagttaccattacatgagttgttgtctaggtgcttagcattttacaagaaacaatgatatggaaatctttgccatgcaaatatgcttagcacaagaacaatgattgtaaatgttataggatatcctatcatcagattaatgggacttcattactactacatatgaacattcacaacccttatactatagagacaaaattggagaaatattgagtttaagaactatttttctacaaaagatattacatgttttataatacccaactgtagtgttagtacaaattattgaattctaagttttctaacacaaaaaagaaatgagatcagatctacagtcattatattatgtgtaatttgtgaaacttggtccaaagtgcaaatgatggtaactatatatgttaagtgaaaatataagtcttaactctagtccaatgtgaaaatttggtaaataaaggttgaccaaagtgaaatttactctatttttaaattatatactcctacataaacttatttctccactctatttattatagtgaattacgctttgggctacattttattacacaagttttactctggaccacgcttaaacctaccttctcactttgaaccaggtaagtttgtcattgttgcggtttggaccaccccgaatgatttttttcactacacaccaatgaccttaaacacattgcgatctcctccatgtatgtctacatggcgagaaaagttattcagggtagttcaaattgaaaagataggtaaaggtggtccaaagtgaaacttgggtaataaaaggtggcccaaagtgcaatttattctatttattttctagttccaaatttagatatctctaaattgtatttctatgtgcactcttttccttaatagtatttatttttaatctaattttcacatataaatttctttttctacgttgattcttgtctctattattatttttcagtttttaatccaaaatttggatttttccaaaattgtatttctacacgtactattatgtcaatatttactattatttgatccactgcgatgctattattttattatgatatattcttatgtagactcattagtcataatattatttaattttaatccaaatctaaaatatttcaaaattatacttctccatggaatcgcttatctatatatttattttttaattcaaattttagatatgtcaaaattgtattttgacctagactctcttaatattatttttatccaaattttaaatatttctgcatttccacacggactctactcccaatattaattattttttacgatattgtatagaataacggtgatggcaatgatatcgatgaaaataagttgtcgccatgcatccattcttcagatagatcgtcgccatgacctctccaatgaagggggtaagttgctatttcttgttcagtcagttttccttatttgtgttttctaacgtttagctatagtggcagtttgcgtgcaggggcttgggacatctttatgtaggattttggctgggtattgcgctctgcatcatccatgcatcgccgtcctaggtctagaacttataagaaagctgagatgaaatcggctatccctacatgagagggaagtccggttcggggtgtctacaattttccctccacgtcgaaagaacagaacatttggtaattttttatttgttttactcaatttgtcaagttatagtacatagtacttttgagaaacaatacatgtattttcatagatttcagtccattgtggagtcgttccttctaaggatatgaaggtagaatgtttcaaggtttattcacggtctattgcctgtttaatgtgcttgtatgctaatattgtgaatgccgttttttaaccctatttgaattttcttagtacatacaatcctttcttttatggctctaaattttcgaagtacatacaatgtttttttaccttttttaaatctgaattttgaaatgccattttatcaagaacagatatgttattctgacctcacattttttttgtttttagcgccttattttctatcaagaaattgcccaagtgaagattgtgagacctgattttcttagtatgtgatttggagagaaagacttgaaattcactttattgcatgaaaattttataggaaatgtctaaacttggtcttaatcaatacctcattgatggtggtgagcagcgaacatctgccaccacccaccaccacttaaccattaggacctgacacccaagaagaaaaggttgtatcctacaacaacaacaacaacaaaactgggcttgccttttttacttgttagatgagatgttcattatcgtagaagcttgttattggatctaaaaaagaatcattggtattttttttgtttatgttggctaaatttaaatggctgaatcattattattagaagaaagatatacaataattttgaactctgattttataagaattatctgtatgcatatttttttacttgtctccttggctattatgaaaatagatttaatattagaattaccctaaaattaagtactacataggcacagaactctcggtggcacacattggactaaatgagagttatgtgctgttttgccttttaccagtgctaagtgctatcaggctgcctgtgattctttgttatgtgctgtgattctttatactatgtatgcatatatgcacttgttctcctggtgatgctaaccgaataggactaagtataattcaaaccaagtcctattcggcccaaacggaaacggacgggagtttttacaatttttgtggaatcggacagattcgtttttttcgcccaaattttttttaccgcgtcgatcgaatcggatttgatttgtttttttaccgggtcgcatttttttaatcgcgtcacatataattccttttttttttcaatgggacagattcgttttttttcaccttttttttaccgcgtcaacggagttggtttcgtttttctttctcgcgattttttccagctttttttttggatcggacagattcattttttttctcccgttttttttttctacccgatatttttttcgcctagtgtttttgtcctttaacttataagtactacatatgaggaaccacatgttatttgatatgggaattggtggcagatttactgctccgttattttcttcttttaaagtggttgtatattttaaagttataatcgctacaaatggtgtgctctctattctattaggatttagtctaattttttttacctttgaatctttgtatctatatattagtcaccctgttacttggttaaacactttacataatacaacaaatgtgatttgggctttcttgtggaacaatcatgttgttttagtctgtatagaaaacatattcaaattatgttgttagattaaagggttttttttttccattctctcaccttctccctctcttctctccctcccaccctccaaatcctattcagatcttcctgggaactccacctctctctccctctctccctctccccctctcctctccctcacgccctccaaatctcttcctgggaactccacctctctctccctctcccactcttccccctcttctctccctcttttctctcttctctccctcttacaccgtccaaatccgaacagcagcaggaggaggaggtgctgcagtgagtggctggaggagatgctgcagtgagcggctggaggagatgctgcagtgaggaggaggaggagatgctgcagtgaggaggatgaggcggctgcagtgaaagaaaatacaccaggggacagatccaatcacttgaagtgaaagagaatacaccaggggatagatccaagcacttgaagtaagtactgatgaaatgtgtttgccattttttttggaaatgtgtttgtccaacaactaaatgttgaaaaatgtgcagattggtgtaaaatgttgaaaaaagatccaaataaagagtgagtgctttattattttttatttaaatattgtttaaggtgcataatcattccctaatgaatatcttttttttttctctaggacaattctgtcagtttcagttgctggtgcccaaaatggcagggaagctcaatggactgttgataggactgtgtacacttatgctaacttctatgatgattttaaagccaaggtttttgactttggtgataggctcaagatttcgtttatagaattagttcagcgtcaagaaaatgatctattgcttggatcttttgagaaagagttaagattaaaagtacttctagcggatgaacatgatgaggtatccataaacatttgcttaatcccacccatgttcggttgttaagctaaacgattatctaaatttgttaggagttaaatgactatctaaatttgttaggagctagcatggttgttaagttaaatggctctatctaaatttgttaggagctccaaagtgagaggtttgtcaagatgcaggggaagcatcaacctgttggtttaaaaaatgagaaaaataagcaagtattgttccttttttttccatcttttttgtcagtgtttgtttaagttccatgtccttaatgttttgtgtatagctgttttggtaatgtagtgctccaatgtttggcaatcacggaaccatttgtttcaagactctttggacaacaatttggagaagaatgtatgatttaatcacaatttttttagtaaaaaaaatatttgtttaagtactaaacgtgtagtgttttaggcctaggaaactgtcacgcttgcgacctgcgccgtgatctgaagaggataagaaaaactggtgcaccagccttctttcccactatctttaagcatattcgatcattaggtggtgattttgaggatggcttgggacgtcatcgtgactcttctgagttcttattgtaataacttaactcaacttttgttgttttagtttgcatttcagttatttttgtgtgttatagattatttttcttttccaggttattactacaaaagttatttgatggtacacatggatgtttaacagatatgtttggtggaaaattccgtcgcagtaaagtatgtttgttgttttagcaattttgacatgtgtttcactgattttacatatagcaatgttttaatgtatgtgcaggtttgttccaaatgtggaatgctttctaattctgaagaagattttactttgctaatgtttaatatacctcatcgtgaacaagttgttgctgcaacattagaagattgtcttgatcacattgtggaagaaaacgtacatgattcattatcccgttgtgaaaggtaaaatttccgatttgtgaatcttaatcgtgtatcatcatgtttatagtaagttcaagttgtttatagtaagttctttgtttataaaatattttcttttgtgtagctgtatgaatgaccagaagtcaaccagtaagtgtacatttcatgaaactagagatgttgttattgtgttgcaaagatttgaaccacttacacttggggtaagtaaatactgttatttgttgttatataatcacttaattgaccatctaacacctaataaatatgtctttaagggttatcgaaagattggagaactaattaactttcctacggagctggacatttcaccatatatgagtggtgttgtaactgacaagcatatatatgaactgtttggaattatagttcatgaaggcggtgttatagggggtcactatagaagttacgtgaaaacaaactgttggtatgaagtcagtgatagagatgtaagtttcataaccattttgtttaatgtgaatgacaatattgtaaactgattcacatgtcaaaatgacattgcttgtatttgcaggtgaaaagagtaaatgaaaattttgtcctaggggcacaagcatatatcctgttctacaacaggtatcgtagttcattttgacaatatgtgtgcctttatgtgagtttgaaaatctgaacttcattttcaggaaagaagaggccaaatcattcgatgaggttttagcttttgctgctacagctatgtcttcatctgatgccgtgcctacatcaacttcaaaagattacactgaaagaacattatcacctgaagtatcgtctgctgctctgtcatgttggtatgtttaagagctctttatttcgatgcaccttcctatttttaatgaataatgttgactttttaaatgaatgacgttgttaacttttctatactgtttgtcttgttgaaaaaaagttatgtgaatgtcaattactttcttgtgacttgttttatcttcaaataaactattatcttaacttatacttttacatatgtgtgcactaagtttttgaataagatgaaaggtcaaacatcatgcaaaaactcaacggagccataaaaagaaatgtagtagtatactgtgaataggagtatcatgaaatatctaatttattgttgtttctaggattgatgctgcacgggtccttgagcccaagagttactcagaccaggatatcctagaaaaatatatcatttgtatggaccgtgacagttcagatgtatctgagaggataaggaatgccatgcggaattgtaatgagtccagacaggagtatcattttaatctccctacaacggatggacctttttatgatgacaacttggggcagtactgtcttcttcggggagctagatttcgaaccattagtacaagcagtaatgtagaagcgaagagagatagggctgttagaatgcacttccttctttctgaaatcttaaaactcctacagctgaaaaaagtgattgacgttggagctattggctatctggagaaatttaagtttgggaattattccaggagtgctcttttacggcgaattaatgatgcatgtatgctcttggggactaacagattatcccttaatatctcagttatgtcaagaggatctatcattgggccagtgctgttcaaagttggagaagatgtgatgattgatgcaagcttaagggctgtacagattccacacgacattcacttggtggaccatattaagttgaaaaaaccagtcagctttgttcttgttgttgaaaaactatcaatatttaacatgcttgtcaatcttaactttcatgtcacacacaattgcataatcatcactggatgtggaaaacctgatatggcaacaagaggtgcagtttttaaacttaattattgcttgccagtcaaagtttatatccttgctgatcttgacttggatgggctccagatatacttataaacttggcagcaaagtaagggcttttgagaactttgtgttgcatctagagatcttatatggctgggtgctagaccagaagattctctacttttacaagaacccaatgaatttaccagagtgcagcagaaatctcttactgatcttcgtgattctcttcccaatatttcggacagagatcgtctaaacactgtgttggactggaactttacattgaatctgcatgacattcttgattatgagaatattgtagagtatttgactaatcgaatggcagagtttgaagatccttgatggagaaagatctgacctcagctgtttgcccataagtgaagctgaagatgggttgccaaacgtgtgtcgccatttatgccacttgtatattttgcacgattgcatcttgtttactgcaataggcgatactgtgccagtgtgccaccatctggatgatatcccctactgactgtagttctcattctgggtaattctaattctggtttttaagagtatgctgtaacgtaggagcaatacctctttgctgataagagtttaacagatcaggcaatttctgattaacttaaagactacgtgttttgattaaccgtcgcttaaaaagtgtgttagtatgacatttacttttgtttgtctttgaactgtgctgaatcctgggaagtccgatgggtgccacagctgtgatatggtcaaagatgagatctccgggcggtggtttcccggattgtagatttgtagcacagggagtattgctgattgtaatgcaaacttttggtcatatttacgtactttgcttggtgagattgacattacttacatggtgtgtttatttcacgctaaaattgaaagtttggttgaaattggaacgatgtgatggaaaagttaaaagtttgtgtgtgtaggaaaattttaatgtgatggaaaaattggaagtttgaagaaaaagtttagagctaaatttggccgtactttgctaccgtacttgcagtagcatgtgttattcatctctcggtttctgggccttcgggtgtatttttgctcgacgcgggagggtttaggatgtccttggcttattgtttctctttggttctttatggcccggtcgtattaaggcactatataaatcataaatggtggcgcagcgaagcctgcactcagcattccggagaagctggcggcgaaatctttggtagaatgccattgccaatccctttgtctcttgctctgtccttgttgattggtgtcctgaaatgatctttatctcttgctctgtcccttgttgattggtgtcctgaaacgatttttcagaacatttgcgtaacattcgttactaggataggcaaggtgggggatgttttgacgattgtagactgaattcaccacatctaaggatacagcttccttcgtcattctattgatttccttcattcttaaggctccaattcaccacatctaaggaattttgcgtaaccatctttctcacgcatcaaaattcttcattttagctgtgtcagcgatggtcgcattatccgtgagaaagatgggtcctgcaagatttagaaaagtagccacctccatagttagttgcatacctaccaattcagcctgtaaaggagattgaaccactttgctagtggctttgataaaaatagcattatgagtaacaggcatttgaaaaaaatttcctactctagttgatccattgtcccaagccgcatcaatatagcacttgctcccattagtagtgacttctcttctcctattgagtccttccatccgttgttcctcctgcaaagagagctgagaggagaatttcagataagtgttcagcattgccacaccctgatattagtttcagggattaataaattatttctagaatttatattaaatattcattaatttacaagttaagttaatgtgggaaatacatttttctaaataaaaaaggctggatttaatacttattaaattatacatgattaattatattctatgaaattttctcagatttttcagagcttggttattaattttaataatacaaagaatatttcagcaattatttaaacaaaattaatcattaactgatctaaatattttttagaaaaataatttgagtgtccaagtagtttcaggattttttttagaattacttgagcattggaagtattttttaaaatgcaaagatcatttcagtgattaaattaaatgaaaaagtaattaaaaaccctcttgtaaatctgcgccaattctggataagtctgatgtacttccctctctttatcccgcacgctgcctcctatccggcgaagttcacttcgccttcctctccagctggcccatctttcctgaagtctgtatcacctctctccgccctgcttccttcgtaactgtcaggtggggcccaccatgtcatcccctaccgagccgcagctgtcgtgcgttgcagcctgcagccctgcagcgtcgcctccccttccaaagccggctgctaacattgctccccttccaatgcggaaatggaatcctcttgatatcctcttctttttccccaacaagtcaaaaaaaggaaatcccatttctatattccggtgaactcggataaaccctaattttccatagccaaatcctatctttcccgagccggtatcttcctcctccgcggatgccgaggtctactcttccgtttcccctttttcactaagccgttgtgtgcgcctccccgcgtgtctttctctccgctgccggccgctgctccagctgctgctagccgctgcctcggttgtcgtcggtcagcgccgtttcctcctacggcatcgcaacgaggacacgaagccctatctccacttccccgaagccgaagaccaccagaaggacatcaccgacgtcaagtcgatctacttcggctcagccgctgctagtcatcgatcgcatctgttagatatatctcgtgttacagtggtttccttatgccgacctatccatatctctctcggttctgtttttataaaccggttgagtatataagaaaggtctcgtgtctatatatactccgcaccgatatcaatctaatcattgcgttgagtctattccactctcatggtatcaaattgcttcgttctaccgcttccgcactaaccctaaccctactgacgctgccatgacgacgtcttcctcccccttctcgccggagtcctttgtcaacgctgttgccgcgtccgtcgccgacgccgtccgcgcggcctaccaagccccgcccggctcgatggtcaatgacacccttaccaagacagtcgccgactccgccgttgacagggcttccaccgctgctcgtgctgccctcaactagcatctgccggcgctctccacggtgcccgccgccacctcacctccacctgccggggatgccgctcctgcgtctgtcgcaccgaccccgccggcgctctcacccgagctggcggcgctcttcgcccggctcgcccacaacattcccggcgtaccacaaggcgccgcaccggctgcgtcctccaacgacgcgccgccggctcctgtcctcgacgacaacgcgcgttccgcgctccgctcccaagccgtcgttgttctgaacgtgaaggcgctggtgctcgtgaccctggacatcgccgccggcaactacgctcgatggcgtggtctctttctcgtggttctcggcaaatatgccttgacggaccacgttctctgcgatgctcctcgccccgacctagccgagtgggtgcagatggattgcgtcgtcctcagatagctgtacgactccatctcccaagaccttcaggaagtcttgtcgccgaccgccaccgaccgccaccaactgccacaccacgataaggtttcacccccaccccctaccccggaggtgggcagtcccctcgtgtgctacggtgaatccggcagctggacaaccggatgttggtatttcttagcgacactactggaaatataattcccagcaatagcactagaaataatcctagtatattatggtcacatatgtaatccgcaagtatttcacccggaagtattccaaggtatcgtatttattttatcccaagggaagatatgataagagcgtactatgctaatagtttatatattacttatatacgtcaaagtctatgcaatggttaattcagttcaaaggtagggtgacacacagaagacagaactaagaactactctcactaaaatatagtctaagctaagtggagaaagaataagaaaagtatcattactgtacttctagtatacatacatctcactaaaatatagtctaagctaagtggagaaagaataagaaaagtatcattactgtacttctagtatacatacatctttagtatacagtcatgaaactaataccccgtacccagtgtcctggtgtttcgagaagctacccctgactgccaagttccttacgacaacccgtcatgaccgtataaccggggctaaatacggaggagtaccctcctcagggaattaacttaagactatatacacgcgcggggaatacccgtactgagctgtcaccatcagcggcccacctctcatccgcagcatataaccccaattaatggtatctaataatctaagcaccgcgcttacattactaaatactactctacgtccttgcaaccgacatagagcaaccgaataattggacactaaacccaaaccaatacacctatctggaaagctagatacatgactattgattcaagtataaagtaaagtcgacactcaaataatatgaatggaataaaataccgaacttgtataaagaagaatattctattaattcaataagtcttacaaaagaagaaatgaatgctattaaagccataccggaatctcctgaagactcgaggactatgaagactattctatttcctactccactagcactagaactactaaacaacacttgagagagctcttgatcttcttcttgaggtgtgtgttggagggagtgaggggagctccttaaataggcaacttatgacggttggaaaggtcggaaacaccctccaactgtcatagggagtgaatctccaccgtccataagaaaccctgaatccatcggagcttagaggggagctgggccattctggcctattttcggcaggtggcccccttagctcctctcttatctagaacagtgaattttgggcctattggatcatgtcatctctgagttctcagcccatctatcgataagtctagttctcgacagtgtctgattgatcgttcgtctattgtctgtcgattctcctccgtttataaatacttatcctgcatatatgtaagtagcacagcacatagtggaagtagatattttatttgaaaattatacattgcaagcatagctagtcttcattaattgggtaatattgacggtcgaaactggtcgataacgaccgtcaacacctgacactccggccgacccaactccatcacgcccacccctcgccaccggtgcctaggaaagggtcgagctatactgcaagtcaagtagttacccattcccgcctgtggtaagcactgttagtcttccagagtttcccgtgaaccggtccttaattgccatggtgcgactagcaaaaccatgtacccacagcccaccattcagttgcattttagttggataattacgaccaatgaaacatggccggatgtctcgagcatgcagctcgtctagatactaagaggtctaataatgtaattaacacatcaaccgagctagtggtaattaagcatggctaagcacatagttctagctaggttacataagtaacacgagctagtcgaattatcacccaagtttaataaaggacggatgtcaagtaaacatggcacaagcgagcagataggtaaagccataatcctatgtaattagcaaaacatgcatatttatttgcaaatggtaaaacaattataaattggaatcaacatgctcaagggggaatatgtgactcgccttgcttcttcgaaagaatctcccgaacattgatccttgcgaacgcgatcttccgaaacagcgaattctacgcgctagtatgcaaaatgaggaaaaaactataataaaaaccaagtaaaaagtacattaaaagtaaacaaacatgtagagctcaattttagatgaattttgcaagttgaacggctcaatttggagttcgtatgaattagatatgaattttagaagttttgagccatttaattgaatttctataattaatattgatttattgcgcaattaatactacttatggcgtcagccgagggggaagaggtggcataggcaagtgggccccacctatcggtgattcacgggaggagggctcacggtggaccgagtccacgcgcgcacgggcgggggcacacgtggcaccgacggggcgccgacatggcagccacgtgtgtggacacatgggcggcccggatggaggccggggccgatttgacggccaaaatcggccacgcggtaggggcggcggcgcgtacgcgatgcgcggcggtccaagtggcaacctggtcagacggccaccggcggcggggagatagagggagagggaggggagtgctcaccgtgctcgcgcaacggcgagaaggggacgggaaggcggcggcggtagctcctcggggtggcagcggcgacggtggtccggcggcgttccgtgtgcgggaaccggcggatggctgctgcgaggacatgggaaaagcagtggtagggttaggaggatgggagaaggcgtgagacgatgggaaaaactgaccgaaggcgaatgaattaggagagctcaccggcgcgcaaggggagtggaactctggcgagttcccgatggcttggggcagcggccaaggtctggtggggcgtggcggcgctgtgggtggtggcggcttggccgggcgaggcgacactcgccggcgggaggtggcggtggctcgggttggtggtgggatcggtgctatgggatggtttggggagaaggagtggatgctggtgtgctacactgtgcggcgaagccgacggtggcggtggcgcggcttggcggcggcgggggcggcggtggcgtgcggtcggagatggacgacgagtagtggggagagagagagagagagagagagagagcggcgcggggagagcaaaactgggcgcggagagctcgggcggaaggggaaaaatggagagggaggtgcggtgatgttttttatagccttggggagggagaatcggggccgacgagggcggcaaccggcggtgaagttggtggcgatgtggaggtggagtggcagttaaccggcgctcccacttggcagacttgagggagagagagccgagcgggccgagggaggggaggccggcttgggatggagggggcgggaggaatttgggcgagcccgaaagggaggaaggggaagttttattcattttatttttaatataattgattaaatgaactttgtgctatttcaattatttcttgagctccaaaaattcacggaaaaatccggagagtatattagggcacagagaatattacaaaatatttccggacaattattttgaaaggaaaattttaatttcctcaatatttcacttgattaaattacttcaacttttatttaatttatagaaaatgcattatttaatgatttttaatcccgaatgaaaatcggggcgttacactttccaacaaggcgacctctctgtctccaagtactgttggtgcatcaagacaatggcggacaatctcgccgacctcggcgaaccacaatctgacgcaccctcgtcctaacgctcatcaatggtgacatgcaatctcttctccctgtgcagcaaccttttccaagttttcttcaagccaggtcgtaggtgctactcgaggagatcaccaagggaccgcgtccggcaaccgactcagccaccaccttcgtcgctaccacgaccagcaccaatggcgccactggtggtcgtggcaccaccggcaccacgggcaactcactgggcggaaacggcagcggcatggcggtggcggctccaacaatggtgctggcgctaaccctaatggcggctcgggtgctgcctctaggggacaaccggccggctctcagccggcccaatctggcttggtcgcacggttgacctggccctctccctacaatctgtgggccgacaccattcagatgtggccgggccaagcccacggaccaggcgccttgggacggcctcccttcacaagcgcggcagtggccggccagcccacctaccacacagcgtcgatgcaggccagccttcctcagcatatgggctcagccggttttccaaaccaggccggcctcgctccactccagcttcccgggccgactacatacagcacggccggctctgtccctgcctcgccgcacacatgggccggcccttcacagtgggatccacaggccctcgccagctccttcaacacctctacactgacgccgccaaactccaacgagtgttatatggattcaggtgcatcttcccacatgacctctaatactggtatccttagtgcgtctcatcctctcccccacaactttccctcacatattgttgttggaaatggttcactaattcctatcacttctaccggcactgcttactaaccttgtccgctctgtttctttgttcctttgtgcttaacgatgttttagtgtgtccttccattattaaatacctaattctgcacggtggtttgctcgtgataattggtgttctatttgtgttgacccttttggcctctctgtgaaggattatcaaaccaggatcgagatagccaggtgcaatagttctggtgatttgtcccccctctcggcggactccttacctacgacaacctccggtcaagcctttgtcgcctctacaaccaacaccgacctgcggcatcgccggcttggacatcttggtcacgaagcgctcactcgcttggctcaggctttcgtcatacctcctccgaagggcactacctcgttgtgtcatgcttgtgttaacgaccaaatttagtaatatcagcatcggagatgaagatgggatcgaagcagaatcaaagatgagggttgttgcggaaacagagtaagagtcggctggagtctggatcggctacgactgggatcggctaagtctgagttagactggttaagtgatacagccgattccgacaatatgacccgtttacgacatcgggttcgagttgatgtgcttcaagatgattgccacgcatggatagagtcctagggaggcaattgtatctattaattaggatattttatgtaaattcattagagataaatgtggtaaaagtctgccgcaaagacttatgatatcttagaatttgttagagataagagtcgtgtccaatatggacatatcttgtaattctcgggtataaatagaccccgagccctatgtaatgattaacacacacgttcaatacaatttcggcgcatcgccacccttttttgctttagttttatttcgacgagttcttgctttcgggttgagctgcatcggtttcaatcttcaacaagaggtaatacttgttatggcgatttacgttctcaagattagtgcttccatcttcatgatactctagtcttgtttatgtaattcgtcgagttattatatatcttgcataatctttgacaatatcgtcatctaacctgcaatcggctaacatctgctaccaaaaggcaggcgattaggataaataatgacatcggcttagattatataagatatccaccactctatgaaacatccagcggttgattgtctagatattgttcttcttttcatacttaatgttgtatcagttgagtttgatctattaagtcgtgcttagaatttcaatctctagcctacctactagttgtcgattagggtagtatcggggtttcagccgatcttatctgatttaactatttttatcctatatgcttgattgatatgttaaatctgccctttatgttaagatctcgttgcgtttaggtatattaagcttctgtttgatgtactttatttgctttaatatcttaatatagagtagtatcggagtattagccaatacacgctagatctatctgatcggctatgctatgagcatatatagtcttactgttaatatatattccggtctaagtgatttatactgtctcggcatggtgaccgatctaccccaatcacttgatctaagtatatatcgacataaagattatatattgttaatatctacagccgatcgagtagatttagttcttctttacttattcgtgattgccgatcgatttacatatgacatcggctcaaagataaatgatatgtcatcagcacctagccgatcggctatcatttatggatttaaccacggtttctttgcctttgtttcttgttgattgcaggatcaaatcaactggcacgctcatacatccgaaggcgagttttggacctgcactggagttaagcagatctcccagtcctcgtgttttctgtcaacacgcttttggcacgcccggtgggaccgattagaagtcagaaagcagcttccctcatggctgagaaaccaccgttgtcaccgtcgtcggccagccctagtaatgttaaagaaaagatccagaagctcggtttgactgacgtccatgaaggaaacattgcgcctattgatccagaaaagctcactcctgaacagaagaaagacttcgatgcaatgatgcaacaagcacgagatcaatttttaaattcattcatgcagactcgcaagggcacatttgttcagaggtacaaggtgaaagtagttcctgatgatcctgggaccggttcttctaaggagggagaaaagaaacaagttccagatgactcggcccagccgagtgacaaaggtgttacagatgggtcgacccatgagaaccagggtgaccactttcatggagtacatggagttcaaggtgatggcactcagggaccgcaagcgggaaattttaatcagaacgacaatgcattccaagattttttcaataactttcaagatcgggttgactatgccgtgtataatgctttgattaatcaatctggagtattgactaataccttatcaaatatgatgaaatcggtagccgatggttcaatagctgaacatcaggctgcaggcccaatttatttgcaagggggtacttttccaaattatcggcctttgatcaccgatgttcatccacttactcagggagttcctcctgttgcatcatcagctcagccgacggcaccagcattggctccagcacctgctgcgctgtcgtcggctccaggccaattagtcaatcctcaattattggtaagagagcaatcacagcatcctggaccgaatgtgactcagctaacacaagaccaggttgcatctatgtttctacctcctcagaatgctgttaattcagctcagcggcagccgattcagcaaacaccgcccaggcaacaggttgtgcagcctattcaacaaacatccccaatccagcaggtcgtacaaccagttcagcagacgccaccaaggcgaccggctttacagccgattcagcagacgccgttgagacagcaggtcgttcagccgatccagcagcaaggctcaatgaatgcgtcggctgggtttgcaacacctggtggtcagcctgtgcagtacactacaaatcaggttgtcccggaacacctggttcatcatgtgcaaccagatggctcagtagtacctcaagttattcccgagcatttggcgcgtggtattcagccgaaccttcacaattaccaggggggcaatttgaattatcaatatcagcctccatcaccttaagttcagtaccaacaggcaggatcggctcatcctcagtttgttcatcaatacaatcagtttgagcccacaccacaacaacctcaaggaacacctcaccagcgaccatgggctgatgtgatagctgatgtaatgagggagcaatttgggcttaaaccaaaagagactagaaatttgtattgacaaccttatcctgaatggtttgaaagagttcctctacctaaccggtttaaagtactagatttctcaaaattttcaggacaagacactacatcgacctatgagcacatcagccgatttttagcatagtgtggtgaggcatcggctgtggatgctttgagggttaggttattccggttgtcattggctggatcggcttttacttagttttcttctctgccacatgggtcgattaacagttgggccgatttagaaaagcagtttcatagttatttctatagtgggattcatgagatgaaactgtccgatctcacgtcgatcgagcaaaagcatgatgagccggtgcatgagtatattcaaaggttcagggaaatgaggaataagtgttacagcttgagcttgactgatgcccagttagccgatttggcttttcaagggatgattgctccgatcagggaaaagttctcatctgaagatttcgaaagcttgtcgcaccttacacagaaggtatctttgcatgaacaaaggttcgtggaagctaggaacaactctaggaagattaatcatgtttatccttatatgtatggatcggatgatgaggatgatgattctgaaatagctgcagccgagtgggttaggagcaaaaaggttataccgtgccaatgggtgaagaactcaggaaaagaggagaggtatcactttgacataactaaggctgataagatatttgatttgctacttcgagaaaaacagattcaacttcctgccggacatacaattccatcagctgaagagttgggcaagaagaggtattgtaagtggcataattctgggtctcatacgactaacgattgcaaggtcttcaggcagcaaatccaaacggctgttgagggaggaaaaatcaagtttgatgattcgaagagaccaatgaaggtcgatggtaatccttttcctgttaatatggtacatacagttggccaatcagccgatagggtccgtgcaaagggttttcaggtgaattcggctaatataatcaacaaatatcagaggaagtatgacaagcagcaggagaagcattatgaagaacacgatgacggttttgatcctcattggggttgtgagttctttagattctgctggaatgaagggatgaggttgccatctatcgaaaattgccctgggtgcagtgatatcgttgagagctcaagccggtcatataataggagtaatcggctgaggcaggaaagagtatctgttcatcaaagattgggcccggtgaatcaaggtcgtggccaacaggatgaggtagtcaggacaaatcaatggtgtccttctggtattttcacgaagaatcagaagagaagggttcaaacattgaggaacagggagcgccttcaggaggttgaacaagaaattaaccatcggctgaagaaagtaaagccaagacaggagtggcgtgttaagaatcaggttcctatagccgatgatattgcagccgatgatgaggcaaagaggttggcaaaagggaagagtgttgtaacggcaccaattaacatggtctttaccttgccagccgaattcgggattgatcaagccgatgtagacgaggtggaagaggagtcggctaagttggttctatcaccagaacaagcagtgttcgagaaacctgaggggacagagaatcggcatcttaaaccattgtatataaacggctatgtcaatgggaacccgatgtctaagatgatggtcgatggtggggctgcagtaaacttgatgccttatgctacattcaggaaattgggtaggaacgccgaagacctcatcaagacaaacatggtgctcaaagattttggtggcaatacatcagaaactaaaggggttctgaacgtggagctgacagtcggcagtaaaaccatccctacaacattctttgtcatcgatgggaagggttcttatagcttgttgcttggaagggattggattcatgctaattgttgtatttcttcaaccatgcaccaatgcttgattcaatggcaaggcgacaagatagagatcgtgccagccgacaggtcagtcaatgttgctagtgccgatttagctctttgggagatggatggccttgattgtttatctggaaaagtttgggatggagattttttaaaagtatccgattctgatatacagccaattgaagatggagaacccaagctattattttgagggcgtcgtggagggttcgaacgtctacaccatggatagagtagatgatctcgatgacaaacaaggtcaaggttttatgtcggccgatgatttggaggaaattgatataggtccaggtgatcggccaaggccgacatttattagtaagaatttatctgcagaattcagggccaagttgatagagctcttaaaagaatttagagattgctttgcttgggaatattatgaaatgccaggactcagccaatcgattgttgaacatcggctacctattaaacccggggttaaaccacaccagcaaccgccgagaagatgcaaagccgatatgcttgaacctgttaaggctgagattcaacgcttatatgatgctggttttattcgtccttgtcgatatgctgaatggatttctagtatagttcctgttatcaagacaaacggcaaggttagggtgtgcattgattttagagatttgaacaaagctaccccaaaggacgaatatccaatgccggtggccgatcaactggttgatgctgcgtcagggcacaagattttgagttttatggatggaaatgctggatacaatcaaatttttatggccgaagaagacattcataagacggcttttaggtgtcctggtgcaatcggcttgtttgagtgggttgtgatgactttcggcttgaaaagtgctggagcaacatatcaaagagctatgaattatatataccacgatttaatcggctggttggttgaggtttacattgatgatgtggttgttaagtctaaagagatagaggaccatatagccgatttgaggaaggtttttgagagaaccaggaaatatggcttgaagatgaatccgacaaaatgtgcttttggtgtgtcggcaggtcagttcttgggatttcttgttcatgagagggggattgagattacccaaagaagtatcaatgcgatcaacaagattaaacctctggaggataaaacagaattgcaggagatgatcggcaagattaattttgttagaagacttatttctaatttgtctggaagattagagccttttacgccattattacgattgaaggccgatgagcagttcacttggggggcagagcagcagaaagctttggataatatcaaagaatacttgagttctcctccagttttaattcctccacagaaaggggtaccttttcggttatatttgtcggctggtgagaagtcaatcggcccggttttgattcaagagcttgaaggaaaagaaagggttgtgttttattaagccgtcggctcttggatgcagagactagatattcttctgtggaaaagttgttcttgtgcttatatttttcatgtacgaggttgagtgtcacgcccagaaattcacgaaccagaattttctaagctgaatgtgcattaaacccctgtccagggccagccagggtacacaaacgacaattgttgacatacagatccacgtcttacaaaaatataaaagattacaaatgcagcggaaaaagataaaagcgagctaagcctgcagacttgactcctgcagcggacgactccattccacaggcatccttgacggcagcgacgaaaccaacctcttcgagacatcttcaactgagaaggactccaactctggtgtgggggaaaagagagcaagactgagtactacccactgtactcagcaagtcataccggaagaggaggtatgatgcaagatatatccaagggaggctaaaggttcttttgcataaagccggcatttcaaagcagtaattgaaagcagtaaaacagttgcagtaattaatcaatattaaccaatcactgctcaacgctacaccacgttgagacaggcccaaaccaccacctgaactaaccagttcccaaaagctaactaggggtgagactaatcacggtgaatctggtcgaccgcctataaccgcgggcacggctattcgaatagttttactctgatcagtggtgtacaactgtacccacaagacacagccccacgacacgttcccgtgcgccgacatgccaccacaacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaggccagccgttgcccacactggcttgtggtaagtacgataagttcttccagggcatcccgcgaaccggtccttaatcaccatgggcacgactaacaaaaccatgcacccacagcccaccatgtagtgtattttaattaaccaacaccattacggtagcactaaaccaaagctatgccgataatcaagtctatgctttaatgagattcccctttgtgtactagttgaactaagcatggctaagcatttcctaagccaacatctaatcattttgatacccaagttatcaatgacataaggtaaacaatgtatggttgagtagtatgacccatcccacatgatattgtaaaacaatgtaatatttaatagaaatgcgggacatttgtaaattgggtacaatatgaccaattgtaatgcatgacttgccttgctctcgcactgatgagaccacagcaacgtcttcaaggaaccgcggatcgacgaaacggccgaaatctacgcgacaaacaaagcacacaagcaaaacatgctataagactactgaaacagagaacaaaaccatttttaatggattctacatatttttcttgatttactgagacttgaatggacttaaacggagctcggatgaattagttatgatttttagaagattctctgtgtttttactataaaagaaaaacccttaatcaatttattgcgcaataattcatcccagggctgacgtcagcaaggggtggggcggcgccgacatgcgggccccactggtcagcggcactaagagagggagaaagggggcagctggcaggcggtcccaccgggcagcgtcacaaagggggggaggaggcggcctggctcggctcggcttcaagccggccggccggttatggcgagggcgacggcggtaagcggccgccgacggcggcggccagcgagaagacggcggcggccggcgggaagacgacggcggccagcgacgcgagcgacggcgcatcgcggtgacacgcacgcgaggagcggcggtgcgcgtgagaggaagagaaggggtgggagttctcaccggggattcggccggcgtgggtgaagacgacggcggccggcggcggcaagcagcggacggcggggcgcgcgggatggacgagacgggcctcgacctcgcgagtccaacggcggcaacggagcggcgcggcgacggcactagcgacggctagcggcggttggaggcggcggtaggcggcggcgcgtggggagagcggtgcggcggtggcgcgcggcaagcgagcggcggccgggatagccccccgcgacggcgaagctagcggtggcgacggcttcgcgcggcggcggctctagcagcggcggcgcgcgaccggaggtggcggcaagcggcggcgctagtggcgagcggcgcggcggcggtaggaggcacgggagagcccgcgaaaa

SEQ ID NO: 76082 - DNA, 2877 bp, Oryza sativa
attctgcagaggaactgtacatcaccacatctttatttggcttcaacaattagccttatctgttacctgatttgtttcttatcactgaacaaaatcagctagtagtagaaaatatgttgtcctttctttcctcaactactgttttgacaatgttatgcgagggaatgatgtgttaacatgagacagcatgatgaacttgatgcccctgttttaatccaagtagaagtagctactgtggtccaagagacaagcaacaaccgctgaaaaaccattgtctaccgagtctgatgactaaactactttcttgtggagtcaggaacagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccacgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctggtcaggaagccactagcttggaacagactccccatttgttttgtttttttctttttcatttgcaagacagaatgtaaaaggtagtgcttcatccatttcaaaatataaatatttatagcacttatataccatagtctaaataacttatggaacactgattccaataaataaaaatccatacatttctggctaatcatattttatggtacaattataaataatctaaaatttgactattagtatgataaaagagaacttttttaatcttaatattttgtaaataactttaaaacaaatatggcttaaaattgaggagtaattgaggctccatttttatatgacttttatacgactggttagatttctcgtggtggaaccagtccacccaaattcaaatcctagatttgacacgggtgcttgtatttatggctaattattatttcagtggtagccgatatacgcctagtcttttaaaggtgttcgtatgtgtagggtgtaagtgtacgcgcgctgaggacgcatatgtttaatactgtgtttctcacttctcagtaaaaaaaacgtccgttatatgaaaaaacacagtaattttgaagcaaaacatcgtgatttccaaggtatgtgcgttggcgttgctcacctcacctacccgttcgttactagtagttcgctgcttgcacgatttcccggtgcgccctggccgtccgatctcctcggcgcgggatttcgacggctcagatctcctccctcctcatcactgactcggtccctctccgccgcgaagcgtggcggccaccgtcgcggcgaccacttccacctccagctcgccgccgcagccgcctcctcctccatctccacctccacctcctcctcgcctccgttgggcgagagggagacggagaattctccgctgccatggctccggtgcggctcggggctcccacttccggcgccctgctgcttcttgtcctcctcctcatctgcggcggcggcggaggcggtggcgttgctgccgggggtggaggcggaggtggaggcgggaaggggagctcggtgtacccggcgcccgtggtgtacccgcaccactcccgccagatctcctggaagcccaggttcactttctctcgctcgcgcgggcgccgccatcggttggttcttggtttcgtctcgatctcgacattggatggactgactgatgcgtgatccatggcagggtgttcctctaccagcatttcctcagcgacgacgaggccaaccacctcgtctccctcgtcagtgcccaccacctccccaatccaacaaattttcatttcttttctctgcatgaatcgggagttcttgtggatgcttgaactctgtatgcccaggattcattgagtttttagaggatttatgtttttttttaggcgagaacggagctcaagaggtcagcggtggctgataacctgtccggcaagagcgagctcagcgacgcccgcaccagctccggcaccttcatccgcaagagccaggttaggtcttgattaacgtttttttttctttgaattatttgttcatccggagtgtgagttcatcttttttattgaaaagtatctttgaataaagggggtcttttagtgtatgaagatagatgtgcaatataacttaaagtagttcttggctaaatgagaggattcttcctcccaattttgagaattttcctttaaatttacataattcttatgtaatgaacaatcatgtccaaatttgtaggatccaattgttgctggtatagaggaaaaaattgctgcgtggacatttcttcctaaaggtatttgactccattaagacaataacaatgcactttactattcatgcaattcttagatgttctatataattcataacttacacatgtgagatattgtcattttacacctaataatcaacctccctctgggcctttgttttcgttcctgtacctatgggcagtcttgaagtgaaagcctctaaaatagttatgctccacttggcatttcatttctaaaataaacaaagtaaagcctttaatgttgagcctccttacctg

SEQ ID NO: 76083 - DNA, 1560 bp, Oryza sativa
cttttatatgttggaatttcaaaaaaaaaaaaggtgggcaatttcagatatttcaaacgctaaaagggactgatttactgaactagaacaatatctttgccaaactaaatcaaactaaaatatctatagccggaggctcctcatacattaaattcctaatacttcatttcaaaattgtgaacctcctgccttagccatcactgacaaacaatcaaaattaaactacggatatttcatatttctacaattctactcaacaaaagctatggcgaatgatcaagctaattaataactccagttttcttaaaagtacaaaacgaacaacataattagtgagagcaagtacatgcttaccagggaactgtgggccctcaccggagggcgagacggctgccggcgaaggcgacggcgttgggcccattggaacattgaatccaaaggctgcaaaattaattatttcccaaacttaattagcccataatatgcttactaatcaaaagcaaataccctcaccaaaagtatagagctattacttttatcattaagacctatatatcctgcatataacaaaaaccaaaccaattctagcaatcatttgctcgattctgtcaaatcaatttcactcgtatgctcaatatgcatatgccaaaagatgagtagcatcgaaatcaaataataaatctgaaaccattttacctaatatagtagtatattagtatgcatataacaaaaacaaagaaacatatctctatatgcaaccaataataagtaattaagatataaatctagtttaactttttttttatggagagagtgctgctgctactgctactagaagtgattaaagtgataattgggggagattaataagattaaagattagggaggtgattgattgcctgcgcaggtggagacgggaggggtggagacgcggcagatggcggggagggcgagggcgcgggagtagtcgacggcgatgccgtaggagtcgccggcgccggagaggagctcgcagaggcacaccgggttggactccaccagcccggccagctccgggcagcacggcttgtccggccgccgcgccctgctcccgttctgcacgtacgtcaggcagtccgacatgttcagcagcgccgtcaggcacgcctggtccagcaccggccccgctggccccggcgccgccgccggcgccgactgcgcctccgccgtcgtcgccgccgacgccgccagtagtactactacggcgactgccaccgccgccagcgtcgacgtcggccaccgccgctgcgccgccatggcgcgctctctgggggctttgatggcgagtggttcgttaggcggtggaaggagaggagaggagaggaatcgaaaatgaattcggaggcgtcgtgtgacactggcttgtcctgcagggtacacacgtatatatagagtgatgcgtctttttttctaaaaaaaaattcaggttacacaccaccgcgtccaccttgccagatataaatgtgttcacttagggtgtgtcttagttgaggaaataaaaatttttgggtgccatattgg

SEQ ID NO: 76084 - DNA, 2383 bp, Oryza sativa
tgatgatgcactgcaagtattgtggagaagaaaatcacaactcagggggttgtaaactaaagaagcagggcatcagttctgaggaggcaaagaggatggttgccacagcaaaagaatcacttgcaatggagattcaacaaaatatcactgaacaagaaccaaatgttatcaaccaggtaaaatatcactgaacataactcctctgttgcacatgttttttttgcatgtcttatgaactacatgacctatggtatatataggatgtcatagatgaacatattgctgcttctcagacttcatctcaactactatcacagctaggaagcactgtttttagtcagatggctgatcaggtaatgttgttttcaatcatttcaatctcacattgcaaactacttgtcattgcaaactatttatcatgtatatatgttctgaattttgcagccaaatcaaagttctgtgctatctcaacaactaggcccattgccagatcctgcctttatcatgtctaacattccatcagcaaggccagctcctcttacaaccaacaccaaattagggaagtcagtggcactgaagaaaagaaagaccacaactggaaacaagaagtctgcaagtgccgcatcaaaaaagaagcctgcacctgggattggaacaaattaatgcctattagttagctgggaatatattttgtttagtgacaatctgacaaaaaatggtgttttggttgtcaacacactgtgatgtatataatggattaaaaatatgctatatcagctgcatgctgtagtgcaagtgcatggctacttgctgattgccagaattatagttgcattttgtgatactaagtgctgaaagtatctgaaatggatgttctgcctttttactgaatgtgtgcctcattttgcctttgcaatattgtgcctcaaatattctatgaattgaacaagcattccttcaaaatttgtatagacccaacattcacaaagatgcagattaaagaaactggctattttattcatcacacaccatgcatttttagtgcatttcacacattacacatttcaaccactcctaaagaaagcatacatatttgtcaccgcaacaaccacacaggcagctactacacatctcaataaggcaacaatatccctaccaatgtctatcaacaagttcatcctcctaacaagcactttaatctgctcagcaatttgctctgcatcattttcaacatatggttgtgcaccctgttgaaccattgcatttgtctgaacacgcacagcagaacatggactctgaatatgcacagcacgagatgcaagatgcccagtattaatcaagtactcctcatattgttcctcccagtaccaaaagcgacatccaattccatctcgctgcgcaaaaaatgtacaaaattaacctcagcaaaccgatgcgaattgaaaattttccaccacaacacagattatagaagagaagaactaacctgatggcaagggcaagtgtaaaatatgcgccctttattctcaggcgtattagccgcacgcctaatgattgtctcacaatcgcaacaagggcacttaatcagagggaaacgcccctttcccttccgccgattcgtcgacgatgaactcgagcccccttccatggcgccaatcaaattgaagggcttcactctagatacgccaaatggaaccaattggatgccccgcatccgagcttgaagaagagggcgacgaactgaagatggaggcgacgaatcgagcctccctagggtttcacggcttagctcgatggggaaaaaaaagcgaaagagtgggggatttatcgtctgagggctggcgaaaaaataaggggcttaatgcataatgcaccaccccggctgtctcctcccctccacgttggcaagccacgtcagcgagcagaccgagtcaaatggggtttggacaggcaatgtacggctaagcaagtttagggacctgtaaatacgatttgagagtttggggacctagatgacacacccttacaagtttgaggaccgctggtgcactttactcttcaaaatatttcttcaaacttctaattttttcgtcacattaaaactttcctacacacataaactttcaacttttccgtcacatcgttccaatttcaaccaaacttccaattttggcgtgaactaaacacaaccatatatgtgaggaaggcacttgacaagctttgcttggttattcgtattttcttcgattccaaaataaacaaatttaatatagagataatccattgtatgccactgagtttgtcatgggtctataatttgccactgactttgtcacgttctataatataccatcgatttttgcttaacttctacgatttacca

SEQ ID NO: 76085 - DNA, 593 bp, Oryza sativa
ctcttgcacttaaggaccgttccttggaatttcatccaaacataagacaagtacgaccacatgggtggaatgggacacccctggctgagtacctagcttatcagggaagccttgatgccgagagacatgtggattcgcgggggtggtgtcggggaggacccctgggcttcctggcacagtatggtctggaacctaacctgttgttggtctgggacccctctcgtcggcatatggtaaacctgtgtcggctttcgaaatgccttgtcatgaaagcttggaggtctcccgacgtggctgatccccacgggctggtgatccgggttagtaatgtcgtgagggtaaagtgtaccccctctgcagaggttaacaaactgttcgaacagtcgtgcccacggtcatgggcggatgtgaggtgatttctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgttgaaaagctgttggccgggtgccaaccttgtttcaattc

SEQ ID NO: 76086 - DNA, 7152 bp, Oryza sativa
cccatccagctgctgccgaaccgatcggatcggaagcagacgcagaattccactcaaaaccagcgagatcgaacacgaccagcgggggaatttcgcgggggcggtggttaccgagatcggcgacggcgacggcgacggcgacggcgatctcctcctctccttctctcccctgctctccccgcggcggcgtccggctccctcctcctcgcgggcgcggatggatcgcaggtggagaggagaaatgggcggagagggagaggagatagatggggagagagaggtcgttgaaatcgcgcaagggaggaggttatataggagggggagggggaggggctgggtcaccggcaggtggggcccacgtgggtttgtggtgagggcgtggaggggcaggttggagggccctgctggtaggtgggccccggaaatgtgcggtacgcgtcggtggtcactaggaattttgcgattatatataccctcccggagtgcagggttcgacctgtgggtttactgatttgtatggggtcaccgaaattctaaaatttcagaaattttagaaatattgtggaaattttggacgaatttttttgaaaaaatttgaatacaaatttgaaaattgcgggcgaaatttctgaaaaatgaaaaaaaaacagatagcaacaaaatccgttcggcaagcatacaagttgcaactactgcatcacaaattcacaaaatacagccaaacaaaacccactcacagatgataaaatgtaggttcaaagtctgaacagcagcacatcaacacatcaggcgaacaatatagtgagaacaaacaaatgtgaaaagagggataataacgaaccttggtcatgcctgagtccgtgcctaccttagtttgccattcttctttgcactctaagcctgaccttaaaaatggacctttgagctccacctcttctcttgttccttgcctttctgggattacctcgagggcaacctcaataagggattcaaatgggatgagactgtcaattttgttgctctatgcgagctccagagccgcccatattgctgccacctcccgcttctatcaccgtagcagctcagcctcctcctcctttcgtgctacaacgataaggtagagatgacgcataactaggatgatgacaactaggtaacgtggcataaagatgatgatggtgaagcttcgaggacagctgatgaggttaccggtagtgcaccgagacatggcgaaggggacataaaagagtggctcttcatgtagctcggtgagactgagatagaggcatgaaagaaaactgcagtatataactctattttataatgcatgctaagctatggtatttttgttcccaacaataatttacataaggtaagattcgggatcatgcactattttaccacataaaatttatatatagtattaaatggatttcaattatcaacttatactacgggtagttatgaaaacaattcaaataacataattgcccttcatttacgatgcattgaaacatacaaaccatttatccatgagaacagtagtagcatttatttagtttctttatatatctatttagtttttttttgacgcgtagcattcgttcattaagggaaatagaaaaacaaacagttgcaagaagttctaacaggaactacatttataataagtgagagactattcaaataagagatttaatatttcaaaaatgtactccatccattcctaaatataaggcacaactactctcaacccaaagaccaagaaataattattatcaccttatagattgggttatcctaataaatagaatgcatgcacccaataaaattagattgggctatcctaataaatagaatgcacgcgcccaataaaattagagatcttgatggtgtaggatttaaataatacttccttcgtttcacaatgtaagtcattctagcatttttcacgttcatattgatattaatgaatctagatacatcaatatgaatgtgggaaatgctagaatgacttacattgtaaaacggaggaagtaatattccagtgaaaagagtgctagttaataacatgcatgcatgtctgccttatattatgaaataactttaaataaaagaacgttgtgccttgtattattgaatggagtattgaagttctacggtgacatggaattaaggaagagactattcaattattgtttttcatatcccaaacagtttttttctctatcatgattttgaacagtgccaagattttttttaatttcaaacaaaaacaagctggagtactagtaaaataaataaaatggcccaatgaccaagtgacatgccccatttccacccctcctatttcctctctttcacgcatctcgactccatctcactctcccccctccctcctctctcgctcgctgcgatctgcactgctactccggtaggtctcctcccccccccccttcctcgcgcggccgcggccaccgccggcgagaagcccgccgcggcggcgctgaccccctccgcctcttcccgcgcgcggccccgccagccggccaccgtctcgggtcaaatcgaatcgaatcgaatccaaaggtattctcttcgctcttctcctccgcgggccgcttggattgatggctcggggtcgcgtaggtaggggaatctgttcgcgggttggattgggttgggttggattttcttctccttcccaattagccccccgtccagtttgttctagatttctgtgatgcgtctggtactgatggatgttagtttttgcagaggaaaatctggggttcagttgaaccctaatgcccccaggttaggtcagcctcgctgggtatcgcggctgctgaggttacttggagaggggtagggtggaatcctcgggggctgatttggtgtaattgagagcgccgattcatgattcaggcaatggcttcgcatgctggaggtagtggcggcggcggcggtggaagtggccgggatgctggctcggcgcagcgcgggccgatgcaggggttggcgaggcaagggtcgctgtatgggcttacactcaatgaggttcagagccagttgggggagccgttgcttagtatgaaccttgatgagctgcttaaaagcgtgtttcctgatggcgcggaccttgacggtggcggtggcggtggcggcatcgcgggccagtctcagccggccctggggctgcagcgccaggggagcatcacgatgcctccggagctgagcaagaagacggtggatgaggtgtggaagggcatccaggatgtgccgaagaggggtgctgaggagggtggccggtggaggcgggagaggcagccgaccctgggggagatgacgcttgaggatttcctggtcaaagctggggttgtcacggatccgaacgatttgccaggaaacatggatgtggtagggggcgctgctgcggctgcagctggtacgtctgatttgaatgccggagcacagtggctacagcagtatcaccagcaggctttggagccccagcatccaagcataggtgctccttacatggcaactcacctggcacctcagccattagctgttgctacaggtgctgttttggatccaatttactccgatggccagatcacttcgccaatgctcggggctctttctgatcctcagacacctgggcgcaaacgctgtgccacaggggagattgcagataagctagtagaaagaaggcagaagaggatgataaaaaacagggaatcagctgccaggtcaagagcgaggaagcaggtatgattaatccttcctacttagaattttctatatattgtatgctcttactttgcttattataatttactgctttcaaacataaaggcctcatggattctttttttttaatctctggatgtattaagttggcatttctcttactcatacagtatttagtctaatatatcaatatatatgttatatctttccaaagctgtaagaacataccagttgcagtagcattggaatgccattttccccttcttttatggatcatgtatatttatttcaccgctgtgtgcattctaactggcaggcttacactaatgagcttgaaaacaaagttcttcgtctagaagaggagaatgagaggctaaagaagcagaaggtactttctctgctgttaccattgtactgtttctattttgtcattcctttagacaaatgatattccactaaggactactccctgtgttattatgttgatatggctttgaaatactgttgttgcacagtcgacaattcctgttttattttagctagttatttttttctctcgctatccacttgccacagttgttacaccaacaggtccaaagtggtaacagataactagataagtgctatatacttttgtaattgtgttagtaatttctatttgatctgtttacttaaggattatgctatgttctccttataaatggcaaatgtaccagatgtagttactactatatttgaactatgaaacaatcaaatgaggctttgattttgacttgctatatatgcaagtgcctttgactttctaaggagacctatatgaagttcttgaggattttaatcaacttatcatgctacattatactcctatatatcagcattaaatatgtgaaacactagtattgtcatcaccaattttgcgcatcattgcaatcttttaaagtgtaaattttaaatgttgcaatgttgcatacattaaatcactgaacacttaggtgggcctcctttttttggttgccttttatttatcaatcatggtaatgatttatcaaccaaacatgccttttctaagatttttgcatatgaaactactctgtatatctgtagagctttacgggttatacatgtgctgcaattccatagtaattcaccaagatgcttgattcccatgcccttaactttgggccttttccccttgaacagagacttgatgctgaacaaagtcacaaacatctctctgtactattagcataatagaattgatggcccgttgatatttgacaaacggttttatgacattccattatagtatttcttacagtttagaaacgaagtgaatcatgctgcccttgttcttgagattgggtaagcaagaccggcaatgccatttagcttatagcatcttgttactgttcattcatgttgatgtcccttatgagatgattttgtcccccgctgtttccaggagttggatgagatactgaactccgcgcctcccccggaacccaagtatcaactcaggcgaacaagctcggccgccttctgatggtgacgatgtccatagtaaattttgtagattatatggggtctgcccacatatttcgcatcctttggcggtaggaacaatcgatatagcttgagattccatcttccccctccagccggtggtggtttagagcttgtaaacaccagcaccagcagagccctagccatgtcgccccagctgctgatctcttcggaggctttgtcacttgtcagtatgtaaattctccaaggcacgtgtcgctgttaagttctcagagctccttggttatacatgattgggccctttgcctgtttcttgtggttggttgatacttagtacttggttgtgatcagtgtacgtgtggagacttttgttatggcctgatcaacatcagttcccctgtttcggctaagataacgatgggtgataagttgacggctcacccatgcaacacatatcgtatgcctgtctgggggagcagagttttagattgtgagaagtagctgatgggaatctagagctttttgggtttaatttattttctgaattttgtaactacagtttcttagaatggaagttggattgatcgagaaagctggagactttatgaatagctgtagttgttagaagctcctccaaacaaactctcgcgtggtagtctgtttctcgtaatctggatggaaagttagaatgtttgagagtgttggagattccagaaatagctgcagcagacagaagctcctccgatcattggagctccaaatctcgtggtttgtgtcgaatttcgaatgaatttcacgagataattccgtgtttctggggctcgcatctcatcatttccccgtgctttcctgcacgtgcaatcattcggacagtttggcccggaatcatgcatccatccatgcgtcatgactcatgagtcctatagactactcgtgctagtacaaggaggaaggagagccgaaagcagcagcaggctaggctgggttaggctgctctgcttcgcgtcgcatgtgccgtgcatggctcagggcacgctctgaatctgatctgacgaacggaatgcaattagccatggcatggcaagcgcatgcaggctggctgtcaaatggactaatccaactcgcagcctctcaccacatgcccatcatcacgcccatccactcctaatcacctccacttcattactcacatggaagccgtgtgagcttaattaagctcatataagctgaacacttcactgcaacagcctacattcatactgtccagcaaagtgagccgcaagcaggtcaccaaagccatgagatctgccaccatttgtgtcctctgcatttgcattctcatgatcctgcaatgctttgccagcatcagtgcagtggatcttggcgatgctgcagcttcagcgtcagggggagaaggcctgatccggccgaggaagctgctgcagaatgcgccggcggcgaggtcaccgccgtcgcgctccgccgccgccgtggaggtcgaggtcaatgcgagcctggggaagcagaagccgtcgagcaagtcgaatcccaggcagaattagaagctaagctactatcagtagacgacacacgctcacatggagctcttccgagatgtggctgtagaaatgtacataggaattttgatgtggaattttagtttcttcctcgttttccctttgcaagtagagtgttcaccatcaacatcatcaacagttcatcaccagtgatagtgtagttgcttacaaaatcagaggatctgaataggcgagttcccttcttttatgttgctgtcttgattgcttctgcctcctttggacacccttgaattttgatgatagcttctagttcctgatgattagtttggttttg

SEQ ID NO: 76087 - DNA, 4354 bp, Oryza sativa
aaaacagctgttcaaatatctgatggaagaagcaggtgagaggaacccattattgcaatcaacacaacaattcctggttcacatttcacaatcgactgtttgatgaaatcctgaattcgaccaatccaaatggagcaaaaggtaaatactaacatcaactgaattagaatgggaacgaagggtaagttgatccctatgtgaagatacatctacactactttctaaaatgttaatcaacgacacatgttgctccttgtccatcatgctgcatggctcgcaaacaaattttcaccatggcctccgcccaccgatacgcctggcaagttgcatgtccttttgcactgcagaacaaacgtttatttgttaaaccacacaatgacaacgctgataagctttacagggaatagcaagcagcatatttcacacctcaaaactcacaaaccaactaattctccctatgtttaatcaataatcatgataaatttaagagtatgaaaactagatatgacattaaatataaacacatgtattaagaatcatcctgcaattagaatgttattcctataaaaaaatagaatgcttttgaagtggatgcgtatatgatatcatgtaggctgtggcatatatgatatccatttagcataataatataaagggagaaaaagaaagagaaaagttcattcagaatgacaacttactgatggtaacacgcttagcatggatggcgcagagatttgacacttcaaatatgtccactaagtggtattctgctgcctgcaggagagggaaaaccactggaaatttgcaggacagcaagtaaataacataatttattttgtgagaattaagtcagctctttgttccttttcctggttatgcagaaacagacatggctggaaagaaggaactgaaattggtatactctatgatagcaatcttgaacagacacaacaaaatagggaggttgcatatttgtagtatataggtgttctactgaaaaaggataataatttagcaatctgactcataaatcaacacacagagatattcattttattgatcatggaagatttgtacatttttcagttacactcttgagccgtgacttgagtcttgaagcagaatggaatttaaacagtataattcagtctgacccttccctaactaagccatcagttgtaaacttataataaacaggtttgaccactgacctcttgcaatgcaaggagagcttcaagggtccaccgtgacacatcctttaatagaaatcagtgatctccctgacctgcaaattttatcggcacaaaaagcttccatcacacaagtttgcactacgaaatatttgatatagagagaaggcaggttcaggatgtacccaccagccgagaaaatggtgcaaacgggatcagcagttcggtggttttctgaaatttcctgatctcccgcagtgccactgtgcctggacggaagcggtgtggcttcctctgcttcgtttgctgcctaggcgtccctgcttcacacacatgttaaagttatttaatcacaggagaacaaaaggagagcaattccaaagccaagacttccatatggatacctatcatctaggtagaacagacgctatttgaaccatgacactaaagaaagtttactaaatcagttcccacgatgcaaagactaataatggatgagcataaaaatcacctatcaacatcgtgtctaaaaaccacacatttcttggctagcaatgcttaataccatgttttatggtcataatgtttcagataacccctccatggaccaaactggatttgctattatttcagaatgaaaacaagaaaagctttgactgatgagcaattgaagatctttctgcaactactgttcttataatatattcagaaaacaacgatgaggaaagtacagcacacggtaaaacagagcaagaaaagggacacattgagcccctcaggtcccccggaatccaagagacagaaaggaaaagctccaacgagcccatgaataaccctagaaacccccccaagagaacgcacctgaagccgatgttccagccgcgctcctctgcattccatcaaacaggtggtgagcaagccatccatccagccaagatacaaaacaaaaacatatccccccacaaaatcaaaaaatcaccaaacgaaagacccgctcccgcacgcaccgtggtcgccgaggtacccgtgccgcctgcaaaggggacaagcaagaggcgggaaggggggggggggggcataagcttcaccatccaccgccattgaaagaaaaaggaaaaaaaaaaagaaacgcagagggggagagagcgcgcgctcaccaccagcgcgctgcgccttcgacggccgaggggagcgttcgaactggagcttcttcttgggctccgccttcgacttcctcaccgccgggtgcttcgtgcgagccatctcggcgtcggcggcggcggcggcggcggcggcgacgtggcggtgggttttcaaactgaagcggcgtggaggcaaacgggagagggtttcttttggttttgggttggggatccctttttgcggttaggcccttggttttgttgttatttatgggtcagtctgtgtcagttgcgtttttcacatcccacaaggccacaacgccacgcgcgcgtatgtgtccaacggtcgagtgatcgagttatgtttcttgtttttttttccttttttgcgaaatggagttacgtttcttgaattctatcccagaatagtcatttcttgacattatttgacactgacaggactgaaactaacactatgcaaaatttaccaaaaagaaaaggatgtcaatgcaacggtcgaatgaaagattgaagaggaatgtttttttttccttcaaaacaggcactttcccctttgttttgcaggaataattaaacatgaatgcatggcaagctcggtgtagggatggacatggcctgacccacatttaatacctggaccactcaagttcaattaaatgaacaaaaattcacacgacatggtggatcaaggattatccactggttagttcatgccatcgaaataatactcgaccgacggaggaaagaccgcccacatgactttttattaagaagcaacctcaaccagatcggccaacgcgaaccttgacctccacatacggaactcacccctatggatcactaaaggtgagtttgacgataaggtgattgaggagattaggaagatacgcaaaaacgaggtgagccattggctcatgattaattgagcattaactattttaaagttcaaaaatgaattaatatgattttttaaagttcaccgtttagtagtttgggaagcatgcatgtgaaaaacgagatgtttttctctctcaatctcccagatctcccaggaacgaacaaagcctaactccttaaccgtgcttcgagatccctacccctacacaattatccaaaatccatgcaacatatttggcagtagctatccattttttctctttttttggaaatcaggtaaatatgttacccggcttgctattcaatttcacccagaatatagtgaaaatgtgaaatccgcaccgctcataattttttcggacgaggtgacaacagaacagctacagttttgctaccatttcagcagccgacacagatgaaaatttcagataaggcagccagccattcgctgcagaagtattagcagtacagatactagtatttttcctgaagaaatcgatcaatctgagaagcttctgctgctgctgctgctgctactgtgggcggagggaggagaggaggacgtcctggagggcgctgtccttgttcatggcggccttgaactcgtcgaaggtgaccttgccgtcgctgtcggcgtccatctggtcgaacacctcgtccagcttccccggctccgttatgtcgcctggcaggcactcctccggcaacgccttgtgaggatcaccaaagttcagatgaacagcagctcgtcagattttcaactcaaaacttgaaaagagacatgaacaagccatctcaagaagagcaaagatttggttttccttttttaggagttcttactcggagcattgatgccagctcttccttgctgatgcagcctgaccgatcagcgtcgtacatctgaaaagaaaaatgcagtttttttttgtgtgctcatgatcagatgctgaaatacctctcttgttatgaattttaattgaatttgaagttatgtatgatatgatatcatgcaatgtttctgatattcctgtacataaattggaagggctgccacttcagtttgagtcgagtgcatttggaaatttttacctggaagcacagggc

SEQ ID NO: 76088 - DNA, 10469 bp, Oryza sativa
atattatacatacatgttgcaaatgccagttctaagtagtggaattggtaagttggtatacaatttgtttaaagtatgatttggctcatgagttctggatatttattcaaagccaaatcatatttgtttttatggatcaccatagaagatatagatttcatagttattgcaccatgaaagctttggttattagtaattcggctaatgtcaaccgtcaatgtgatgatttgttctagagttgttttctttaggaacattggcattgttaatattttgcaagccataacaaatgaaaaaagataaagactcacaaggactaccaggcccaaagaccgtatccttgtcccctcgatccattgccgcccgcgcgctacttagcctcgatagttcggtgtcgcgcaggcatatgtacaacagctagggatgaaactggttcggatagtttccgtccgtccggaccatttttcggattcggatagtttcggtcggaactattcggaaattctcggattctgaaacgaattcggattttttttctcgaagacgaaaacgaatacaataagggtactatccgtcggaattggaaaatggtcggaaactatctggaatttttttatatcagcagacattgagcaaattttagaaaaaacacgtagatatatataatttttttatacggaatcagatgaagacaaactttatatcaacatttgtagagttccatgagatctacaactttcttatttactattttattatttaaggtcatttaagtgtctaaatattcattataatataccatattaatttttacaaaatctcagatctacaattcaaacgacatctgatggagatgtgtttcataccaaagttgtagagctcaacgggatctaccactttgtagtttataacatttgtatttgaaagcatttaaagcataaaacaaatatttcaagtttcgaagatgtgaagtaaaataaataacatctccaatttatacaatggcaagtaagttatacatctagtaaaacgtcttgagaatagaaaatgataatcatatttgcatatgaatctcttagaggaacaaccatgaaaattgattttcacatacggttgtgagaccgtctataaaattaaattgacgatataaatgttggagatgttgaactacaataataataagtgatatctcttccttgatcaagaaattcaatttgaggggctttttatataccggtaaatattcactaccgtattcgttccgtctcgtattcgctccgtatctgtattcgataatattcgattttatttccgtatccgagttttcgattccgattctgattcccaaaaaaaagtatgaaaacgaatatgataaagctagtttccatccatttccgatccgttttcacaacagcaaatcaattcctaatctccgttggatcgcatcagcaagaaaccaacaatgcagcaaaagggagtatgtccgtgtgcatccatcagttcgtgagacgttcactgtgccattacatttcccgactttatttttcttctctaagtttcaaattcatgttataaacacgcaggaatttatttgtttatttcatcaatcctcatcgtgtcttcttaaatgtatgattttggttatgaaataggagtttatttattcaattcaccaatccatattaagtgaagatatatactttgattctatagtttagatctcttgtcttaccaggggcggcagcaacttattactgggcaatttggctctcatgaatttggatcaaggaatgatgtggtttttgatagcaaaattatttcttctcctttgcaggttattttcttgattacacattggctccgatcgtgggttattctctagaaaccaaatttgtaggattttgtcacttcggcttgtctatatttggagcaagtggtcaaggagtttttttaccccggcaaatgggtggtgacctagtttttgggttgttgggcattgatcttccacattggttttttctcttattttgagtgtattgaagtttgttggttgtgtacgctgtcatggtgcagaggccgagagtattctctgaatgactaatctctataaagttttcattaccttaaaaaaaaaactttgattctacagtgtttttaaaaatttagggccatgttatgtgattcgcacacgggtctctaattcctacgtctttccacatgcacggcgaatagactccaggtgcttgcaacgtcattggctcatctccaggttcgttcatataatgcaggtggtttggagtcttatatcccaagtcttcttattttaaagatgatgaagaagaagaaggcttaattaagaccgcgctgaagagacgatgttaattcccacgggcacgtatattagatatagactctattagaaagactgcaacgccaggtgccaacctctagtctctaggttccttgacataatggcacattgtgggagtcttttatattccaagtcttgtttttttaaaaagaagaagaaaattagatgtgtccaagccatcgagaagacgtatcaacgcatttccacattttcatagaataaactccattacaaggacggtaacataaggcgctcgcctgtccttcacttgatggtgaatggtagtctttgtatctaagtctttttcttaaaaaagaaagatcgaaacgaagataaaatagatggatccaagactgctgaggagaaataatgccaacttattccacgggagcctcgaatagaatccattacaagaatggcaatgtcaggtgctcaaccattcaggtcttcaatttggtggtgcctactcgttccgtaccaaaataaatcaacgtgtaataagatgtgacctaatctaataaaacgggacggaacaagtaattcggagtgtttgtattgaagtctctattttattattaagaaagacaaataggtggttccagcgcattcccacaggcacgtcgaaaatactccattacaagtagggatgaaactagttcagatagtttccgtccgtccggaccaatttatggattcggaaaaattcggtcggaactatccggaatttctcggattcgaaaacgaattcggatttttttttctcggatacgaaaacgaatacagtaagggtgatattcgacggaatcggaaaacggtcggaaactatccgggatttttcattggatatccagagatatttttcaaaaaaaaaaacaacaacaaaaaaaaaacccagaaaccctagccggctagccggccgcgccagctgcatgctgcagccatccgtcaccgcgcgagcctgcctgctgccgccgccgccgtccgctgcgcgagctcgcccgccgccgccggccgcgggagcccgccgcggctcccacccaccgacgccgccgcggcgcgagccgccgctcgagctcgcccgccgccgccggccgtgggagcccgccgagggtcccactgccgccgccgccgcccgtcgccgcctgccccgcctcgcgagcccgcgcgccgctcttggccggtcgccgcctgccgcgccccgcgccgctcttggctggccgccgccgccctgtgcctgtggatgagaggaagtgaaagagagagagagtagaaagtgtgtgtgagagagagaggagaggaagagtcaagaggataaggttgggggtgaaaaaaatggtggattttttttcaatgtaaaaatcaatttttattttatatgtggctctttaaaacgaatttaaaggcactaaatcaactcatataaaaaagttgttaaaaataaagttgtataacttattgagatctattatttttattttggtcatttctccatccgagtttgattaaactatataaaatttgaatttaaaaatataagaaattcaaataattttccaggttgtaaatgatttcaaatgaaaaaattgtcaacaacaaagttgtataacacatcaacatctacaacttttgttttggtcatttttctatatgactttgtttgaaccgtttgaatttgaatttcaaaatatgacaacttcaaataatattttgaaatactaaataatttcaactgaaaaagtcatcaacaacaaagttgtataactcattaagatctataacttttattttggtcatttcttcatccgacaaagtgattataacattgtacacaaaatttgcatttatctcatttggtttattaaactataagagagatatgtaaactttgtgaaaaatattattatcaatttatcggatgaagaaatgaccaaaataaaagttgtatgtcttgatgagctctgcaactttcatgttcgtgtacaggtgaaattaattacatcttcaaaatattatttgaagttttgaaattcaaatttttaattgataaaacaaagtcacaagaaaaaatggccaaaataatagcagcaagaacacaataacatgatagagtatgattttagaaacatttagaaaaaagaatcatctaatttggagttcatatgagtgagataaattagtttcaaatttccaaattttatttctgcatacggcttcttaagtcacccgtatgggaaaattgatttttttcatgcgggtccttaaatggtccacatacaaacaaatgaaaaaattcaattctgaaaaataaccaatcaaatatttaaaaactttcaattgaaatgttcaacccaaaatttaaaatattcaaccaattttcaaaaatttcaatgtgcctatgaaaattttagtgatacacattaatttatttgtttcatgataacataaatttatatggaaagtaaacataacattttctatctcctccttgccattataaatagagataaaatttaaaaatactgatgttttgtttttgaaaactaatggctacatatcttcctcgttttaagaagcttattttgaggggtattatattttgataattattcgttaccgtattcgtttcgattcgtattcgctccgtatttgtattcgataataatcgattccgttttcatatcgggtttccgattctgatttcgattccaataaaaaaaatgaaaacgaatgatagagctagcttccgaccgtattcgatccgttttcatccctaattacaaggatggcagcttcgttcactcatggaccactaaactatgatgcctggttcaatgtctttttatatccatctcttttttttttagaaaggagaaaaaaaacaacaaggttgtacgggtgctgaggaggggcatcaacgcgttcccaaaggtgcaccgaatagatcgtctctaattacaacgcgcacacatgtctgtttgcccggtagcatgtgacaagcatcgactatgaagcaatcttattgaaactggataaaagggtggaaggatttctcctgcaaacataatcccaactcaaacactatttcgtagttcccatacttaccatgtcatacaaacactctttatacaaactatatgtgtcaaaggtttggtttcctcacaataaactcatccaatcacctctcttctctcatcatttctctctcttctaattatctatcttgtcaacttattttttttacagcttatttaatgctacaaaaactagctaggtatatggctggaactaccctgacaaacctcaccacctccatgcccttcactggcaccaccaaaccacttgttggatgacattaaaggcaaaataaacttcgttaatctgctttgaaattttaatgtgtcaaaaaaaatccatactttgaaattttgttttaagcttttaaccggaaaactattttaaccccacaagaggatgttccttcatttgtcttaaaaaaatcatccaaatagttatgcagaattttgaaaaaagaaatataacattcatacttacaacatatatctgctgaattctttttctatctcattgtgttggtcaaatttgatattaattctggcggactgctacatttcccttcatttgtcttaaaaaaatcatccaaatagttatgcagaattttgaaaaaaataaatataacattcatacttacaacatatatctgctgaattctttttctatctcattgtgttggtcaaatttgaaattaattctggcggactgctacatttcattatactctacattatcaaaaataatatttttcaataactattcatatggaatttggaagaaaaatatacatgagagaacattcctcggagatattagaatctattccaaatatgatcatatatatactaaaaatttaaatgttcatgacagtaattcgaattggattgcattaagtgcttactttatgggcaacaacatctctttacaccactacggaaaggctcatcactcccggtttgcaacccattttactcccggtttgcaaaccgggacacctaatccgggactaaagttatctatctttagtctcggctaaaataacagggagtaaagatggatttttaagtcccggttggtaagatggcggcaccattagtccggttggttagtttttttttctttttgttgttatttttctgctcgcatttattgtcacccttaaatgccccacaaatcattcacaacaaatcatacacaattgcctatccataaaatcatccacactccacaagtcattcataaaatcatccccaaatctaaaataatccataacaaagtttataaatcattcaaaaaaatctaaaataaactcaaaaaacacaaccctgccgccgccgcccggtggcctcccctcccgccggatatggaggaggggaggccgcccggccgtgcgccgcatcgctcccatcccgccgccgctgccgctacgaccgcccggccaccgccggaggggaggccgccacccgcagctcatgcgtggccgcggccgtgcgccgcctcctcgcagccgccacccggcctacgcccgccgtcgccggagtgggaggagtggggagggggaggagaggggaagcggccggaggaaggggaggagagagggggagggggaggaggtagaggagaaaatgagaagggagaagtagaggacgagttcgatgggaggagcagaggaggaggggatcggataaggactgctggaagcgcgcgcgagtctctggggagtttttcgattttttttattttgggtttcggttggtacaaacaaccgggactaaagatgataggggttggtaacaccaactgggaataaaaatcacaaaagtacatgtaggttttcaaaccgggattaaagttatttttagttccggtttttactcaaaccgggactaatgtgatttttgtgtgacctagtaaagatcatttctccagtagcgttattaggcaggttcatgaattcccttattttattttttttacgatatattacccccaaatgaggtaagacgaatgtcattcatatatacaatactagtaatattagtatcatggtatatattatggacggtgtgaaacaagttgggatgagcatcataaaagattctcaaaggcaatatataaggagaccatcagccagcttctgagcaatactaattaactctcaaatccctcgcgcacacacacacgcagacagagagagagagagagagagatggcgttatttggggtaagagagatgagacgatttgagagaatgacgccggaaaggcgagctgaatatctactaggcatggccggtgtcgtgacgttggtaacgtcgatcctcctcctgttaagcggcagcacctatgggtacggccctaaggtttgcaccggccgtggcgtcttctttagccccacgatcgctctcggcctcctgctgatggccgccttcattttgggtacgtgcggccagaggtacggtgatgagtgcctctttggttgctacctcctcggtctcctcatcgccttccccctcctccttgccttcataatcttcggctacgtcgctgttggaggcatcgacctcggcggcgtaagtattcgcgagtacaatctggaggagtacagcgggtggctcaggggccgtgtggccgacccgcactactgggaaacaaccagcgcatgcctacgcgacgggaacgtctgcagcggcatgacgcggttggtacgcgacccagacaccggcatattcgtccctgagttatcccggtatgaaaggtggctcaaggaacatgggattaaaaaaggcgtgcacgtaatgtcgcctatcgaggtatgtacgtagcagctagcttcgatataattgatggatgatatccccgagcccaagctcaggtgtaacttcggtattagcctatgtatgtccaaccttagtgtacaaaacttgatttattttgaaagggagagggtagtatcttctttgacgtatgggccggtccacctttgaaaccacatgaatgcaaccgcgtgcgtggtgacggttttttgtttaggtccgacaaagatgaccaccatcgatgacggctctaacacatatgagtttccacatcgctgaccactaaaccgctaccagaccgtctgacatagatgagggttcccgccagacagaaatgacttgattcgcactagcgcactcgggatgaagcggtgcaccactttgttttagggagttcaaaagacttccagcttagtatacgtacgttgtgctaggttaattatagcttgcatttcattttttttctttcctttcctattccctgctttattttttcagtgatgatgatatattttgttcaatacttctttatttatgagcaattctacggttcttaggaaggtaccatgagatagcaaaatttacacttaaatttcggtacctcacagtacctagataccatgagttaccaaatttacaatagaaaaaatggtatttcatggtatctcctcaaggactttaaaattgctctttatttattcatttcgatatttcacttaattggaacctcgccttataactgaatatatatatgctgcacttggcagtctggatgctgcaagccaccgacatcatgtggtttcagatatgtcaacgggacgacgtggataccaacaccagcagcagcaggcacccctgccgcggcgaccaacgtcgactgcagcaggtggagcaacaaccaacagacgctctgcttccagtgcgactcatgcaaggctggcttcctggacgacatcaagaaagcctggagtttcgatgccctgtatccaattctcgcgttggtcggagcctttctttcatgctttgcaggcgtcaagtattggagaccaagactagacactgggtactcactaattagagaacgagcagtggcttaatttagacggctaatatctgcgtataatcttttcacgtaatgcataggcgacatacttatagacgacgcgtacagtaagattataagagtcgtctctcttttatagacatgctatttgtattatcaatatgctttgactctgtaaatagcatgcataatgagtgtatggtattaagccatctatattgagaaaggctctctagtgtaatatcatactagttctggaatttaatctgaatcgtcggtttttataagtgcatatatcggtactttattaactcagcgattagggtacgcaatattaattttggcattttggttattatccattcaccagtctgtcatttttccattcatttgtgcggtatcgctactttgatgtcagcatccttccgctgccggtcacgctcagcaaacttccagccggcgtcgtcgatcgttaaaactactactacctcctccgttttagtacgtaagatttacttgtatatgtatatatatatatataactagattcattaacatctatataaatataaagacttataatataaaacggaggaagtagtattaacggcatgaataaaaagccgaatatgatcgttaaaggtcattatttttctcatcgttatggtattaactataaagttttccttccgtcgttttctgttatatattaagagtccattaatatttttcaaaacgatcttaaaccgtcacgtgacgctctaacaaattaaaaaaatctgagaaaaaacaaaacatttatccctcggttttaaattaaattaatggttctaatattataaaccgttatattagattatcttaaaataaaacgaaaaaccaaaagtgactatactgtcccatctcaacttccatggtacggacgtacgtgcgttagtatgtaacctttttttttcttttcaatgtctatagttgagacgtttattattattattattattattattattattattattattattattattattattattattattattattattattaaaagtgataataaattttaataaaggttactttaaaaaaaatagaatatatctgcatacaactcttttacaagtagacaactagacata

SEQ ID NO: 76089 - DNA, 10608 bp, Oryza sativa
attacacatgtgataatctatttacatgtgttaattaagaacatactttgggaagaaaacattctgtgccacgtgtccgacgcatgagagaggagcggcgtgggctcatgtaaaataaatgagtagataaatttatataaaatatggtctatacaactataaaaagataatgagtgagtggaggatgtcaccaagcaataagcagactcaaaataatgacaaatagtttacttctatattttatcgagtgatggcatgatgtgtcagttgtataaaaaagtttttctttgattatgaataatgacaaagacagcagtatgaagggatgggaatatgtacttattttttaacttaaaaaaatataggcaaaccatttattttgttaaatagtcatggtacaaagttaatgattataaatcgtatggaacttattgattataatttacatgacaaactatattcttgatataaccgtattacatgatagaaaaaactttacttaaaagaactccaaaatttataagtaaactatacatactaattaaatgtacataattatggtcttattacaaaaaaattattgtttcaacaaaaacaatcgaatatgcaaaaatgaaagaaattaacttcaaacaattttatgttttgcactacaaagccaagcaattatgtaagtatttgtgtgcaccaaaaccctttaatgttctttaaaactatagataaaatattgttgaacttatgtagaggaaaaaaaatctaatttttaatctacccttgatttaatctacgccttcacgaggtgattcaatcacaagaactttgagtaacttgatcttgtaatttccgcttctagccgtatttacacggcatgtgtactgcatgatatgcatgataattacctagcggtagtttaatatttattttatacaaaagttgtatgaagttaatgtatcatctattcaaaagtgaatgaatggtttttgagaaatgctaaaaaaaaagaacccaggatatattttaaaaggacattcgttgactatctatgagataattgttgaacaaaatataatattacccttcaacatataatgcccgcgcaaaagcgtgggctacctttctagtgaccgtgatattatgtcatcgtcttcattaacgatcgtgatattgtcattgttatttaattaagggctgttgctatcattatttcactgacgatgggggtattatacatccttattttatttatgaacacttccttatataaaatcaccgaaaatatcattaagcaataatatataattgtgtgcactcacaaagaaacacttcatttattcatagaattattggaagcttacagacccctccgttccaaaaaaaaaaagtccaatcctagctacagaactggacatatgcgtgaccagattcgtacttagagtttgactttttttttcgacaaagtagtacaaatttatagcttcttggtttcacaacgggaatacggctagaagaataactatgctggcatgtgtttgttcatcatcgcggattgcacattaggtgatcaagttgatcgatcttattcagcatcatccctcagtacataggtatcctgccattcaatcacttggacacaaagtagatttgtgggggcagcgcacggtgcggtgcgagtggtgtgggacggctcggcgcgtcgcttgcccggcttggcattttgtctaccaggtggcgggcaggtggcccggcgaggccgtgtcggcccaggagggaggagggtaaaaagtgcgaaatacctaataagcagaacgttcgctctaatactttaccgcgaacagctcggacaggttgacatgcatgactgaaaaggctgtcacgcgtcagctggggcccttgaatgcagtgtcctttcttttatagctaaactgtgtacgtatatctttttttttcctttttaatctccgattttttagggattgatcacgtatgtgatttttttttctgaacaacacatgcacaagaataggaaagattcttgggaattcttactcaatgtgtgcccacatccgccactttttatttaggttagttttgacccaattgaaatttaatagttttttatttttgaattattttagtttcgttttaaattcatctgtgtataaattttgtatatcgaaagtttatttatataaagtttacatgccaaaagtttatatatgtataaagtttctatatcaaagtttttatatataaagtttgtatgtataaagtttaaatttgggtttaatgtttgtgagtagagatgctagtaatttgaatatgattttatttgaatgaaaagcttaaaaaaatgggtaaaaaatctattgaattgaagatgttgctataaaataaaataaaaatacatttacctagcctagttacgtagtataatggtttaattacagatcatactagttttatcggtagaaacaacatgatacatgcagctgattaagtggcagcatgcatggttgcatgctcgatgtgtgcatgcaggtgcctggctgcctgcaaatcatgccactaatccctaattaaaacgcgtaagcgtagaaggttaaggtgatactagtagatgataaagtcgatttgtggtctgaaagtgatcgcgatccgcgaacgttcgcgtattagccccacccgggcggctgctatgctgggctgaggcctgagggagaggggctaggaggagagttagggcctcaaatgaacaggatttttgttttatatttgcttggaattttgtaatttggaaatgaaaaaaggattgaattggaatgtaatttgtattcaaaatttgaaactggactgtttaattggacattccaattcaacatggttattacggggtgcagggattagttatagaatttcgagaaattgcttggatggatggattgtttttgaaaacagatttagaattgtcgtcacatattaaaattcatcggcagtttttttggctatgaaggaagggactattacagggtgtttcggataaagttgaaatatcatgaaaatggatccgaagaaaataaatgcaaataaacgaaattgggatttagatccaattttggcattcaaaggattcaagggaaggacatgatattataaccattggaacgggttttgggactttgattaacttaaatagaatctattaacttattaaaggaataaaaaaataagcctccatgtttgctcttatggcctataaaatcccacattaattggaggaaaataagaaaaaaataaaagtcaatccgagacggtaccacattaaccgtagaaaaaaagaaaaaaaatcaattggacaccctatagattgcttacatagtaaataaggattctttttcagtttggaaatagtattttattttggaaaacaacaatcatacatgatttatcaaagtgaaataatcagaatcagtaaccgagtattgcatatgtatctattccgaattgtactctctacattcatgtcaaaaaaatacatagacttagcaaccaaagcaaaatacaaacacacaaaacaatctaccaaagctacgtttttcaattcaaacttgtcacttaccttgacacatctcgtagtaagaatgacaatagtagaagcatcaccaaagataatcgattccgtttcgggtgcctgtttgagcgaggagaaccaatttttatcactggtcatgtgctgcgaacaaccggaatccacgatcacacgttctccttcctcgccaccaaagcctatacacaagaagatgccgaagcctcagtactgcggttagataaaagaaatttagaaatccaatactaagacacatgaccagtagatccaatagatatatatctgcgcgtgaaaatagtttgagaatttttagaaaatttttccaaggtcggtttgaccgagggggtactgccggtctaaccaggggtcggtccgaccgccactgcactgtcggtatgactggtcgccggcctaaccattgtgttctggccgatttgaccatgccaatgtcgtcagtctgaccactagtgtcccgctggttggaccgccgatcccgaccaaacacaaatcgaagatctctcaaagtagattgaaactttattagttctctctgtgtttacaaagttggacaacggcactcctcacgaaaatctttactaaactcgaaaccctaactattctctcaacattactctcagaaaaacaataccgggaggacacaccatccctctctatatatacctaaggtaggcatcctaaagccacgaaccaaccttgtacaagaatcttaatcccctacgaaaccttcccatacaagaaacaaactttacaaacttaaattgtaccaaatttggactccttccaaattcgactctccatcccatacgcacacaatatctccatcgtatgccatatggaatcttcaccaaccacgtgcattgatctttagcctaagcatctgtcacgcccgaaaattcactagtaatttccgaacttatttgtgcataaaatcctcatccaggaatcagccgaggtacacaaattgacaatttaatatacagattcatcaaaataactaaaacaataaatacttacttaagaggcacttagtcctcaccatgaagaaacctgcagcggaaaataaaatctagcgaagctccggctccactcccacagacagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaacatttaagagtaataaaacagtagagtactttaatcattaattttaatcaacactgaacaacacgcccatgctgctcaggcccaaccattccgaacaaccatacccggctgtacagatctaactctaaaccaggagctaagcaaattattactaggtataacatccataattgttgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagctgtgacaataccccttgcacaagacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctggcttgtggttggcatggttaatgtttcacaatagtagctcgcgaaccggtccttaattgtcatgagcacgactctcaaaaccatgtgctcacaacccaccattatcaagttttagttggcaagtaattaattaaccaatcacaattgaccatcgtgaactatcattaagccatcattaagtaatagtgagtcataagttatcccaatagtgtgctaatgtttctaagcatggctaagcaattatatctaatatctagctgaaccaatatatacatagtccaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgcctttgcaataatcggtcttcaattaatcttcttgaatacttccggcgcactcgcgaaccttcgtaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaactttacaagattaaatctatttaaagcctatttaaaaaggattaaataaatttaattcaatttatggataattttaacatgtagatctttattttatacaacttttgcaacttgaaccacattaaactgagttacaatgaattagttatgaattttcaaagattaaatcggattaaagcatttatatggattttaattgaattatgacgcaataatgaattatttttgaaaaggaaaagggaattattgcgtcagcggctagggtttgcggtggaccgggtgcacggcaacggttcacgggaacggacggccgagatcgatccatccaaaatggacggccgagatcgaacggtccacgaccgggccacggcggacggtcccgatgacgtcagcgacgacgtcagcgatgacgtcaacaccggcggcggctcggcaatgcatgctcgccggcgaacgacggcgcgacgacgcgaacggaggacaccaacgggtagagggcgacgcggtgaactcaccgatgaccaaaacaacggcgaagagcaacggatggcgccggcgacgaggaagaagcggcgacggtcttcgggtcgacggtgacggcggtgctccggcggtcttcggcggcggcggagcggtggacgaggacggcgacgcgacggcgaccacgatggcgacttccccgagcgacggcgacgactggagcgacggcgaagcacggctggagcggcggcaacgacggcggcggctagggctacgcggaggcggcgctagacgcgacggcgggctaaggcaaaggtgacggcggatagaggagagctcgggggtgcttttaaaggggcaaggaggcggcggcgaagacccacggcgaccggcgacgcgaaggaaaagttagggttcggaggaaagagaccgatccgaatcgacctcgaattcacgaacttccaaagcgatttagacgatgattccaaaagagaaaaggtggaggagatcccgaggatcatttcccctctattgatttcaccggagaaggaaaggcgcggccgaatttggaaggagacgacggcggcgcggcgctagggttcgggcggcggcggcggcgcgaggaagacgaacctgacaggcgggacccacctgtcagcggccgagagagaggaggaaggggcgcggcggactgggccgactgggccggggagggagagagaaagagagaggttttgggctggctttcggcccaaagccaaaagatacttttaaaaacctttttcgatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagatcttctcctttaagcttttaagatcatttctaattattccttttaaacaacaatttataatttaaggatttttaaacaaggaaaagctcttaacaattataattagatcattattgatcaaataattactgaactgttctttgtatcatttaggaattgagctctgaaaaatccgagaatattccagagagttgacttaatcatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagcatcccggattagctgatcatccggacgtcatcttctcccaagttgacttccgatccatcatcggcaatactcttccgaggcatcaaaaccacctacacatgcagcaaccaagaaaccatatctgagcacaagttctcaccaacatgactcattgttagccaacaacagtattatatacgcatagtatccatatagaagttataaacatgaattatccaaggatatccaaagaatcaacccgaaaccgaaacctacatagagtcagccgatcagaccactagctggccggtccgactgcacgcatacatccgatcggactagcagcacttgcccggtctaactggttcaaacagtcaacaccagttgctgttcatcacctgcaaatcaatcatctccaaaatcacttcgtcaataatctctaaatatcaaaaccaataatcccatatgccaattgttcacataataaggaccaaacacactttgattttacacttggtccaacgaacgagattcaccaactttggtcagattggatagagccttttttgcacagtttgggaggagatgtttctggattcgttgttacagagctcagcatcagttgtcttagatcattgcccctgttttgccttcgcacaagtgttcgggggcaaaaagggatttcactttgagagttttttcacctaaaacgagggttttcttgaggtcgagcaatagatctaggtagctcctatacaatcctcttgtgcaattgagggtttattcctcaagctaaaatgattgggcaaatggattgcagagttggagttagaaaaaggtgggcaactttaagattcagctttcgatggcaaaggagatcctcaaccgcattaagattgccagagattgtagacctctcactgttggggaggaatggttgagaatgaaattgaatctgcactgccttggcctggcatctcttgagcgtactattgctaggtcaagatctcagataacttttcttagtgaaggggacgccaacaactcttattttcttaatcagtcctgctactgtaagaaaaaaaagaatcatttctaagttaatggtggatgatcgggttgtcacttctcaggaagaaaaacatgaggtagtttttgagttctacgagcatattctaaagtcagcacgtgatagggatttcttgttggatctcccggattttgacgataaaaagtttgatattgatgccttgatgagccattcttcgacgatgagatatggtctactgttaaggcttttcacctcgacgaagcttatggtctcgatggttttacgggttgtttctacaaggtgtttgggagattatcaggtgatattctcttggcgcttgcagcgattcaacaaaggcatatttcttaattcaaattgttcaattaagcctatatcactcttttgtctgaaaaggtggatgcttgtcggtcatcattataatcgatcatctggtagcaagcgtagtaaaagaccctgccaaccctagggttagacagaagtgctatggatgaataccccaaagatgacgatacctgttaacaatttgtgatgaaaatctcaaaaaattatgataaattattcaatatatagaaagatggtgtgtgcctctgtgccactaaaaagttcgagcctccctctccaccatcgtcgaactttatcacaccctccacaccattccatcgctattctgcttgggtttaacagtttggcagttctgacatgtgggcccaggcaggaaaaatgtcgctcttgccctttcagtcgctggcataactattcttttgttctttgatggtgaaaaacatctgccatgtgatgaaacactcttcttttgttccgttagtttgccatgttgttatgtggatgcaaacaagtaatgtatttgataagtcatgtctattgccgacatttagtgctatcatgtgatgaaacagctagttatgtgaggaaacgactagttatgctatgttgtttcattctggacaattacactttcaccattcaacattgaaaattcattcattcatccatccatacatccatttatccatgactactcacacacacaaccacctacttcttgaaaatagcatacaaagtaagaaaaatgcaaatatagactatcttttcaagccacttaggcttagttcatttccctagttcccaagtccccactctcttttttcacgcgcacacttttcaaactgctaaacggtgtgttttttgcgaaaagtttctacatgaaagttgcttaaaaaatcgtattgatcaatttttgaaaaaaaaatctaatacttaattaatcacgcgctattggtccgctccgttttccgtgtgcactgttccggtcaggaacaggcagcaacaaacacaaccttaagctactgcatcaccctattgcccacttgtgcattgcctacaattccagcagcctgagaaccttcctgcatgatagccaatggagctgcagtagggaaaccaccaagtggtgccactgccattaggggaactgcatgaattggagtaggggcatgaggtgtctgcactccagtgtccaccattttatcctcccactgataatactgttagcctccaatctgaaagccaaaccattaacacattaattgtaagcaaacaaaaaaaaaaccaaagacaag

SEQ ID NO: 76090 - DNA, 5216 bp, Oryza sativa
cggacagtagagttgtgattgcaaaactccacccaatgagcctcacagatacgaggaaaaaatattaattaccccctaaactatcgcggtcgaccgtattacaccttagaccacaaaacaagacattatttacccccaactatacaaaccaggcaaataactcggtaattcgttcaggggggtaattcatacttttttttccaaatataattatgtgtattcttagttggtgtagtgaacagaagttttatactttgccaattattttgttgctacctccatttataaagtggtgatggatgtttttaacatcgatgagtttttcattaaaattctcttaatataattttcacaatttaatcatgatattgttgcatctattaatgacttcaaatttttttgacatgtgactacacacaatttaggacgccatcatttcgagatcggaggtagtgcagattattgttttttacacacggttttggacgtcataattatgttgtcacaatatagttcgatcaagtgagtattatataagaattcaatagtaaaagaacaaatctcaacaaataggtacttacccactcaatcgaagcttgatgacgagcacctcgtccagactcactcattccactaatggtctcaagtagtgtcacaccaaaaccgtagacatcattcttcaaagagacagtaccttctataatatattctggtggcatatagcccctaaatatcacaaaatacaaattcagatcctatcaagggtatgtagagaaaatagaaagaaaataatttcagaggcaacgaatgaaatgccatatatcttacagtgttccactaacgcttgcattaatgtagtcatcttgtaattcttcagataatccaaaatcaccaatcttagggttcatgttagaatccaaaagtatgttgtctggtttcaggtccagatggactataggtttctcggagtgggtgtgaaggtaaacaactccctgggttatcccttcaattatttttaatcgggaggaccaatcaagcaacccccctgcaaaaccagaacaatttgaagtgggacaatcagtaattataaacaacaaaagttaggatcaaattttctgtttatagtgcgtaccatagattaagttgcccaagtttccatttgtcatgtattcttcaaccagcaaaagaaattcttctttggcagaaacatttccatttgtggcattttctttcggcatttcaatttccctgtattcgtggcaatatcctacaagtttaactatatttttatgctcaagcattgaacgtagaaggatcaaaggatgctttttgggcatctcgtcatattgagatggaaatccatctgtatgtttcttgatagcaacctgaaccccatcagataaaacaccctgaaaagtgcaaattacacagtcaaaacagcacccaagaaagtcttatcaacgtgggagtagccatgaggcatacagtacaccatgacactagattaccagcagacatctatcagtaaagataaagaattattgatagattttggcaaattatgtgttgacaatactgcgtaataagacatgttatatgttaggaaatctaaatattttttggatcaaaataacagcaatattatgagtagaaacaaattatatatccagagaacttaatgattattatccatctgtcagcaatgtttcgtctgtcagatcatgatctcacagttaagatagagtgaggtgaaagctcaggcggcaaattcatttaggtgtgcgggaaaataaaaaaaaccgccaaaattttttccacgccaaaaagaaaatcgacgcaagaaaaaaccctgggcgccgccacctcgcggccccttccatggttcaccatgcattgccacctctccctccttccactgcatgcgcctctctccccatccaccgcgcacaccgcctcctcctctgccaaatccagcgcacgcccgccgccacctcactcatctctccccctccaccgcgtgccgcctccgcaaaatccacagggcgactgcctccaccacgcagccccctaaccggttgcctgtgccgatggtagataaggagaaatgaatcctacaaacctatacaaatcatccttaacttattatagttaatagcaattctctgcctttttttcttcttccatgctagtatcatgttttatcaaagttgttggctctaaatcaagctatcaatcaatcacctacacactgacacacgtcaactccttttttttaagcctaaggcggaactttgttccacttttatatttagaagagaattgacccagtttataaggaaaacctggcccaaaaaccatacaactgcacggttaattacagaaaaaccggctgaaacccgccgttacacaactaacaacaacggcggagcacaaacgcaggacgtcgggccgccaggctaaacacaaaagcgacacaatagctcctacatcgcagaagaggtgttatcattgccgagctaggcgcccaagcgacctagcagcgccgacttcacaaccgcagcgacactgaaggcacaaaggtcgccaaagcgaaaagcagcttcggcatccaacaatgggcatcagccaagccaccgaggagccacttccttcacacggctagcaccagaactccttggaagagactgcaacatgtcatcattgccaagcattgcctggattaatgccatactgctaggacaaattaaaaatctattcgattcttgaaaaaccgctaccggtccaccggttcccataaaaaccacccggttcacccgttttttaccggttcgattgcagggcggttttttgttgaaccaagccgccaaggtccctagttctggttttttccggttcaaccgccggcctggtccggtttcttgtactatgccgtagatcgagtcatgtttagtttgtgctttgttgacatcatcgcatggatgacaaacaatgcatcataggaaaaaatattcatttgtcgccatgaaaaaaatcagggcatcaatactattgaggcaatatatacatgttgctacaattttaaaattgttgctatccgtggtaataaatagggtggtaataggttattgcaatgatttttatttgatggtaataaattttgatgttgccacggaatggatgtggcaaaaaatcatattattgccaccactccatatgtggcattagttctacgtactaaattaaaagttcaaatattaatctatcatcataactatttattttttataacttgtattggctaggattcgaacccaagacttatcctcacatgcgctctcctttaccaactcacctcacctagacatcatttctgttacaaaatgcatatcgttccatttaagcctacctaactgagatttgaatctaaaagatttcaaatgaaaaagttatcacctataaagtttagatctcgttgagagctataattttcttataaaatttgtcccaatctatgtccatatgaaaaaaatatgttaaattatgagatgacaatttttttattgcaacgaatttgttgatcgtggcaatagaaaatattgaaaagtaacttgccatagccatgtactatgcaaattaccaaaaaattaaaattgtggcgatagaacattttttttcaacaataatgttttttggtgatatatcattttctattacaataaaaatactaaataaaataacgactgtaaattgttacaataaaatatagttatttgcctaaaaattatcattgaaatagtacattatattgctatgaattattttttgttataataatttaatggcaatagctcaattatcttgtaacgattttctgtttgttccttgcatcgtggctactattctaaaacatttcaaccatgttcaaatacacaataaagattaaatggctatttatgtgcgcatgatcccacacatcgaaaggtatctggtggacaattgtgaattggacaatacgagcctcatcggttatccatattttctaataagccaaaacggcttataggaaattaaaattaatttataaataaaacttttatatgtatgttcgtagcaaattaaaagccaacgctaaatgaaattacgttgagaaaatcttaaaatcaacatcaaaatcaagtttaaaatttcaagttttagcttttactcttattaggtaaactgatggggctctataatagttgtgcctgacataattgaactgggactaacgagccattgctatatatagttgctatataattgatcccaaaattaactaacatgatccaaaactgaattgctcccaacccgagcaaaccaagacgccaagttagaattgggactgaccttgtagacagttccagaaccaccttgaccaattgttgttgcaaagttatgagtggcagcctccaactcaataaaactgaagttcattaattccctctgtcgaacacggggaagttttgggattcctacaggaagtgaacttcgtcttgccctgatgacggcgaacatctctgtaaatccagctgaacatcaagaagcgttttaatttgcagcaagaagagaaaaaaaataatattctctattataaagaagtttgaagtgtattttcattcgttagaacagctaggaagctagcccgtgcacatgccggggtaccttaatattatttgaatttttattatgatgatttatgtgtggtgatttatttttctaaatattcctggactcattttaaatatgtatttttagtattttatttgagcattggctatgattttcttctaattaccctttcaacatttaaattttaacctaaaattactttgaaccatgtagtgttgaatttgtgagaaaatattatgttacaatcaagaagttgatttctatgcattttctaccatgtgtttcttttttaaaaaaatatttagcatatcatttttttccgagttttcaaacttcaagtaaaactttttcttgtactataaaaaaatttcccatgcgttgcaacgggtaaaggtaattttaatcttattattattatacggtttagttaaggcgaagttgtaaaattcactgtagaaattgcttggatatatatatttctagaaattcataaactgagttaggagtccaatcatctcaagttagcatgcgagtttttaaagagatat

SEQ ID NO: 76091 - DNA, 1828 bp, Oryza sativa
aatttaatgaaactaatttggtgtacagatatttctattttttttaaattcctataagcttgatcaaatccaaccacgtttgacttaacataaacctaaaatatcctattaaacgcaccactacttaaaaggagagttgtccgtctgctccccttcccaactccatgacgcagagagcgacccatagacctccttacttgagagtaatcactctcccttaaaaacagaaaagaaaacctaaaaaccattccatcatatgggccgataaaaccatgaaatggcatctattgcaacacatgggcatttcgacctaatcaatgcgtctggtaactaaggatgcccaatagtttggtgtaccataagaaacactattccatttcagcgataaataaaaggaacaaatcagggaaaaagaagtgtacagtgaacaaacatgcagcacctggatcgaaggtggtcgttttataggcagcggccgacatgcttgtggtcgaatgccacttgctggctgttcctgctgccgtccgtgttgaggaaccgaggtatgctgaaaaaaatatttctgttgtaaatattttatagaatactatcgatcgcgagccataaagatcgggcgccaacaaaaacatgcacacaagtaaaaagtacgcataactgtatacaagcaagataaaaagaaatggcaagagacctcaagggatatgatttaaatttaaacatcaagacatttttgctttcaaaccatatatgatctaatatatgattatcatgttgaactgattacaatcaaatattttaaagaagatttatatcctgatgaaaaaaatatatgtatgtttcaacaattagatttcggatgtttcataggtgagaagaaagtgtttaactaaaatttgtcagtgtttcatatttttagttctcttgttgttgtggaattttttaatgttgcacaaaatattatttgaatgtttgaatgagtattttctaatgtgacactaggtcatttgcaaatattgcacataatattttgtaatgtttcaatagttacaactcaatttttcatgtatgataataaaaagtttcaacaaaaaagtatttgcaaatgtattttatgttttcatataattttttgatgtttcgcttgttgagacttaatgtgtcatgtgttggtttaattgttgcactcaatattatttatgctgcatctcattgcagcatttgataaaatgatggaatttcttttacgagtggtgaaacaatggttgatttttttaaaaaaataatatatacttttcattaaatataatcgtgcaagatcttattttaaatattttgttgcaataaatataattatgtgatcagattatagattagataaataattcaaagaaaagtttgataagaaaatttttatacatttgggttggagggggaggagttcactgtcatcattttgccaagctcctttccattgtcaccataattatagtgattttttttgtatttttatggtcccacataccatgaactgaaaaattatggcacaatcttcttttgctagtaaaattatgggtgggtcacttttttttctagtcacaagttatgcgaatgcggcacaatggtatggtgaaggggtgacaatgtcagtacaacttatttgcttcttctagcgtaggtattgcatgaggccaaaagattgtgatcaatgatggcattggtatgacggagagcagtgcacatgaagtctaaggcgacatatattgtatgtacggaggttatgacggagagtagtgtacgtgtgtgcttgtcaggccatgtgggccccata

SEQ ID NO: 76092 - DNA, 4596 bp, Oryza sativa
cctcaagaactctcaaacatttcttcaactgagagacgtggaacacattatggatgccaagcatgttggagggaagctcaagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcgtcggttgtctgcatagcttttctgccgagattgcacgattctcaatctttccctgacagctctgactttctcttctgcctcatttaaaacttctgtaccaaacaactggcgttcccctgtctgatcccagaagagcggggtacgacacctccgtccatacagtgcttcaaacggtgccatctgcagactagcttggtagctgttgttgtacgagaactcagcatacggcaagcttttgtcccatgccccaccaaagtcaagcgcacaggctctcaacatatcctctagtatttgattgactcgctcggtctggccatctgtttgtggatggtaagcggtgctgaaattcaaccgggttcccaattcttcttgtaatttctgccagaactttgaagtaaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgatccaccaaaacttctctttgaggtcttggtacatcttagtactaccgggatgaatggaatactgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggctgtgcctctagggcagccacgaatccgtgctcaactataccaaggttcagatgttccaaatcgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcaggttgagtaaagatgtactttagacttttgtgatctgtatatacctcacaacggttaccgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctgaaaatctttcgtctgatcaggcaggattaagactggtgcagacaccaaccgtcgtttgagttcttcaaaactccgattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccacttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcattagtaagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacaggtcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcaacttgcttcttgacttccatcaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactgatccctggcttccgcggcactggagactggaaggttaccacctctccttttgcattggtcaacttgatggtgcggctggcgcaatcaatcactcctctgtgccttgtcaaccaatccattccaagtatgacatctaggtccttggattccagaagaatgaggttggctggaaaaatcaacccttggatttcaactgtcacagatgggcagtagtgagttgtggtcatgccacctccaggagtatgaactcgcattggtatcttaagcttcactaaaaataacccatgtgcaccagcaaaacgcttggaaatgaaggaatgggttgcaccagaatcaaacaatattactgccggtgtcgagttgacgggaaatgtgcccaatataacctctggtgctgaccgcgcctcctctgcagatgcatgattaacacgggcctgaacgaacttgggtccagtacgtcttggcttcgggcactttccaaccgtgtgtccgggtttgttacaattgaagcagagttcgggtttttctcccaacctcttgggctgttctggcagagctggccgaactgattgagctggaatctttagtgaactcggagtagggttgagactgtgctgctcactgttgttgtgactgccactatggtggttcttgttgaagctacccgggtggtagggacggtgcggtcggataaccatggtggaaggtccaccgtgatgtcccattgtgaaacgaggcttctgactcttcccctagggagtcctgaactgagctgccttcctcttacggtttattttgttacagtgctcctcctgacggatagccttatccaccagcttctcaaagtcctcataatctctagagatcaactggttagtcaattcatcatcaagaccagacagaaacttctcctgcttctcggcatcggtacgcacgtcctcaggggcgtagcgcgcgaggcggttgaactcatgcaaatactctataactgttctggttccttgttgcagagaacggaactctctcttcttttgtgccacaattccctcgggaacctgtgctttattgaaactatgacgaaactctgtccaagtaacctctgccccagttggacgggtcaccatgtagttgtcccaccaaacagaagcggggccttgcagctggtgtgtagcaaaagcaaccttctcctgctcgttgcattgcaaaagattcagcttcttctcaatggcatgaagccagtcgtgggcttcgattgggttggtggtgcttgagaaggtgggcggcttgacacgaagaaattctaacagtttggactgaggaggtggaggaccaaactgcaggttctgctgttgctgctgtgcttgctgctgcacctactgcatcacctgatggtactgttgctgcatctgttgcatcatcattgtcatcatctgagtctgattgtccaacacctgagcaattgttgggttctcgggcggtggggacggactgttgtcagatgcaccgttggcacgtgctccattgatcggctcttcgctgccactagcgttgttcgagtcgcgtgaaccattccttgtctccatctgaaggggataggtagaaatatgagaaaagaaagaaaaacagggggctcagaaactaatcttgcttatgaatttaagtgcaattatcttaatctgggattaaaacagtgaaaaagcaggcacgcaagctcctaattgaggcagtcataccactgacacatgatatcgaccgacgactaacccacaagcaacaaacctaaacacgaaaactagcaagcaaacagactaagaaggcgataaagctaagggcggcgactctg

SEQ ID NO: 76093 - DNA, 1497 bp, Oryza sativa
tgttggtatttgatacggttacagataaaatccgcaagcgcacggatataccgatgtagcacttcccctacggagtattccaagggtatcgaatccaagggaacgtgtgtgatcagagcttcttccagttcacccaaggataccaagtaaatgataggccaggatagagaggatttactagtgagaaacagtgtctagggaaagcttaattttaatcctaacgtaatacttcaggaactggcaacccgttgttcctagatgtcgctctactacgtacccggacagggaggacttaagtgctctcgaggactgtcaccacctctacacccacctcaacgtattgtgggatacgcagcaattactgaataataattacctaaacatcacgtctatgcaattaatatctactttagtatttataactcaccaaagcaatcactatatttaagttgattatagcgaacaataatcccgtatgctaattaggaactaaccaagaggtaattctcacaagataaatctaaattactcaagaagaatattatattgaattcaggataataaacagaataaaagaaataggagaagattaccgacaactccggaattcttccgactccttctactctactctcttcctattatagtatacaatattatagtacaatagagcctcttataattcagcttaagcttagaagtgtgtgtgtgaagtgagggagtgaagcctttatatagaggtaggtatgactgttggcgaaggggaaatgtccgaagtaccccgcaaccgccatcagggagtgatctggagcgtccacgccaaaccccaggatcaacggtgaacctgggctgggccctcctggcctggccttcggtcggtggattccccgatccttcgtctatccatttctcggagttttgggttgattcactaatgttttgatgaagttcacaaaccctccttgtatggatacataattctcctcactttagtctgattttcctcccaacttcagggtttatcatctgcatacaaatatacaccaacacttgtggaatacgtgagattaagcacctatcactatgttggatgttttattatccgaactttatgcagacgttggcggtatagaatcgacatttaacagccgccaacaaaaccccccacacttagcactttgctcgtccctgagtaaaggtcagtgtagaatgaatttcttcaagagatgaatcaagcatataaatcattcacacccatacctatacctgtgaattttatcagtggctatcttaccatcttgagtaattgataaatggaatgatcttgattccagtccttcttgcttctctgttagactcgtggggtttttatgaattttcgcaaactagctcttttcctcatattgacttttctctcttgtctctcaaagatgtatattttctttttggatcctctccaaggcaaagtatgccagaattcatccctattctaaggct

SEQ ID NO: 76094 - DNA, 1418 bp, Oryza sativa
gggcacgggctttgtcccctgcttcatacccgccatcgccgggccgagcctcctcagagtcttgatggcaacctgggtcttctcttcagacttgctcactcccctccttactattgagaacccgccccggccaagaacatccacaacttcatagtcatcggacaactttctgctctcagtcttggacattatggacttcgactgcctgctctgaagaacttgataaattgaggaaccgaataacaagactcaattggcagtaatccagtagcaaagctgtgtcctgaaagaagtaatcagtagcgcaggaagaacaaatgaatcatatgggtatctgcaggaagtaggagaaagagaatttggggaacagcagagcacaaactggaaggagcagttaggagtacaaagcaagctccttctcctgaagacctgatcagtaaacaaaacaatatgagagagcattatatagagtaatgtgagtactgaaggttgtgacgatggaagaaagggacatgtgcaacaaccaacacaagggaataaaccctatcaaggatttctttttgtgcagagaacaaggtgacaagaagagagaaatgagatgattggaagaagatgacaggccaaaatagtttttgttgacctggttgccactgcttggagctgctctgaattggtcttcactcggtgaggcctaactgtagtttactgctttgtcttagacagttgtaagcacaattccactgtagctgacaacatcataaacatggaaggtaagctctcctcatgcaaattaacacaagatgtaaattggccaggtatggtctggtcaaacggctggagaggaacaaatgaatcattttgatagacatttgtgccatacaaattgacaaatcttcactctggcatgagtttcctctttccaacttaaccattcatcatagaaatcgataaggaaaccaaaattgcagaggcaaatgtaaaaacaaaaagattatatggctcatgaaattacaatatgtaagcaaaacttccatagaaccatatgttaccactgtgacaataacgggttcacagctccagatatatcatgaatgccctaaacagatgcttccacaaggacaacgcccagacaaaaatgcatcacataaacaaaaaaataataattttctagatgaactatgccgaatctccaaagctcaatggctcttgtgacgcttagggtttatctttccataggctgcttgcctttcggtggtcatcttcaactccctcctcctacgcttccttcgttcacttctggttgattttgccttgccatctgcatccccctgttcattcggcagctccttctctggttctgatgaagcagggccttcctcagacttagacttcttctttttgaccttcttgccttcttt

SEQ ID NO: 76095 - DNA, 8139 bp, Oryza sativa
  unsure (1)..(8139): unsure at all n locations
gtgttaggactaacttcgacaggatgtgcattgttgaatgcaattatttcagcgagagaacgaactggcgagtatgataagtctgacagatagttgttcaggtttagcttgaactcgnnnnnnnnnnnnnnnnnnnnnccacttttagtgccatcgaatatgacactcaaattagctatctcgaggttttcgattacaactgcaccctgttgccttcagagatgagtaacaattaattaaatggttgtagtttacttctggtaaaattactcaattgctacatatatgatattagacaacttcgacaaagcatcgtacagggaaaagagagaaggttcaaaaatttcgttgatgattacctctgaaatgtgataggtaaaaataatcttcaaccatttttttagtttaattcttgtagcaatacaccaataccaacttccgaaagggaatataagcattaattgataacaacatggttgttagctggggtgttggggtttcatgtatgaactaaattgctcgttttgaactttgaagtcattgtcttttctgcccaaagtcaaggcaagataacttacacaacccaacattatttttcttcaatacacaactcatattaattttatttccttgtactatgtatatatttttggcacaatcccatcatgtgtcacaaattaaacgaattacgttgaccatatcagcaacctaaattttcatgtttctcatctaataggtcatatctatttatactaccaccacaacttacagtatattagtataatatttttttctaccagagtagaactcacggttcttaaaattatctctgatggggataacagtggtcgtagtagagatgaccgtagaggtagtcttcctatatatacttacaaaatgtgaaaaatcactgaagtatcgtcataatattcttatcataggatcttacgtaaacgatacaaatatcctcgcgttagatatatattgctaagttaactaataaatattatttgggctatggtctagatccttaaaaaattacctcattgtgttgaggtgttgcttgtacaccatcttcctgacagttccatttgggaaatcaaaaaaaccgtctggtatgccaatcctcttacccttcaacccatcaattctcaagaattgcacatatccaccagcagggatatacttcgatgctgcttttgtggctttggcatcaagagcatcataacccacaatagcatccaacacatggacagcatctgccactgttcgacataacggtctgtgtatttgaaatcaaaattcaacatatgtaaaattaatgttttgataggataagaaatactttagatgtcaaattaagaaaaatgggctataagatatacctatgctcataaagtttatatggtcaattttacaacctctaaacctatattcatacaacattgttaggaaatcccctcattaaccgaagaaaaggccaaaaaataccaatattgtttgtaggatgatattatagtagtttgactccatatctgatataaattgataatcattaatgttcaattgcagaattatttaattaaggaaaaggtaagaaatatgtgaccccttgacaactacaacatggcattattatttttattctaacttttcgagttcaagagtaacaaataattaaagcaatgaaactatgtattgggatgcatcttccacacaatttagatgccaagtaaatatcggacaattgcaactattttttatgaatttttggttatcaattctaaaaaataaattaatttatatttgaataaatatattttaatttataaaaaaaataaaaccaaatgactaaaatatcgtactcatatttatgccaatgcatacttaatttgaaaatagaaacataatacccaataatgaatttaataaagctacaaagaaataattactgttaataaactgtacaaactatctttttatattataagtcgttttgaccttttttttctagttaaacttttttagtttaactaaattgatagaaaaatttagtaacatctacaacaccaaattactttcattagatataacattggatatgtttcgaaaacatgtttgttttatgttgaaaatattattatgtttttctataaatttaatcaacctagaaaaaaaggttaaaataactgataatatgaaacgtcactacaagaaaacatgcctttagtaaccatggatttagttaccaaggaatttggtggctatagtccatcactagcaaccaacatcttaatggcttggttactccaagtcgtacaacgttttagtacactttgtatatgtgaggaccctacgacaaccaaggactgaaggacttaagataattatttgaaaatacagaggactccaattgaaaagtgcagctattatctgttctcgccatggaacacatctccatcatagaaacacttcaaagacatcaaaacctagggctcagcggtggcagtggggctgagcaacttttcttatatacatgagcaacctttcttatttggtttgaccccaactttttttttatcaggtgcaccgtatcaatagccttctgctatatacatgccaagcatactgtggtcacaaacctgtcccaagctttgaaattctataaatgtacggcatatatttttcttgtattagaagtgattgggtgtgacatccacacttaagtagtattagttattttctgactattacaatgtattgttcaatcaaatatactcagatttgccataattattttgtttatattatggtgatattttgatctgtatggattgttcttgtgtgtgaccatatcttttagccaccaaggttaatattgttcttggtggcaataggtatttaataactactactctgtcccataaaaaacctaattctagctataaatctggacacttgtgtgttcatattcatagtcaggattggtcgttttttaggacggagggggtaagagccaagggttatagtgcacttttatttaccaagtactatttggttacaaaataataccaatatttactcggttactattagttcaacctattgttaccaagtattggctggtaactggaaggtatagtacgtttaacaaccggattatagccatcaagatacgtccaaggtataatggtggttacatatcatcaacagtgatcaacatgtgatctccaatgactaggcaccttaatgactaaaactcattttcctttagtgaacggagggggtacgaattaacaatttttagcatatacagctggtgaaaataaaaacttacccgacggtgtcctgcctagttgtgaacgggataacacctgaccggcttgtcaacccaaccgtcggcttaatccccaccaccgagttcgccgccgctgggcacaggatcgacgccgtcgtctccgtccccaccgtcaccgccgccatgttcgccgccgcggcgatcgccggaccggtgctcgacccgcacggatcggccgagagcacgtatggattctgcggacgtcacacgtgcgcgcgcacacacacaaacagttagatgacgcccagtctagcttgcgttcgatcgccatggcaggcggcagctgtgtcgagcttgccgccggctgcttacccgggattggccgccgcgtgcgctccagccgcggagacccggcgagctgcggaagttggcccactcggggaggttggccttgccgagcacgacggcgccggcgcgccgcagccgggccaccacgccggcgtcgcgcctggcgaccgcgccgagcagcgacagcgacccggccgtcgtgttgagccggtcgcgcgtcgcgatgatgtccttgaggaggacgggcacgccgtggagcgggccgcaacggtggccggtggcgcgctcggcgtcggcgcgcgccgcctgggcgagcgcgtcggggttgacctcgatgacggcgtggaggagcgtgttgaggcgggcgatgcggtcgaggtagaagcggacgagcgccgtggaggtgaggctgccgttgctgaagccgagctggatggcgtcgacggtggcctcatggaactcgaagccgagcgagccgccgccggcgagcgcgacagctgcgacgacgacgacgacgagcgcgggctgccgagccatggcgttcaaactggatagtttttccggtcagacgtgcactgctgtctttaacaatacggcagcagcagaacatagtgagaaagtctggtttgcttcttaacggttgcgttcatcctatttgcacacctaaactttcatttgcatgcaaactttttcttaaaaacttttcaaacgcagatgttgcatgctgtgagtactgtaactttcatatggttaaaatcaaatggtcaagagcatttttttttagtgagaattgttattagctttgcttgtaaaaactttgtaaggtatttttgtaaaatatgtagtgcaacttcatatatagtgtgtaaacctgaaaattattgttggatacaaaatggaagcctgatatttatctacgtcatcatgagtaaaactacggtgacgtagataaatcttagtcatcctttaacgatagtttcctcgtacatttgcactgcatatatatagagtttacactatatgtttttaattttttttaagtatggatagcaatactcaaactttaatattggatatgttacacgtcaaacattttaaactaatcgtattcttcctttaagtcgatcatgaggcaattttacatattttcattatttatactgaaaacattacctaagttataaaatgattcttgtgtgctttcttaggttcacttggtaagctgaaaatgaatcttaaagcaaatgggaggaatgcaaaaggtgaaaaattgagaaacaaacattccacctcaggtggcgattggatggatggttggattagggaggagatatcaacactgacaacacatactacacaataccccgcgcattgcagcgggtatttttagatgtatttgcaaaaaaaaaacacagtgaaagaacatgatgttattttaaagtgatatcgtatgatttctacttgagaaatataaaagttaactgaattgattgatacctgagggaataattacagcatatgtcttgtaggttgaggacgatatcaacatgtccctgtgtttcatgaacgcactcaactgtttgttgaagatattgatgtttctgcatcaagtatatatagtataagaaccgggtgcagctagtatttgctttttttaaaaaaaaaaaagaattgggtgcgatatatacaatagctacaacaatgttgcaaaatctggcataatagagtaaattccctgtactcttaaaaattcatgcaatctctctcgtacctctaaaatttacacgatcctttctatacacccgaaatttctacttgatccctgtctagggtctatctgataccatttgtgtgacatcccagcctaattaggatatagcttgtgtggcccatgagagctgtgtgtgcatgtttcgtaccaccttactagtttagcaagggtggaactaacttataagggtttgttctcccaaccatatcgctactgggttaacctttttacacaaagcgtagaagaaagtgtaagtggagtgatgtgtaagttggctcgtccgtcggatgtgctgggctacgtggttctgaagagtggttgttacaaatgatatcacagccgaccctcgcagttgcacgtacgtgtcaatgtgcgggcatatggtgcatgtcacatgtggactctgtgtgaggcacatggcatggcatatggcgccaacactggatgtacggacgtgcgctaagaggggttttgttcctgggatttgcctatgcttgtgtgggtgagttggaccgacggggacgtcaggtcctttgagggatcgtgtgatatcccggctgttgacggtcattagcgatcaatttcgaccgtcaatattaacaaaatagaggagaactagtcattcttgcaatgcatattttgtattaaaataataataatccactagtattaggtttactaaccttttgcagagaataaccataaagtggagaagaattgacatcaaatcaaacgatcaatcaatcggacgatgtcgagaatcagacttatgtataaaatgggccaagaactaagaattgacaagatgaattgggccaaaattcacaagtctgcaacaaggatcaggagaagaggccgccagccaaaccatgggctggttgggccgacccctggttcggtcgaacctcaggttcgtccgaacccccctcacggccgggaaccccaccgattttagggaattttatgatgtggtccatcacaaatgttatacatgttgcatgctaaactgtatggattatgatgagaaccataatcacgccacacatgtagaatttaccgtgaatctcacatgtcaataggaccgttgatgagggtgcacagtatggacgacaaaacacgcccctaatttttttaaaaaaaaattaatccattccgatacgttccaatgtgtttaaaagcctcttgctctatttttttttttaaaaaaaaccactcttagtttttattgatttggctagaacatgtttttttcttttctttagcttatataagtgttcgataattataatggtcgcctcaaatagctatggctcataacgatgatatacgtgtgttgtaggtattaaagattttgtttttctgcttatcaacaaataaatgacataatcaattttttcaaccttcatttaaaaaaaatattcttccgactttggaagagtgtcaccactaattcattttttttgtttcttggtattttctaaatataggacatcaatttgtgtttcgcgtaggggcgtcgaattgccctgtatgtgaatgctaaagcgtatttatagaatttactttgtactttccacacataaatcttagcaaatttactatatccatattgttatagtaggaaattgaagtttttttgggattcaactgtatcgtgccttgcttttgttcttgattttgttctctaacttagccaacagctaggtgaggtggggggactggatagtaaagaggataagaaagaaggatgaaaacgaaaaaatgaaagactattccatagggatgtggaaggaccttcctgcaatagaagtttctcgatgagaactttatgatattttccgcagatgatgtaacaaataaaggatcatcctttcacttatttagatattctaaggtggttcgttaaagtggtttttatatcatttatatatgcattagatgagtttatcgatgtgacatgtattgaacatatatgttaaaatcttcacctaaatcttttttacccattttttatctcccacttacaaatgaatgtcgatataatatattagtacaacattactagagattatagattgatgaccagctattgatgattgatgatatgtaaatatgtgatactggctattcaaaccactttttccaattatacaaaatcaccatccaaaaccatcaaaaggtgtaatataaacagtattgcaaagtttggaagcttgatgtctagtttcaaaattgggggtgctagatggatttctatccaaagtttaggggtatatgaactttttactaaattcaataaatcctggaagtaatttatataaatcctaaaagtaacttaacacaaataaaagtaagtttttacggaattaaaagtaaatccgttgtgtggggttaagggtaaaaacataagtctatctagaaattaaatttaatcatcgtcaattatagagctaactaaaattaacaataaaagtaaaaaactaacaatatgagaagtaatttaattaaatttaaaagtaatttacatatatgataaaaattaatttacatatacaataaaagtaatttaaaacatattttctctcggaatataatcatgtaaaatttaattataacattggataatagacctgataagtaatttaaaagaaaattttaattataacattggataatagacctgataagtaatttaaaagaaaattttatttgaaggttagct

SEQ ID NO: 76096 - DNA, 8158 bp, Oryza sativa
attacactcatcctaaaactacgaatctggacataaactatgaatctggacataacctatgtccagattcgtagtgtaatatattcggacggagggagtatttgctctaaacttcggaagaaacgttgtcttttaaaaaccttcaaaaaatacgttgtttaaccacttatttttgttaaatcaaagtgtttttattattattctgtgatgaacaattggcatcggagattattggttttgatatttggaatttatttttgaagtggttttggagatgattggatttcacaggtgaatctacaggtactgttggatgtggtccggtcagaccaggcatgtgctgccggtcagaccggcgtgtatcgcgcggtcagaccggcgcagcccgcggtctgatcggctgactctgtgtcgatttcggtttcgggttgtttgtttggatatccgtgattgtttcatgattatggcttctagatggatactatgagtatgtaatactgttgtttgctactaatgagtcaagttggagatagcttggtctcggaatatggtttctttgtttatttcatgtgtaggtgactagatgcctcgagagagtatttgctgtgatggaccgggagtcggcttggggataagacgacgttcgtggtgctcagagatcatgcgggatacttaggctagagttgatacacgtggttcgtgaagattccatatggcatacgatggaggtattgtgtgcgtatgggatgcggagtcgaatttggaaggagtttaaatttgatatgattggttatataaagtttgtttcttgtactagagggtttcctaaggtgtttaggacttctagtatgagtttggttcgtggctttaggctgcctacctcgggtatataaatagagggggagcgtgaggcttccctgtatcgcttttgagagcaattgagttgagagttgagttagggtttcgagtttagtcgaaatttttgtaaggaatactgttggtgcactttgtaaacacagagagaatcaataaagtcgtcatccactttaagagttcttcgatttgtgtttcatcgggtttcggcggtctaaccggcggcgcaccggcggtcagactggcggcatcccggcggtcagactggcgggtgacctgcggtcagaccggcttcagcgacaggtgacaggagctgatctcgacggtcagaccagagatacaatctcggtcagaccgacggcaaccaggcggtcagaccggcgcatctacttcggtcagactgcaatccgtcgaatttgagggtaacttttatttccgtaaagtattggtttttgggcataccaaccattcacccccccccctctggttggcttagttgttgtgattcaatcctacaattttaagttttttttattgaaatatctaatttataatccctataatccagtatttagccaaaaaaggaccctgattaggatgacctgctgtaatctgtttatgctaaagtgcccacctgaatgtcttcacctgaaaaaaaaaaggcaaaatagcagaggtctggattctgtatcttctgattgaacttttttagtatattcaagatcaatgtgaaataaagaagtaatctgaaacctcacaattgccatatgccaatgtgcagcactgatagctgaaagaacaaggatcgatctgctgaccaagttcactttcagaagagtcacaatccagcaatgaactcatatttccgtttcatgcctaaagtcacagataatcatatatcttttacttacacagtggcagatacagataattgtatggatattcatacatgggtggaactattcttgtttttattgcatttacaaaatgcataagcatatgcatcagaaaaggaaaaaataaaaaactaacacctatgaaatatgaatctatcatcctatgtacatctctacatattcacaagctatgaaaagaaccctgtatgtacatccaaatctgaatgaatttctaatcaagccttcatcttcgagaaaagaggaaggatccatcctttgctctaaatcggataaaagaaataccgtagactatccataattgctttcaatatgtttgtgaactaggttctacaatagtgacatcgacagagtgcttggagacgatgatgttgctggcgagatccttttggagttgcctaacattttcagctgtgatgattctacaagtgctccagtcgtcagcttccatatcaactcccaggtatgtgaaatggtcttgaacgctcaaactccatgtggagatgcacctaggaaataaacgagggaacagaaattataattagaagctaaaaaaaccagatttgagttgttaggttgttaaaatgagcctctaaacctgcagcaatttggatcttcaccactatcatcacatatctgttcggttatgtcgccctcagaatcattgacccatacctgaaattcgaacaagcatattatgtgtgtacactgtacaggatgtaacaccacatctctaaagaatattagcatatttgatttagattagtatcattgtcccatggaaggtgtgcagagcatctaacaacttgctgcactaggcattgattttgtattattaatggtaaatataaaaagggtgttaatacaaaaattcataaagtgtgctatagtgataaaatagataaagccagggccaagttaagtgtacaagagcgcattcttaattagcttatgtgcaagcctgtgaggcatacctctcttgggaagtggtggtaagttagatggggaagaaaggagaaataagggggcaaatgtggcacaatatcatgtccatgtgtgactcgaatcgtgttgggcacatatttggcaaaataagaggcaaaagcagcattgccaacacgaggctgtccgaaagtcatgagttgaacactattgcttccaagattgatctgtggacagagtaaaagaacaagactgtatcagtttacataacaaccaatgatggcattcaatttttttatggaaagaatgtgatacagatattacatctataatgtcttagaagagttgtaatctgaacactggatgtattagtaaaactttgagcctcgggggtacttacagcgagatcaagcgcacagaaggatgccatggctcctcccattgagtgccctgtaactatgacattgatatctccatatgactgtcttgccttgtggacagcacttgtgatagctagacgtaaaatcgtgttattataggaggagaaaaatccactgtgcacctttaaacagagaagtggagatattttaggggaaaaaaaaggcactgatcttcttttaataaaaggacttaaggagatagaaacactttgctagcgataataacctttgcgttaggcatgttaggatagctcagatcaagttgtttccatatcaagtccttgatccaattctgcatactgagtaagcaaatcaagatataaatcacatgggaacagggaacagtaacacactgtgcaaaatcagtgtacctgttttcttgagttcctcttattgcaacaattattgaatttaaattataatccacaccaacgaatgcctgttacattgttcacccacatagtgtcacacaatataaataaaatcattaaacgcttaatgtactcaaatatcatcgagaatttatgatattagtttgaaatttgtaagataagaacctgtaggcagttctccacatccacgattagagatttcatctcaaagccctatttcaaatgtagtcatatcaaaactagcaacaaatttatcctgtccatgacaaaagaaatatttttcctaaagaagaagaaaaggaaaatgcttttatgattcattaagaggaatggcagatcctgacaagcggacatttgaggtgattctgcccccaaccatcagtaacaatataagctttacttcgcagttaatgagtatccctctaaatatgaattgaacagaacaaacttgaaggcttcttacttgagtcaagtcattacaccttgagcacgtccatgtataaagagctgttaaatctgtcatgtacacctggagaaaacgaagagccatcagctaagttcttcttcttcttttttcatttttaaagtagctgattttattttggggcaaaaggagaaaacaagaaagagagacagttgcctttgtgaaatgcaaaacatgaacagaaatgttacctagaacacatactgcttatgtaaaaataaggaaaagtttcttacagcagaagcatattccacaagagtcatggcaagagtatggctatagttcaaagtttgctgagagtgctggacagagatatctgttataatgaaaaaagttagttcactccagtttttgatgatgagagcatgaatacaaacattgatgatcaactacatctactatacgaaggtatgcagcagacgaaccgacattatattcggtaataaaatcaaatgttgacaaatgaaaagaaaattgattaaggacatttgacttgtttggacatgcttaagatattaagccccatttgctcataagtgaaggaaagccgaaagctgatttcatattctcaatttttatggcatcaaacttataggaaaagtggccccagtatcacgttctggcctggtaaacttgtggtagcttcaagctcaatcttaaacctcaaatcagcagttccatgtgacgagtaactattaatgccccaaaaattgtgctaactgctagctaaatcttcttgtgaaattaagcccaatcggagtaggtggtgcagaaaaaatgctcgatcaagttgtgtatataatatatggcagatggcatgcagcatatagcagtactaaataaactttcaccaacagagtgtcaagcttgcattggtgaaggccaaactaaagaatactctataaatgtttgaacttcacatatttcaggatcctgagacaaagttttatgaatgcaaagaatccacaagctgtaatgaagtggaattcaagtttaaggaagcaagaaagaagttgagaactcaataaatattaggtttaaggttcaaatatgtgtttggaataataggaatctctgagcacaattatatccattatctttcttgccatcaacttctttatttccaatgttgttattttctactcacccaccaaccttgtcttccttttcagcaattagggcatcaattatattagtaaggacagggcagcaagaaattccaactgtcacccacctactcttgctcatgcatccccaattacaacagcagaacagctataacttggtcaactagtccagtaactccagtaaattactggtcatttcataccaaaccgacagccaaaacccagaacttggtaaaatcaaaagaacaagacaatctcatccatcatcagcactccccatttctctagaaaattaaaccttattacagatgcctgcataagcattggtctgctttctcccaccaaagcagtcagttactaataccttgatttgctatttgttctgttaaacgttaacccattttggaatacattgaggcaaacttagaacaattacccaacaagcatcaaaattggaaacttagggcaaagggtcacatgaaactacctctcccatgggaagcatttgacagcaagagcaccagagccaacacactgacgcatctccacctctccatgaacctacagacacatccaaaccaacctcccatcatcaaatgaatcagataagcaagcaaaaaagaacccaacttgatgagcctcgaaatgcagagcaaacaatcccagaatcgaaccggaaactacaccaagttatacccttgcatagtatgaacaagaacaaagaagaggaggaacaagattatcagtggggagaagagaagagaaaggaagcttagggggcaaagaatttgacctcatccgagctactacctccaactccaagaaagcaagaaagagaggctggattggatgaacaaagttacaaaacaaacaaaatcggaggaggccgagtattaatgcggagtgggagcccagcggtcgctttcccggcgctgtgtttggagggagaagaagaggaggaggagagagaatcagaatatgcggctctccctcctccggattatgctatgccaatgccaaggcctcaagatggtgggaccctaaaaagacatcaactttcgctgtctcgtcactcctgaatccatgatttgttcaacaagatctcgcaagaaaccgtgcatttctcatataaacaattaaacaaacgagcaccactctgtctttgaataattctgaagaaatttactgtactactcttgtcactgaataatctgaagaaattgtatccaggacattctggatctgaagaaatgagggaggatcgatgaatcactggatggatcgccgccgctgtcagggcaggtggccgtcgctggcggctccagcgaggcttcgacgcgaacgtgaggacgcgtagatcggagaaagaaatggagcccggatatctcagattggatggagctcgtgtttcctaatcgtgaacggcaccgatcgagtgcagaagaggaggcgaaccaacacatttgcgacgaattacgaagacctaatcgatcatgagatgatgagagagacctgcaagaaacagattgctcccctactcatttctccacgtaatctctcaccatgagagcacccacaatggtaaagtaaggagctatctatataaaacatatacatctcagcagtagactagattaatagtaaaccactttaatggtatgtctacatgggtatctatagctctctaatccattgtttcgtttttctatagactatctccaggttaaggttagtagatagctttgctctctctctcttcatttaatctcttctaagtaggaaaatatgctaacatggatctcttgtagagagcttatagataagcattgtgggtgccctgagtgttgcttaaacacgaagtgatatctctcaaagaaaaaaaaaagaagaggaagagcggactagtgggcctgaaatgggtcgcccccgttctgggccgtcgaggaggagagtggtgtgggctataagcccagcagaaactggaggtcttacacgaagaggcccagttgatgggccgatccatgggaaatgtctagtgggcaggcctggaagatggagtcgcgagcccacgtcgttgtaggctaacaggccgaaacagcaactgcatttgttcgtgagttaagtttgcgatgatgacgataaattgatgagatgtgtaatttgtaaatgggataatttcgtttttacccccactttaatgtctaatattgattttatccctattttttagggttttcgtttttacccccacttttttaaccgaaagaggcgtttacccctggtttagacggaagttagtgagcccgggtttatggcagttaagaaataaagaaataaatgaaataaagattttttgaatttgtgatttacctttttacccctgggaaatatctaaccctatactagtcgcttctctcctctcgcacgcgggtcactctcgaaaccgatctgggcagcacaggcgacgacgaattgggcggcgtgcgggcagcggccaggcgacgacgtgcgggcggcggccaggcgcagctcctcctgccggcgagcaggcgtgcactctgcgcgggctaggcggcgggaggaggcgatggctacggcggctcgtcgcaggaggcgacgggggcaacccagccaggcaatggtggcggcggcagcgagtgggcggcggcgacgagcgggcgtcggccatgcgcacctcctctcgctggtgagcaggcgcgcgctctgcgcgggctaggcggcgggaggaggcgatggcggccgcggctcggcactggaggcgatggcggctgggaggagttgcttgagttttcttctttttttttgacaggggatgttgctctaatttgtgatttggatctgcttgattttgggatgattgcagcttgctatttgtcttctagttttgtaaagaaaaagtgtcaaaattatgcctaaattctttcagtttttgtctaaattttatcaaatttgtggcaaaagtatg

SEQ ID NO: 76097 - DNA, 906 bp, Oryza sativa
ctgccgctgcagtggcgacggcgacgacggcggcggcgaagctgggggtaattagggttttcgcgaatcgagaggagcaaaccaatattaaaggaggcaaatgacatatgggtcccacctttactgaaggcccatctgtgaattttacggcccaagaggacggaggcccaggggcaaacgcgtaatttcggcagcgaggcggcacctatatacaccgcgtcgagctaaaccctaaccagccgcccattcgcgccgccgccgcagaagccaccgcgccccgcagctctcgtcgtcgtcgccgcggccgctcgatcacgatggctcccaccaagaaggcggtaaggttcctgatcgattgcgcctccctccccctcctcgtcgcgctctcccgctgcgcatctcaccatttcgttgcgatgtttttgctggtttctgattggtgggttgtggcgatgatgcagaagaagagcacggacaacatcaacaacaagctgcagctggtgatgaagagcggcaagtacacgctcggctacaagaccgtcctcaagacgctgcgcaactccaagggtatcgatcccgaccgattttttgttgttttgttcgatctggtagtgttagtggatgttgattgattagtttgctcgcttaatccgaattgtagggtaggtgggagtgttatgattgattgatgcgttgctagctaatcatagtctgcctatagatctgcgtgttagtttgtgcgataattttcgggtagattggactgtcttatgtttatttatgggtggaattgttgtaaatcctttggaagttgatcggctgtaaatttaagtttagatggattgtggttgcaattatttgggatgcgttgtgaattgagttgcattgcggttgggctgcaggaat

SEQ ID NO: 76098 - DNA, 3331 bp, Oryza sativa
tatctccagatttgctaaatgccaattgacgaatccagcttgcaatgatttgacaacaaagaggataataggcagtatccaccattcattgtcttccctactcttaaagctgcacaagattccagagaaagaagagaccagcatatcagtaaagcagatatggcaaggtgcaggtttttccctaacatagctaaaagaacaattaagtcctgtgaattgccattgagaagacagttaaaagaaagtgtagaatatataatctagatatatatttaaacagtttttttaagagttcttttaacagattagacagaagacatactaaatccaaaattaaaaaaaaaaactacggattgagcttccatattcctttatcaaggtgcagaatatatgactaccacatattacatcacagatagagacaaaatcagatgtccccaatttataaaagattttggttaatgaatccaatttgaagaatgctatttattgtacaaaacaaaaggtttcaagttgttcaatttaaataaagacaattcaaataaacatactccctccgtttcaaaatgtttgacaccattgactttttagcacatgtttgaccgttcgtcttattcaaaaaattttgtgaaatatgtaaaactatatgtgtacatgaaagtatatttaacaatgaatcaaatgatatgaaaagaataaataattacttaatttttttgaataagacgaatggtcaaacacgtaaaagtcaacggtgtcaaacattttgaaacggagggagtactattttaggctggtcactcattcaggttttcgataaagtgagtatgccaaagatataggaaaatgttgttggctattaccaccaggaccaaaaacacacacaatcgtacatacaggaaatgaacattggagactagtcaacatgaactcatattacatcaattatctttctgttattccatgcaataactcttgggtgatttaaattcaatgactacgggtaactcacagcagcctatatatgataatcaggttcatgaaccacgaatccaagtatatggacatggtcacatctcctaatcaccgagagcatgcacccaacatccaaactaatcattcaactaatgcaaaaacaatgtgaaccttattatcatcacatgtatggctcatgcactcatagagaggaactgatatgctttccatggtccatcactactaaatgcatgcaggaagagacttgtgcacaaaagaacatgaacaagttaactcctaacagggactttcttaacctaaattatattaatttagatttggatataaatatatattctgttataaatgtattttgcaaactcttattattgcaaccaacagtggaaaattttggaaaggttggtagatctgtagcatgtagtctttcccaactagacatgccttgaacccacgatatgcagccacatgggcatccctaaatccccagaaatactgcctaatctcttatgttagttttgatgtgcaaagtcataggataatctggttgggaacatatcatgtgcacacaagcttcccgtgcacaccaactagcaaatgtcacagaaaattctacaaaaaattagacacatagtttcaatagtactacacctacatgtgcaatcttatcttcaaattcattatattttagccgtaacaaaaaagacaaaatcctgacagatttttacccttaaaactgtcagatttttcacttttttattacgactaaaatataatgaatttgaatatgagactttgcatatatgtgtaatactattaggagtaaatgtccattttgtagaatttttcgtgacatttcctagttggtgtgcacaggaaagttgtatgcataaggatatgttcccaagctagtttcctgaacattggaagtcaccttttctttatttggagaatgaattctggaattcaaaagaaatattagaactacaaaccttttagtgtttagtgcatgaggaacggaagacactgataaagaagacagcccagagtacaaagctccataaatgattgctacaatctgcatagaataaaaattgcatataaaatctccaccgcctgttatgaataattaagccataaaattgagtatatgaacattacttaagtaacaggatgcaaaccaactcttgttaggctattctgaaatagaactttgtaacaaagcataacagatcatgctactcatgcaataccacaaataaaggggttcttagacaaaccatgagaggaaaggcttacaatgtttatgacagaagtagtattccaaagtgcaaaaatacgggtcacggaagatctctttggtcctcggctgaaaagtgcattgagaccagcaagaaagggagacagcaaagcaaggggaggaataagaagtacagcaaggaatgctccaacagatatccaatagtactgcacaagcataagcagggtgacggaaaaatcacccagtagtataatacatataagcagctgcaaagtttcctgaaatattatagcatggttccagtaaagatgccttcctctcaaatatgtgtgtaaaacaggattatagtgcttaccgcataaccaatgggcctacaattttgcaatagcaatgagaaagggaaaagataatctcttttacattccagtgattttagtgtaccctcattgattatcccaccattcactccacctgtcaaacgctttctagaaacagcatagcttgtgcaaggctgatcttgatttagcttcttggaactgatgttcttcctgtaggattaaaagcgataccactattttacacagcaagagtaatattagtaaaatatgatattgtgattggtaattatttccataccttgagcgatcgatgaattctgagacatgatcatgctgatgaagactcttatagaagtgctcattgacagcaacaacaatacctagctgataataacaagaagcagtggcttggaaccatcctaactccactcgaacaccatgccgctcaagttggggatttccatgactattaatccaagaaacaacaggtcccaaagttgatcggatgttcccttgccgtactgtcctcaactgagcattcaagcccgcaaccaatctgttccagatcgcagttgacacatactagagaaagggaatgaagtcaatggaaatgattggataataattttgcacttctacatagaggcttcagatatctagaatatcatatctagactgttcattatctaaatacagcatctgcatgctttactaggtcccaaaaactatgcaccaaaca

SEQ ID NO: 76099 - DNA, 3796 bp, Oryza sativa
attcctgcagccctattttcctctatggcaccctcagaagtactgaatatatttgcctctttccctgtttcaggtgactcggacatcatcaacacaacccctgcctcccagtgaagaagtttttacctatttagttgagatgtagggttcagacgtgcttacatggccaatggctgtttcttggttatctttagttgtgtaattttgctatgctgagttgggatctgccatacagataatactccatattgttgttaaggcatttctatggttttgtttgatgagatctctatttatatattgagcaagtttattctcctgctgttctgtgagcatcagcaaagagagcatcatccaagatgtttgcttccttgcttatgtggttcaaaagctagactatggttgttaactatctcgaagcttcgaatcacttgctttgttttttatccatggtgtgattcgctgattgccgttttggtttctgctcctggagaatctggaaacgtagtgtggcttccacgtttgcttgtcgatttgattatcgccgtttagcagctgctgttttgtttatgcttttctatattccgtgacgtaataatgcctatctcccagattgtaaggttcatccgtttgtgatacgagcgtacttaatgctaggagtacgtgtgtatttattaggttaatttaagtgagtttctatatattgttgtagtgttagaagtgcatctaacaaaactaattttgtgaaacattttttgtttgaacaaggcacgtgtttactgataagttgatgtgagcaggtcaacaccatctaattgggcacacagattagctatcacgggattagtaattttgtactactagtgtgccgtagttggtagtatcatgggctcatagtggtcttccctattaactaagggtctattcactttgctaccattttcaaccttaccaaattatagtattgtcaaattttagcaaggttgccaaaattttggcaaggttgtcaaattttgacaagattttatatgtgcttagtaaaatttaggaacaaactaaatgtagcaactttttttttaactttgccaaaacttgataagattgaaaatggtagcaaactgaacaagccataatcgtggaccaaagaaaggaaacaaatgttgaccatcacggaaggttctaggggccagcagaatccacacctggcacagtattatgccatttcattaacatggtttggttacctacaaaattcacattcccaaaaccaaaacataaatatagcacaaaaaattgacaaattttatggaatatatgaagtagagcaaccattatacgagtttaattgccataataatacgcaatacccaaatatagcggctccctaatctcctctcataattgccggtgcgtgatgcgggagttggttcgaccagcccaaccgcttcccacccgaacccgacctgccacgtcggaccaagtccaacgcatttccgccccctccacccaatcccgcgccgccacgtgtccccgagtgcgcgagaaatttgtcctaaatcccaccattaccgcggccgctttcacatctcctcctcctcgtaatcatcttctcttctctcttccccggcggcgacgcggcggcgccggtcaaaccactcctcgccggcgaggggagcgcggatcgggctcgggaggaggctaggggtttggctcgctcgctcgctttcggcgtgcagctgaggcggtggacttggcggctgtggcggaggtggggaggtggaggtggaggggagatggaggggttcctgcagaagctgaaggggctggacgcgtaccccaaggtgaacgaggacttctacaagcggacgctctccggcggcgtcgtcacggtcgtcgcctccgtcgtcatgctgctgctgttcgtctccgagacccgtaagtgtgtgtgcgcgaagcagccgccgccgcgcggatgttgtgtgctgttcgcgtactctcccatccgtggccgtaatggctcgatgtggtttggaattcgaggagttggttcttgccaacaagatcaaagtcggatttcgagttgtcgatggggatggggatttagagtaagatttgaattcaatgatgcggtgggcgtgttcctgctgctgctgcatgcttgaatgtttggaatatttccaggggcacctgaccgcgctcttggtaatttctagaagaaggtgcccttttaggtagacaggttttgcggtgtgtcagggtaacgaactaaagatgggcatgttgcgatgggcattgacgctaatggtgatgtatgctgcgcgcgatttttcttttctttttctttttccttttcgggtgtgagattcctgaaaagttcaagaatgcttttggctgagttcctgcgtctctgaggaagataaattagtttatttttttctgctattacttggatttatgtgctgctatcactgttggttcgtgaagggtaagtttttgtgttgttggctctgcatgttggatcatgcgtgcaaaattaggtcgtcacaaggattatgccgttttcaagttaccttttgagtaaagtctgttgttgcaaaggttctgttttatttggccagcatggccttacattactttggagtttggagaacaagaggttacaagttgtcgaatttttatgctctttttgtttggtgcaatttgttagtgtttatttttttaaaaaaattctggtagtgagaaggttctttcataaaatgtttttgcagggtcatatttttattcagcaacagagactaagctagtggttgacacatcaagaggggaaaggctacgagttaatgttagtatttatttgattgttaaactagattcatgtcatatgttgtacttctattgtttctagtataaaatgcatactcttttgtatgctattcacttacaatctgttgggaactaggtgtgaatatttcctgttaacttctaatgctaaaactgttttgcagtttgacgtaacttttccgagtgttccctgcacccttctcagtgttgataccatggatattagtggagagcagcatcatgacattgtacgcacttatgctatatcatcttctaattcttagtatgtgttgatttgtccatcttattattccattgtttgttgtagaggcatgatatagaaaagaggcgattagacgcacatggtaatgtcattgaggctagaaaagaaggcattggtggagcaaaggttggtgatcactgctttagttacactttgaggttgagctcattaataaactaagtgattccccgcgctttgctgcgggaattaccaaacaattctcaatatatatttttcgacaatcaagatagcagtaaaaaggaaaaaaataatgaaacatcagggtttatcggtacttatcatgaaacaaacaaatgatatccgcgctttaatgtgaaacatataacatattataaaaatgatagatagatttgttaaactattgtgcaaatgatgtgaggggtggtgattagatatgcttgcatgttgatttgtagaattaaataaattgcagatgatgttgtatgcttgcatgtcttaaatatgtaataattgctagtgggtgatgatgtgacattgttgcatgttgagctttagacttagtgagctataactttatagaaagtatagatttaaaatatcgaactagagtcgtctgtacaaattattcttggtgacctagtatatttccctacgatgtacagcattgtagttgttggaaaacaagtggaa

SEQ ID NO: 76100 - DNA, 1834 bp, Oryza sativa
cctaagttgacgtcttctgaagccttcttgtaagaactgccagttcctttttttttttttgtgtgtgtgtgtgtgtttctagtttacaagaacctatcatggcccaaatctcatggagataggactggatctatatcttgcccttaacatcaaggattaatcctgaactgtaatttttaacaaggcggtaagatagataaaaatattagagaatatctgcccatgtagccaaaagagataagattggcactaagtatagtgctaatccactggcaaagtcaacttcagaaaagaaacctcacaaatgtaacaggaatcagcatatattaaagtattaaacacaccaaaatgaacacgcaaatcaaaaatataatggcagctgatatcctgcagaaattgtcagcatcagattggtcgttttcatttcacaatcccaaaatgaatgtcatgtacatggaagaagaatctggccgtctctttttcaaggctaacagcaacctccgtgtatggaaacttcttccaaccattttcctggcagcgcaagaataagttgtaaatgaattagtttattttatccataaagtggtaagaacatatatgcggagcattttgagtgcaatgcaacatctctgtctcaacatgcagatccaagaggataaacacaagactcattggcaagaggacactgagaaaaaatggatatctcatatgtatagtatttattgatgttataatagttaagaattgccatttcaggcatcatccttcgcagaaataaaataaagactagtgagtcatagagggacaaaaagagcaaacaatcagcttgcatgatgttagttgcataaaatcatgacatggcattgggagagcaatgagaaagatacactaacttgatatgatttccatataaccaacagaatgtcaccactgtacagagagctaatacaacagagagcaaagcacaacctattacatagaccagaagttaaaagtaactagatgactgcctggaccaacaagctaggtacccagtaacagcacaagatatctagaagccattcatctccagaaggtaagttcgcctcttcatcagcgccttcacagcaaacttgaatggtccatcaaatgctccggagacaaatgcatccgtttccttgcggctagtatgaccgccattgcttccctcgggtgagggcttgatagcgaccaacgttgcaccttgcaacgcaatgccgccaggaagctcaagatatggagcgtatttgagcttcatgttgcatgctggaacctgagtcctgttagaacatgctgaggccgacaactggttctccctaaattccttaagctgctccgctcccatggacaatgtgccctggccatcagcatcggtcagtaccaagcttgtaaagtgggatgatccttgataattgaccgaagaagataatgtctcgttgatgccgcaatcagagagctgattgtccacacgacgcggagtttcaaccctccattggtatagaaggattccggcatgcttccattgtcctccgaatacagctcatgctctgcaccaacaggcttgcggtcgacctgagtacccccaagaatcacacaattctgaagcgtactcccatactccgctcgccatttcaggagaactccctcctcagtccccacatcccccgagggcagctccacccgcagattccggatgtgcgtgaagttccggagcacctgcgccggcgagtgctgcgcgagctgcgggaacagcggccgcccagcaccgttcgggccgcgcatgctgtggaacggcttgatgatcgtgaacagcatc

SEQ ID NO: 76101 - DNA, 4370 bp, Oryza sativa
cgcgcaagaacaatagtaacatgaacactcgttgcaagcattccctccatcatctgatccgagatgtcatcttgcacccggcgcaacttcttggaaagagcagtggccgcgcagaagaggcacacgatgttcctctcctggcacgccgcgatgagcgtgtgggcgtggcggagcgtcgagtcgagctcctccagagcagctgccatggcggggttgctcctgatgatcaccgtgtcctcgagctgggagagtatgctgctcaccctgaccactcgccttctgatctggacacactcctgcttgttctggcgaaccgtctccacggcctgcctgattttgagcgctaattccgcgatgtgcctcacgctgcccaatgaatcagccatcgatccttcctaccgccttgcagcatgtacaatcaacaaattaattcggatttgcgactaaaccaaccggatcaagaagcaagagaaaaatatatatagcactaaaagtttaaacaagctcgcactctatcaccaaccttagcctataatcttgcgaatttctgctctcctcgcggtctctgcctcttccaatctgatatgaactgctcactctcctcaagataggccagcactggaggatagctatatatgtactcttttcatattactccctcctctaaatgtttgacgctgttgactattttaaacatgtttgaccgttcgtcttattcaaaaaatttaagtaattattaattctttttctatcatttgatttattgttaaatatacttttatgtattcatatagattacatatttcacaaaagtttctcaataagacaaacagtcaaacatgtttaaaaaagtcaacggtgtcaaatatttaggaaaggagagagtatattacaagttgttagatttttttagttaaaattatttaagtttgatcaagtttatagaaaactatactaacattttcaattcaaagtaaaatattacttcctccgtttcacaatgtaagttattctaccatttctcacattcatattgatgttaatgaatctagatatgaatctaaatagatatatgtctagattaattaacataaatatgaatgtagaaaatgttagaatgacttacatttttttaaacggagggagtatcagaatatattcaatgttaaatgtaataaaaataatttggtgttgtaaatattacttattttaaaaataatttaaaaattcaaacgatttgtaatatgggacggaaggagtagtatatatatacaagataacgaaggtagatgctacttcctccgtttcacaatgtaagtcattctaatttttcccacattcatattcatgttaatgaatctagataaatatatatgtttagattcattaacattaatatgaatgtgggaaatactaaaatgacttacactgggaaacggagggagtatattatattatgctggagatcgatgcaaaacggactaaactaatgatgccaagtacacggtgttggctagctaggtcaaacgtgtgtttgtgctaatttcttaattgtttccgtggaaggtcaactgtgttaattaggatcccgaactaccgaaggccaacacaaaccattatcgctatcggtttgagaaccaaaagaaatcgccattcctggcaagtacgtgcagccttgacagttggcaccaacaccaacgtggatgatgtttcgcacacatgcacacacacacagctgatgaacaagacagcagcaaacggtgattgctatcatgtgcaaatttagtcatcgttactatttaattacatccttctggaaatcaaattaaatatatctgcacaaataaaaagctttatccgaccgttggttgtcctacgtacattagtttgttccattttttagaatgcaataataatgtatccatcctcaagttagactacaattaattgttagaaatttggtcataatttagcatattttaatccaaaattttaggacaataatcaagacatacacaatgagaagcgatctggtgatgaggctaaacataaacatgagcatgcttatggcaaaataagcatagacatcgttgacgttcacatagaatttcaatcctatggataacattgtgaacatgtaaataacaagaagaaaatcaaataagcttagaatcttatacccagggaatggtgcagaagatgttgaggtattcatattgcctccgttgatgttgtctcatccgttctctccattagaagtgatcgtgaagcagaaacagaggaagatgcaacgttatcgtcgaagaacgaagaataggagcagtcgcgcttgaagcgctacccaaaaatttgatcgcccgcctacccatgcagtttctcaagcggacggagttccggaagcacatgctcatcccgtacacctgtgcacgcaggtgaacagaaccgaggaaggattctacagcccaagaacagagggggaggaactcgaagtgcaagagtcgggaagaactgatgttcttccttctggtcgctgcggaatatatatatgcgagtgtgagagtaacgttcaggatcatcaactgtaacatcctgaaacactaaaatttcaaactttttaaaacttttgcatcatgctggatgttatggttgttattacttgccaaactgtaaatcatctcaatggaaaaatcaaattaaaggtgcgcatctaaataataaatacaatttacatgaatacattgttttacaaataaattcaaccaatgtgctaatgtattattaaaggtcacattagaatattttaattaactttagaaatatcagagcctccgagttatatagggtgaatttaggatgatataaagtaaagccaatttcattttgggaaatgatgaataaataaataaataaatattcaaatcaaatatttcaattcttaaacccaaaatgtataggttacatctcaattcaaaattccaatccaagacattttgcagtttggcccctccatcttttccttttcccttttcttccttctctctcttcttcccagccgccactgttcctgggccaccaggtgctcgaccagagccctagcccaagccgcacaccgagcgccacacctccgagccacgaccgtgtcgcgcacgacaggtgtgccctcccggtcaccttgcaccgtgcgccgcgccgtgtgccacgccacgcccgtgtgggcccgccgcccgaccgagccccggattcccgcgagtggctgcgccgccacgagcgcctgcttcacctcgtcccatcacgagtcgccattgaagtggagggataacggccaccacgtcgcccggcgtcaccctagaaaataggcctgcgcctccctactaaagccgttaccactgcccgtcgctgccaatcatgttgccattgcatcgccatcacattgccatctcgtcagccctagctgagaccgttggataatgcgatgtttcttccccagctagcactccctcttctggaaccttatcacataggcaatcatgcccgatcgaagcattgaacccgaatcctgggaggatcgaaccttagccgcgtcgtccacccttgtccgattgccattaggactctagctcagctattgtgtgttgccaatcttatccccaaggtttccttacaccctaagctaagccctcatataaaccccatccgtctctgccttcttcgtgaaatgcatttcgtcgaacaccttgggcgcgtgttgcaccttcttctccgctccaccactgcagccgatcttcgccgtcccgccgtctctcggtaattcctcactcctgtgacttcttatagtccccaagtatctagtttccccgtcaatttaatcaattagggccgtaaccatgccaagcgcgacctccgaagctccgcacatggaggtcgccgtggacaagccatcccggagctcctcctctccatctagctagcaaaatggaaccctcacacgccgtagatgccaacgccctcgtcgatttggtgggaaaccctctctaccgctctagcccatagctacccgaactcggcttcatgacggctcttggcttcatgacggctcttggcttgacgccgtccacgcgccgctatgcgccgtggctgccgtcgggaagtcgtcggagcctcgccgcaccctccccggcagccgccgtgccgacctcgcgccgtaccggctgcgctcggtcgagcccagccgtgccctggatgctgcctcccgttcggctggaggtagaagaagggtaggagagagaaacagaaagagagcagccgggcccacatgtcattagctccatcctatttccctttagaaaattaatcctgtgaaaaagaaaatc

SEQ ID NO: 76102 - DNA, 4109 bp, Oryza sativa
ttcatttgggcgaaaatagaccccgtaccatagcaatcaactacagctttctacaggaacagagccatgacctaactgaccttgaggaccctttcatagaagatgaaataaaataagcaatctttcacgcaagatcagataacgccccaggtcctgatggcttcacaggtgcttttttcaaaaaatgttgggagattatacaggaagacgttgttctggcgataaatcaggtggctaaccacgacactcgaagcctttggttactaaactcggcctacattgccctcttgcctaagaggagtgaagcacttcgagtaggtgattatagactgatcagcctcattcatgcctttgggaagctcttctcaaaattattagcaaacagattggcccctaagctccaacagatgatctcaaaaaaccaaagcgccttcaaaaagggaagaaatatctaggacaatttcctcttcgtcaacagcctggtgcgcgaactgcattcctccaaaacctcggcgatcctcctgaagctagacattgcaaaagctttggacactgtcagttggccataccttcttgatagactcagacacctggggttcggagacaggtggattggatggatcatctctatcctatctacgtcctcttcaaagatcatcctaaacgggaaagcaggtgacagcttcttgcacggaagaggtcttcgtcagggtgacccactctcccccatgctctttattctggcgatcgaccccttacagagattacttgctaaggcacaggaagagggcctactccaacctctccaaaggcggacatctcgtttcaatgtagccttgtatgctgatgacgcggtggtgttcacaaggccagataaacaggaacttcagacagtacaggcgattctccataactttggactctcaacagggatggtcactaacctatctaagagcgaaatctacgcaataagatgtgaagacctggacctccaagatattatctcccctttcccagcgcaattgaaggccttccaatgcacatacctaggtctccctttgcacatcagaaagcacaaaaaatcggatgtgcaaccactcattgacaggttttcagctcggcttccgacatggaaaggaaaattgctgaataagacaggtcgaacggttttgatcaaatccaccctttctgccctcccaacttatcaccttacagtcttccccctaaagaaatgggctaaaaaaaagatcgacaaaatccggcgcggattcctctggacaggatcagaacaggcacagggaggacactgcttagtaaactggaagagggcctgcagaccaaagaacatgggagggctgggcataacaaaccttgagctcttcgaccgttacttaagacttcgctggctctggcaagaatgtactgcagtagataaaccttagcagggatctacccttccttgtgatgaaacagatcgacaagttttcagggcttccacggtgatcaccttaggaaatggcaacaggacaaaattctggcatgacagatggcttgaggggtcatcccctaaagagctatacccttccctctaccagatagcaacaagaaaaaacaaaacggtggcacaggagcttcaagacaaccgttggttgagacagatgcgaagaatgaacaccacagttcaagtcagagagttcatccccctatggcaccaaatccagcaggtcgttctacaagagcaaatggatgacacgattatgtggcggtggacttcaaatggaacctactcggcaaaaaccgtgtacaggattcagttcgttggaggcatccaagataacaggtcggatttcttttggaaggcaaaagcggaaaataaatgcaaattcttcggttggcttatgatacacaagaagattctcactgccgataagcttcacattcgtgcttgggacaacagtcacatctgccctctttgtggtgtagaactggagacagccactcacctcctcatggactgctcctttgcaaagcaagtctggagactcatttggcagaaagcaggccttcatatgccactagcctctcttttcaatggagacatgctagcatggtagacagcttgcaggagagagatggtgaaagaacagagaagaaattttgatggcctcttcatctacacagtttggggcatttggcttcaatgacatgctaggatcttcaagggtgcttatggtgcaagtcgtcgagtcaataatcgacatgtgcaaggcctatgatggagcacacaatttagatgagtagttctcgtatcctcctgctagttgctctacactatctaaaaattcctgtcaactcctctgtcaacacctcggaagggggtccccatgggatccttttgtaaccttacttgtacaaactcggtttccctctcttctccttttatgaaataggcagagctcctgcctttacccctcaaaaaaaacttgtagtgattcttcccattggtgataacttgttcagtcaacaagtttattttatcttctttagatggccaaaccttcaacttgatcaactctgcaaatggcctgggctctttagaaatcagcactatttggcaaatttacacaactgaccggcaccatatgagcttcaagatcctcattagcgcatctgaacaagtacctactccatttatcaaatactagcccttgattgcaccagaaggatagccatggttctagctgctactcggaaaaggtacgtgtgcaaatgactcgagaaggaggtacggtggccttggttggagagccctaaataccagcacatttcgactgccttggatcagtcttggaattgaccatgggttcaaatccatcttggtgacgtaccacgacatgctctggctgataaccggatagagaatgtgaacgcctacgtcttgtactttgtctcaagcaccttgtggactacttgtcagcaattgctttgcgactaaaccgttgaagcttgcattgtaggatcgaacaacaagaactaagccaaccacaaggggacgggtttgaatggttgtagtaccaaaaaaccaaaacttttagtggaaatgaaagtcaccctcaaattcgatgtcacgcggtctaaccgaagtagatgcgccggtctgaccgagattattgctctggtcttaccgccgagatcagctgttgtcacctgaggctcacgctggtttgaccgccgttactccgctggtctgacagtcatgatgccgtcggtctgaccaccggtatctcgccggttggaccatcgaacccgagcaaacacaaattgaagatctctcaaaatagatgacaactttattacttctttttgtgtttacaaagtgcaacaaaagcactcctcatgaaaatctcggctaaactcgaaaccctaactattctcacaactcaatgctctctaaagcgatatcgggaggcctcaccctccctctctatttatacatgaggtaagcagcctaaaactacgaaccaaactcagacaagaagtcctaatccacctaggaaacctttccgtacaagaaaccaactttacaaactccaacagtagcaaatttggactccttccaaattcgactctgcatcccatacgcacacaatatctccatcgtgtgccatatggaatcttcaccaaccacgtgcattgatctttagcctaagtatcccgcataatatctaaccgttcggacgtcaccttatctccaagttgactcccgatccatattccaagaccaagctatcaccaacttgactcattgttagcaaacaacagtattacatacgcatagtatccatctagaagccataaacacatattaatcacggatatccaatcaaacaacccgaaatcgaaacctacacagagtcagccgatcagaccgtggtctggctggtctgacagctcgatacacgccaatctgatcgcaacccatgcccggtctaactggaccaaatcatccagcagcacctaggcccgggccaagtcagtggggggaccctatcgggctccttcccccccaaaacaaactgtacgtgggcagaaccgttgttgcctgatgg

SEQ ID NO: 76103 - DNA, 1137 bp, Oryza sativa
cggaataagaataaaaaacactttcattttacatgcataatgcaggcacaatagtgagcttggcatctgcttcagcaaacacaacacaatcctcagtgacattgtcaccgccatcaccatcaacatcttgactggcctccagtgggaactggatcggtgttactactgagaggtgccgcaactccagtcagatcagcgcttgtagttgattgaaccttgatgtcacagcatgtcttgagcatactgttgagcgtggcaatcgtccttgtgcacagtttgtttggaatatcaccgctggttcctcctcgacttgagctatgtcacccttggtttcgtcggtctcaattgaagacaatgttgttgccgtggcaaacaacatgactgagggcatggatgaactcgtggcaagaacacaggttcaagtgtagtaggagtgctctcagccacaaactcagtgttggcgtacatcggtcctgacatcgaccaattggtaggcattaactctgcgccatccgtgggacaagcccatgcatgctggacatcgagaggcagtagatgttgcggccctaggtgactgctcgagccctctccacatcaccactctattgacgcgaaattcgtcgttcacatgaaagccgagaagatctgcttattttcagtgcacgtcatatcaatcgtttttagcgcataccatttatttcgatcctatatctaataagatggacatagatcgatgatcaagaagccgatcggccagtagaaacgtgagatttatgctatcatcggctagcactaagctatgcataataaacaataaacgctatttatcaaaggcaatcttgatagatcagaccgaactgaagatagtataagattggaattaattgagatagatttaattgaagattatacaaatttgagtataagccaatgcaactcaagatgcaatgagataatgtaatatgaaccaatcgtcatgatataacgtgatagatgtaaatctgatggttaaaatgtacattggctgagatatatgttccgatgtaagtaaattaaagtgtatatcgactaactaaccgatatatctgatagctcaagtctaatataaagataactcatcgtctagcactacaataa

SEQ ID NO: 76104 - DNA, 7289 bp, Oryza sativa
tgggtttttctcgacgtacaagctgagatccgtgcctgcaaagagcgtggaattcaacgtacttctccaacccgtgatgtccattgtcctattcataagacaaagaatcacgacctctcaagctgcaaggttcttctcagcaccatgaggacgtcacctcctaaggttcaacagtcacaaatctctcttagagatgcggacaaggaacgaggagtgacggttatctcagatcgattcgttggggtaatcgacatcgatcctcacgagctgtctgttctacacttgttcgaagaccagacctcatcatcaacgagtacaccacgtgatgtattcgccatcgatgggaccaacacatctgcgcacgctaacgcagaacggaggatcaagtggttacaccggcccagcacatcagggccatcaacgcattgctgagggaaactccttatgaccccattctgaacgatgatctcgaacagtggacagaacggctacgggaatccgtagctaacctcagtaacgcattcgaggaggccgctgctagggcacaaccagaacaaccgccgaacggcggtgctgacggagaaccacctgaacagcggacgtcacctcgtcaagccactcctccgcttcggggcaccagcgatctcctcgaccatctaaacggtcgccgagaagcgcgacgcactcgagacaacgacgaccgttcttgacatcgcgtctcctcgcgacgccgcgggaacgaagaacaaggaggacatccaagcgagaaccgagaccgtgataatcgccacaaccgccacgaacacaccaatcgcgagcagcggatgccgggcgatactgatcgaggacgacatcgtgatgacgatgacggcggagatcgacgccgggacagcaacggtgggcgacgacaagattctcgagaacccggacgtcattctcgtaatcgcacaccggaaccgagcgactcttcatcgtcatcgtcatcatcctcatcatcttcgccatcggacagacatccacggagaacgtacgatcaccgacaacccactgcccccggcggtgggtgtagagctttcagccgtgctctgcgggacgtccgatggcctgagaggtttcgaccgggagcgatagagaaatacgacggaagcaccgacccggaagagttcctttaggtctaatccatagtagatcaaaaccggggtcaaaaccaccaaaggacctcgggtgactggttttgtatagttaagagatcctgcatcaaaaatgttttttatccgagtaaattgcacccacggtgcatcaacttggcatgtgggtgcaatttggtgcaagaacttgagaaatgagcattctagtacaacagcttgataggtaggtgcaatttagtataagtactttataacaacttgcaaggtaggtacggttttgatacagtaaactaaggagttatgcgacaacttaattatttggagcatttttttatatagattcatttttaagtaattattttgacaatatacaagggttgatttttataagcatatttatattgttatcctaataactcataactgaaagtcaattaaactagatgtaaaaattattatatttcggttgatatttaagaaggtgaagaaaacaaaaggaaatcttaaaggtaattggatgtaaactagatgtgaaatataattcttaaagattaaatttaatatttaaggtaatatccgtaggattactatgtaatggcatattgatatcgtgaaaaaactcacctagcatatgcttagccaacttgatgcatcaaaatattaaattattaagttcctgtactggaacgcacccacttatcaatttgttgcactcaaacgtggtacctacctaccaagttgttgtatcatgggtgcaatcaactctttttatcccggtgacaagttgagggaccttcggtgtactttttcctctctgtcagtgaagaggtcaaggccggcttcccaagttgggcagcccagtgggccgaagggcctggtgatttctaaggcttcatgaccggttcgtagccctaattcctatatatacatatatatatatatatatatatatatatatatatatatatatatatatatatatatatatatatatatatatatatatatattaaatatcttaaaggtgctggattagctgccttccgggtgattgagccagccgttatccaatacaatcgtgacacgttgttttgttacagttgatcaactgccaagccaggttagcgcttctatgggccagctgattttttggcccaatgcacggcagccttttagtgctcagcggcccatcgcggcatcggtgccgtgaccttgctccgtcctgggtttcctgtgcgctggatcatccgtcggtcgccgctatcctctcgacgcgtgccccttctccatcccctatctgaccatcagcgacggagcgacgatagtgctctgccatgggcgtacggcggcgacggggttggctacggctgctgctccactacgcggagagccctatgaggaccaggggaggtaatctgcatcgctccttctttcttccactcccttttttcttccatatatggagctggttctatttgctgctcctcctgcttagttcttgaggatttccagctcggtggtttccctcaccgcatcgtctcgtgtggtccgaccgttcctgctgtgctcgctctcgatttccccattgcagtgccgatgttgtgccagccatacttgtgctcactgtttttttcctgttttataccttccaggctgcgctctcggattggtgtctctcccacatcgcgtcttgctttggggggagggaggggggcatctttgcctccctcagctacttctcgctaaggtatttagtataagatcacctggttttatcatggggatgcctgttcagttcagtacgtatgtgtggtgcttggtatatgggtaaactgagatgattatgtcactggatgtttgttcacttcatttcgcatatatggttcccctctgtttttttcattggattcctgattagctacgatttggcatatatttatgttatttcgtttttcatctttcctgccgtgtctcgctgtcgatttccccattgcgatgccgatgttgttccatccatgcgtgtgctcagtgtattttttttctctgccttccaggttgcgggctccaattggcgtctctcccacacatcgcatcttcttttggggggagggaggggggcatctttgccttcgtcagctacttctcgctaaggtatttaatacaagatcacattgttttatcactgggatggctattgagttcattacatatgtgtggagctgtggtatatggataaactgagatgattatgtcagcgaatacctgtttgcttgatttcgcatatatggtgctcctctgttttttcccttggattgctaattagctgtgctttggcatatatttacattatttcatttttgtattgtcctgttatgttatatattctttcgtaggttggtttttttatcgcttatgtgggatacatgtttagttcatttcacatatgcgatgctgcgatatgtataaactgagatgcttttgtctccagtatagctgttcggtggatttcatatatatggtgctcctcttttttccctccttcaattaccaattgctttgttttacattgttccgctatgatatatattcgctcctctttttttccctccttcaattaccgattactttgttttacattgttccgctgtgatatatattcttggctgtttttcgatcgcttgtgttgttgccagttgatttcgttcggcgtccatctgtttcttcctttgctggaccttatacagttatatgtttgggttagcctttcaatgtggttatgtctttggtgttttaccattttcgtaaacgcattttcaaatatttgtatgttccagtctaagcatccgagagctcctggttcagctcttgatgatttcccactttgttgctgttagatatgtcatattatgtccagttattcagtgcttgcttatatgcatctatctttcttccatatttctatagtagctcgtgcctctgttctttatgctttccctctccattatatattcatccatatgtttttctgaatgtgtctatattttgctcctttcgtttcttggtgtatagaaatgacatggagccatccagattcgttcgcatctgcccgcggaagcgtccagatggtacttggtgatgtcattatagtttcgtatgcaagcctcggagttagcaaggccattagcgatccttttttttccctgattcacacttttgctcaccaatagatgggtcctccatatcatctgctgccaataagcacttagagcttacgagtggtgtgtcatgtgccataggtatgtacgctcaatagtctgagagttagcgaggtcattaggataattgttgtttttttgtttcctgattcgcaattctgccttccgatagatgagccgtcatcatcccgcggtgccactgggttctcaatgctcacgggtagttcatcatgcactataggtatgtacgcttgctgtagtcgctgctgtctcaatgtttagtgtcatctcttatcccttgcacatctttttctcatatttttgtacagttgtccacttgctgtgatacgatatgctcaaaatgtatgttcatattgataagttcatctatttgctcattggttctttctagcttagctttgttttctctccgatccctcattctatctcctcgcatcacttccacagggagtcgtggagctggccacattcagtcttctcgacccaacagttacctctggactactatttgttgtgttgcttagcttgctaaggccttttcccttcttccgattgatttttttcctgtttaaatttttcataggagatcatttttgcccaatagtgccagcacgtgttgctcgagtgaaccgggaaaaaagacaggccgctaggaaaatgcgtcttattttgcgacaaggttcttgacctgcttatgtacatgatcctttctggtcgcttatggcgatgttctttctttcttttgtttccctttatttcttatttgctaattctcttcttccgttcttcttctatttgcatagaacatgtgccacgttcactgtcgatgagattcacatattccataccaaaggagcacatgcaaattcttaaaggtaatatcttagtaccagccttgctttgcttcgcctttgtcccttttttttttgcctctctatctatttctggacaaacatatgcatgcttctctacttataggtttccttttcgctcttatagctacgtacccagatcgttcctattatggtggccttgactatgaatgcaatcattgtggtgcattattttggtaccaagaaagggttgttagccagagctcgcacagagccaagaggattgcatacaatctgtgttgtcgtggtggaaagatctccttacccccacccaagccttttcctcctatcttacaagacttgattcgttttgatggcggtgcccgttccaactctttcatgcgactcatcaggcaatataattcattatttgcattcacatcgcttggggctaacattgataggagcataaacactggtcaggggcattatgtttttcgtatcaatggtgttgtccatcacagaattggttctctggttactgctcctggacaacgtccggaattcgcccagctgtacatatatgacaccgccaatgagctccagaataggcttaatattttttatcacactgatgatcctggggatgtccctgatcctgttattgtgcaagagcttatctcgatgcttgaccagttcaatcctcttgtgcaacagttccgtcttgctcgagacaagctgctttctccaagtgctcctgagattgctatcaagctcattgggtcagaccattctcagagtgaccattacagccttcccaccatctctgagttggcaacactaattatacctggtgcatcttgtgaggtatcaaagtttgatgtcattgtgcagaagcattcaggtgagttatgtcagttgtcacctattcatccagcccttatgtcattgcagtacccgcttctattcccatatggtgatgtgggttttcatactggtatcaagcttagagaggtagatgatcagccacccggtagttgcgacgaagcatcgatgcttgaattttatcggtacgagtcccactatcgaaaggatgagcccaatccattcacctgttgtggtaggctttctgatcagctcgctgcgaatgctttctcatgtatagagacatctcgactcacataccatgccctcaaccagaaaaaacttcgctctgagacacatcaaggtatatctgatgctgttgttaggggagacagtgatggaaaggatgttggcaccaaggtaattctgccatcaagtttcataggaggaaggcgatacatggttcaaaactaccatgattcaatggcaatctgccgttcttacggtcctcctcaaatattctcaactttcacctgcaattctaaatggccagagattattgaagctattcgttttgaggcagggcaaaaaccaagtgatagaagtgatatggtcacacatgtttaccatatgaagctagatgagtacatcacatctattaagaatggagaagccttcggtcccataaaagctggtgtgttacttgtcttattcatgatagctgtcctatctttacgtacatctccttcctaacacatctattgcttcccctaacacattatttgttcttttcttgttgctttgcttttcaattgtgtacactgttgagttccaaaaaagaggattgccgcattcccacacattaacatggctcacagctcaatctgaagaaccttcacctgcattcattgacaacctgatctgtgctgagataccagatataacagctgataggtttgggtttggtcttgttgatgaattcatgatacatggcccatgtggtgagcacaatccaagcagcccttgcatgaaggatggtcggtgttcaaagggctatccaaaatagttctgtgatgttactaccatagatgatgatggaatcctatttatcggacgacgcaataatggtcgctatgtggtgaagaatggtgtttcactagataaccggtgggttgttccttataatccagctcttctgaagaaattcc

SEQ ID NO: 76105 - DNA, 13708 bp, Oryza sativa
cccttatgctagcctcactagatgcagcccacacaagtactctacccagccatgatgcttctatggcatcttctcagcatggctcatcaccagctgatgcaattgaaccgcacacgataattggctcttctctccaatctatgacaccttctacaccattggtgcttccagatccaaaggtataatctaatagcttcattctgcagcaatgtgtactctcttgcatataaacaattgtaaattcttatattaatattgcttatgcataggccacaactgatagccgtgatgatcatcatgggacaacaccgcctacttcagaggctagcactatattctgtacttagagcaaatatgtatgtctgtcccttatcaaacctaactgaccactaatgctttatcagctcctggctatggcacaactagacaaaaaacgtaaatcttctgcaattgatgaggatcttgctcaggaagggtaagtgacaatgcacagtttcatatttacgttccttgtttttttttctttgagttttctcatggctcaaacaaattgcatctgtagttcatctcctcgtgaacatgattgtcagaaagcatcagttgtgcgtgcgctgttcgtagacaaactgcccccacagcccccaaaatgtaagtaaacgttgttagccaactatatattacctgtgtgctcatttgttacagaaaaactgactctacattacattttgccctttaggacttgagggctccatataatatcaccccaccaaagcggtcttttgcacctggcatgccaaggcgtatactcctgtccctgatcaagcaagactaatgctcacatattttgcccaatgtattttgcagtgggaatataaataggggatgtgttcttttgtgcaagccattagaccaaatgacattacttctacgtcttacaggcttgcgagccctagtggctagcagaacgataaatgaattcgtataaatagtatgtggtgtctgtacgatatgcacgttctaatcaaatatcgccagaacttatactcttataattggtgctatatctattcgctgcacactgtttcccaaagtcttcttatgtttgtgccggaaaaacacaatttcctactgtttcttatatatgcagcggctatagtcaaccatgtgttaccaaatacttacgatccgtgcatcgattagcttattcttgaaaaagcatacttgcatattcctgaaaccataggcacactctatttttctcccttttatgtccaaagcatgtggtcaggcactattctatttttcagcaattcttttcatcaaaacaagcacccatgccatttgagagcagcagaccatttacatgcacatattaattgatcacgctgttatagtattcaagaatttccagataccgacaaacatagctaaccaccatacatagaaattatagggctttactacttacactaccattccatcacagattacatatgtctgactatatactatagacaaatacataaccaccatatatcatgcctacatgctgttccatgcatacacacccagctatacacaactgctgctatataacagacgcttattacaatcaactgcaggatccctactgataaaatactggacataatatcagtcacaacatctgttgttttcgctcagcttagttcccaaaaacaatccatgcaggtctccttaggcttagatatatctagcagcaacactggtaagattagccaacccttcgtccacaaaagattcagcatattcaccaagacggtgcacatcgtagaatactccaacctcacgatgactaagatcatcagcatcaggacctcctagaacaaaagaacatatgtcatcacatatttggttgacagaaccccaatgaatctaaagctctatcccagccgatttccagcaaccgtgccttctttgcaagagtattgcatttcttcctagctctcccaagagctctcttcagtcgctctgtctcaacatgatagcgattcatgtcaaaccagtttgtatcatcgaactccacactacattctttcttgataacagaaattaaagcatgtgcagcgctttcttccgcatcacatggtcttatagctgaaataccctgtgcacgaacaacaaaaggctctccaactcctcttgcaccataaacagttgcctcagcaaacccaacatagccatctgctacagcacggcaactgtatcgtgcctcatttgcgcctatgcctctcaaaacctcagatagcaacgttttggacctgatctgcacgagccgacgctgctctgttaaaccataacaaaaacaacatcactaaccataccgacatcataaaaccatcccctttcttcccctattcctaaaacttcctataatcatccatttatatataaatcatccaaatcaccatatgctgctataaagatccagatcaacacgggtcaactgaaaaataatcacacatctaaaaaaacaagcccctcgtacacagctccttcagaccaaacaagatgcaagagaccgaacaaaactaacaccacaaatttataagagtatatctaggtccccaagattaatcggagcatatacaaatacattaatacacataccttgtgcaggttcctccgtaccaactggatagtccctcttatagcaacaagatctaacaaagcagtagcagcgccgccgcaaccactcagtataaagaagcagccagttataccacatatataccagcctcagcaaagcagatgcaatcccaccatgacacgttgccctgggacaaccgagcttaactcaaaaaggccgtgcatcataaatcccaaaaccagcccactaattatgggactgtacatctttaaaagcccaaggtcaaacataaaaggaaaaggccataactcctttatggcatagcacgatcaacccataataacagcttgacatacctccactaccaaaaatacgctttccatatactgcaccggtacgtatcagataaaacccatctcttagcagccgcgcagcgcgctacgcgtaaccgctctagtatatataatcctagtcggagacggagtacgcttcctccccttttcctctccccgcagtaggggtggaaacgagccaagccgagccaagctcggctcggctcgtgaaagcttgctcaactacaggctcggcttggctcggcttgattaattgaacgagcaaaagatgcagctcggctcggctcgtttcaaagctcgagccagctcgagccagcttgtgatgtcatgatggacggcgtcgagtcagggacgccggcgacgcagggggcgtcgagctcggctcgagcggcactggggacggtggacggaggccggaggtggtgcagggaagggaggcggcgccgcggcgggccgacggcacagggggcgtcgccgtggagggaggacggagccgacgcagccacactaggggaggtaggcggcgcagggagtgaggcggcgagcccacggcgcagccgcgcaggaaagggaggtggcgggccgacggcggcggcacagagagggcttcgaacggcgctgccggcctgccgctggcggtctggcgctggggaggggatggatgcggcggccggcaactcctcttgccagtcgccgccagcgccagttgaggaacggaggaaccgaggaaggggagggatcggatctgctcgcactcggctcagctcaggagtcaggacttagggtttctctctttcatgggccagacaattgttaatgggcttgggctcgctcagggaactcagttttccataggcttgacaagcctaccgagcagcttgcgagctagctcgggctcggctcggtttggaaacgagctgtggagggagctcgggcttggctcgtttagtcttcgagccgagccgagcttcgcgagctcaagccaagcccgagccgagctcgcgagcccgagctttttgtccacccctaccccgcagccgccatcgcatctgaagtataattgacgccataggtagcaaagctccaccctctctttgatcgatcgatatcgataggcagcagaaggggagaaaaggaaaccgatctcggtcatggccacgcccaccactttggtcgccgcctccagccatcgccgtcgtcgccggcgtggatccacaccggcacaggcacaggcacaggcaccggcaccggagggggtgccggggtggatccttctgaacagcggtgcccacatcggcagccgctccaacgccaccaccgccgtcggtgaggcgagggacaagctgacgatagaggtgtccttgtggccggcgcagccgccgcacccctccgacgtgttcgtgtgttgcccgggcgtccgccacccccgcgaatccgagatcctcttcacggcccaagatctgctgctgctgcgtgtcccggtcgccgccggggctgcgccgagcctcatcagcttcacggagtgcgattacctcatctaccgtgccgccgccggcgaccgtcgtccgtcgctcacgctgctcccgaatccaaagcccaactacttccacgacggggatgtcggcatccttccccgaggcgggggcgagtacacggtcgcggccctggttgctagacgacgccgggggcaggtggaccaccaagacggtgtggatggacgacccgcggaggcctccccctgtggagatccccatcaacgcaaggcggctcaaccaccacatcaccaccaccaccatcacgctcggcggcgagctggccggtgccatgggctgggtcgatctctggaccggcatcctaatctacgatctcctccatgacgacaaggaccaagaccggccaacgctccggcacatgccgctgccgctgccgatgcacgccatcaccggcaaccacgggatgggcgacaagctagccttaggctgcccacgctctctccgtggcattgcctctgtcacgaggcgcggcaaggcctgcctcaagctcgccggcgtgcatgtcaccggagagcgcctcccctacaacgacgctgaaacccagctgccggcgttcgccgtcgacgactggactgtcacgacatggagcaatgacaagatgaagggctactttgaggactggcaggaggatttcacgattcgcggttccgaggtcaggattagcaacgccatgcgctcggatctgctgagatctgggttgctgtaccgtaaaccgtcacgaggggatggcgatgaggctacggtggaggagctggctttgcacaatctctgggtgtctcatcccacccccagcctagatggtgaagaagatgtcatctacctgctggccaagccaaagtgcttccaccccaaggcgtgggttcttgctctcgacacgaggagcagcacgctgctaggcgtggttgagtttggcactgaaaccgcaccatctgcaggtgtcacgtatcgccccagtactatatccaagtacatgagtctggtgacttctccaggtaattgccatcatgttatagcagcacatgcctcgttccctcctcgcaacaagtgacatttctctacgggcaaaactgactagcgagatatcttagagaaaaccagtctttcagtgacctgtctgtggacaaagactttccttttgtcttagtagctactagctggttgagtacatttcgagattaggtgatgatcaaccaattgaaaaaaattacattggtatcatgcactctggttacatgctcttagttcagttatcttctgttctttggttcttaacctgccatatgtagactcatatgcatgtatttttctatgtaaggaaataaattggcattgcttacaaacattctagtcaatgtgtgggtaaatgaggaagatatatcatatgcacatccaaccacacatccatgcatgagaccgagatatgctccctatgtacctaaatcatatactagattcgttctgcttgaaccagtttagttgccttgctatatttataatagaaaaaattactcatttgatgcagtgatgctagaatcagtttagttgccttgttgtatattaatagaaaaattactcatttgatgcagtgactgggagaacttaaaggatgctgctgctaatcactgaatcaagatggtactgctggcctgtttggaggcgatgcatcgaagattaagactgaatgatgttgttacacatatactccctccgtttcataatacaagactttctagcattgctcatatttatatatatgttaataaatctagacacatatttgtatagatttactaacatctatatgaatatggacaatactaaaaagacttgcattataaaacggaggaagtatatgtttacaggggtcttggcaattttgcattcgggtgcaagaaacgtgtttgtttccctgcgctggtggttaggagtatttatgtaaatttctctagttggaacaaacagccagtagcttgtcgatctgttactaacttacgatgaagcatcatcattatcatctcataaaaacttgtaatgggattttatattcgtgactatcacgcactttgatttcggtgagaagagaaatccagaaaattgccatcaactcatctctgctattgttcttgctctgctcggttgatcttgccggttttactacagcgtgcgtagacacaggggtactaaggctgtgtttagatccagggatgaaaagttttggcgtgttatattagatatatggacactaatactaatttgaagtattacacgtatactaaggaaggccgtgtttagttattttggcaaaaaaaatttaacgtatatagacatacatttgaaatattaaatgtagactaataacaaaacaaattacagattccgcctataaattgcgagacgaatctattaaacctaattactccatgtagcaccacattgacaaatcatggcgtaattaggctcaaaagattcgtctcggaatttattacatgcaaactgcgtaattgattttttttgtccatatttaatgctccatgcatgtgtttaaacatttgatgtgactgaaaagttaaaagttcgaagggaacaaacgtagccatactcgtcttcgaacacttttccaagtcctgaaatgcgatcattgatttgatgcagttgctgaatctgctgaggtgggatttccatttcaaatctatcatgtatttatgggcgtgcatctacgcttcagccacattttaatcctgtctatcaagctccgtttcttcctttaactaaaaagaaagaacttttttttaacccaaacaacattcttgaaggcctgtgggttaggcgtgagcgtgaaacctgtcaaggcttcgcaactgtcatattggtgatgccgtaggaatgtaaggccttacagctttggggagataatgtttataatcctccaaggaggcatatatatttctcttatgcagttttgatcaatgcacttactttggaacctcaaccatatgctaagcatggaatctaataagaatataggaataattcctcatgttgccaccggataagatataatgagcagtgtttcatatgataagatataatgatctccaaatcaaccgagcagcaacaaaatctactaacagagcagtgtatcctatgataggattatcagtagctatacatgcatttgaacaagcaagcgctgagacatagtggagcgcaagctaggaacaaaagtcagaagtcagaacccatcggtcaccgaagaagtactggtctgcatgccctctgcaatcaataattgttcattacttttgttcctaaaaaaaacatagtgggataatggaatttaacatcccagcctttacaagctacagccaattattacattatatcaatccagaaaagaacgtagttcagctaaataggacaccaaacaaaaaacagaggaaactaagccaaaataaggagaacacatttattttaatctatttgtaaacctccatccataattggcaaataattgcataaccatcgacttcaacttgcggcatgcaacccttagaaactccccatcatcctcaccccttggtagctgtgcccaaaaccggagccagtgcgttgccctgaaaattacctgcatatatgaaatagatgatgatttattaaaaaccaaatcatttctactcagtgaagatcaacaaacggatgaagaaaccatcgtgccatttcagttttagtccccccttcctcaggttagtaccagcggctaatgctgacacctcgatcttgtagagtagtagtttacatctgccattctatccagtgacgatgcacgcgagcctaaaatgctcaagcataagaagattgccggccaaaaaataaaaacaaaaatctgatacaaaacctcaggctctgcttaggcggtcagctgcattgacacaaaacgtttccatcagataacatgaaaaaacgaaacctaaatgaaacggcagtaaatgaagatttggttagcatgcacgaaacttgagataaacattacaagtagcaacctctatccccccaccctctcaaagcgaagcaattattgtaatattaaaaaatatttagatgtgtaaaagcatgttcattcgggtaaacaggtactccctccgtccaaaaaaaaactcaatcctgggtttggacctggacgcatgtgtgtccaggttcaaaacccaggattgggttttttttgggacggagagagtatgtcgcaagtggatggacaggtagccaatatcatcctccagtatcccaataaacttcagttatggttcctccattgctgaaaatagataaagagaatatctactactccctccgtttcacaatgtaagactttttagcattgcccacatatatatagatgttaatgaatctaaacacatacatatgtctagattcattaacatctaaatgaatgtgggcaatgctagaaagtcttacattgtaaaacggaggaagtagctaccatgtgcgatgcttgttcataacagaattaaatagaaataagatggttaactttagctatggttcttcacatcatacagattaagacgctggatttaatttgtaatgtcgaatggtcaattagattaatatgaaaatatatagggaaatgtcactactttgtattatgacacccatgtgagcatgaattttgttttagaaaactgtcaattaaaaatgaaaccaccacttcattacacattcagtaaaacttactcagaatcctcaaacattgtccaggttgtagaaaacctaaaaacaagagagaatagctgttaaaagtacaaaacgacatgctttttgaaaaaaaaaagtggcaaataaatcttacgggccatcgatatcacaatttctcactataaacaaaatcaattgtggcacaaattttgaaaggtattccccaatcatcaaagcagtagtaactatgtccaggacagtcccttggtccttcagagaacaaaaaaaaagttagcagactatttgatgagggtattgaaaatttccagaatgaacaaagtgttttcaggaagagacaaggttaaagcgaggctggatcattaggtcagtaaagtaataggacgattacaaagacaaagaaatttggtcaagaaaaaagctcaagaaaaggtgaattgaaaagcataatatagggataaatggtcatccctaactctgcgactctttaagagaactacaactctccttcaaagtcaccactagacccctcatctccagcacacaagccacattcttctctagactatgaatgcagggatgatagttcatttgtgtcaccctggcacatcatctgctatccagcctatcgctgactcccagattttgcatcctactgagccagatgcttttcatcaaggagcaattaaaattgggctgctgcacatttatttataaggaggtatagttgcgtcttcgattaacaccccccctccccaccggaaaacaagcataggtggaaaggttggtgacttggatgaagtaaaaaaagaaagagagaaaacagaaacatgtatttacctttgtgtacctatgggcatgctcaataaagtttctcagatatttcagcagaaaccagtagcctaactcataaacatccacaaagaaatgccaatagacatttgaaaatggtatgccaaagtgtctcacacctctccattctatcagaagagtttccgagacttgtaatggctcatacacagtgtcttgcggtttgcgcagtgaatcacaatctctgtacagatggcatatcaaagtagaaagagctgctggagacatgaaagctggatgacagcccaaaaacctttgaaacttctccagcttctcacgctcatgaacttcagggacttccatacaattatgctgaaattgtagaaagtaacaggggagaactttcttcttttcaccagaagctgaatcgatctcttcatgctcgtaatatgggaaaataatctcaaagaagtttctgaagtcagcttgcatcccttccttggaggttgtatcatttggcacttctgtgataacaaaatctttgatatcattcctcactttcatatgctctgccttccatttcccattccagcacaggcccttcttatgcagcattagcaatcaaatgagaatttcctttgcatttcctactgagttcaaggtccaatacaattctaacaagcctggacaggtattcctcagaaacaaaaccgttgatatctggcttgatcttcgtggtccgagtgaggatgatatagttaacaatcgccaagagagaggaggagccattcttatcatggcatataatttgttttatgtgcccaccataactgatctcctctaccttgtagacagacatacctgaaagatggactggtatacatggcaacaaaatttacattatgtaatgtaaatgcaacaatcttgacaaggcatatgacatagcaatccaacgaaattgaaatctaacagctaaatttggaacatctggaaaaggaaatcctcaatagtagaaaagaaggcgaaagggacgaatacacaggagtgcgcacacgaaacctgttcgccttctcccaacgggcaccaaccagcacaggcagggtgtacggcggcgcgcgcacccacttccccgcctgtctctcccagcagctcaccgccgatctctccgacggcagcgcgcgcgcaccccacttccgccctgcctttcctgcggcgcagcagctcgcgtccccgctccctccgacggcggcgggctcggccgctgcacggaggagaaagtgcggcgggtggggtttagcggtggcttagatctttcgcggccggggggggggggggggggggtggacaagcttaccgcgacttgagtttggtggcgacgccgaccagatcagccggcaggaacgggtccgacaagcaacattagcggccgcggtggcggcgatggcggcggtggcgtggcggcgatggcggcgacggcggagcgcgtgacgagggttttgcggaggaggagggttttggtggagtcttcgacagcaagcgaaagtttatggccggtctgatccgatccgatccgctccccgtatccaccgccccaacatgctacctccccaaccctccttgatctctccgagtaatttgttttttcgattttgctatatcttacctgaaagattttttcttatctctcactcgatgttctcacttaaatttacagtgcattttcttgtaagttacagtgtaatttatgaaatttacgctgtaacttttgtaggttacactgtaatttgtgaatcttcgcatgtaaattttaaaatttgtattggatttgatctttttcttgaggatatggtaatttagtgtccattatggtgtttcttaattgctttttgctttttattatatctatcggattttaattaaagattaaaaatttgtgtgatatgataataaaaatctttcgaaagatgtataggtactcccttgttttttttattctctctcttataacattgtaggactacaaacgacacacttataacacatgcataaattatctctgcgaacacatatagtccctccgtccaaaaagaacatattcctagcatcccaaggttgttttagttgagatagagaaatactaaaatgcccttggacattgaaaaaaaatagtaggtgtgataggtaggtaaagggtattgaaggaataaaacctttcgttttacgtgctgagtgtagataggatggtagaagttggtttttatgggacaaaattcaaactctagaagttgagttttttgggacagatatattggatcagggcctgtttagtttatgaaaagaaaatttttgggtgtcacattggatgtttgaccggatatcggaagggttttcggacacgaataaaaaaataattttataactcgcctggaaaccgcgagacaaatcttttgagtctaattagtccgtcattagcacatgtgggttactatagcacttatgactaatcatgcactaattagactccaaagattcatctcgcgattccctcctaactgtacaattagttttttcatttatctacatttaatactttatacatgtgtccaaagatttgatgtgatgttttctggaaaaaaaatttggggaactaaacggggcctcagtatatcttaatataattattattcgtgtatagctattgatgggtatattgtcaaaaataattagccatataaatacaaacactcatattaagtagtactctaactcggtgggttggttctactataagtatctaaacagttaagttaagctcaccttattctctcttttcacactacccaaattattatgcatcaaattttaccactctctcttcaatcttttttttaaaaaaaactatacacacaatttaacccggttttaaattttttatgtcgtccaaacaagaaataaatagaaaaactgcgaaggggaggggatcctgagctgcattgaagatgaacagcggtacagattacacgactaaaaatgtataaaaattacatactccatccgtttcaggttataagatattttgactttggtcaaagttaaactactttaagtttgactaattttatagaaaaaaatatattataaaaatatattcaattatagattttatgaaattatgctagtattgtaaatattactacttaaaaatatcacgaaaaattttataaacaattagacatttacttctaatagtattacacatatatgcaaaatctcgtattcaaattcactatattttagctgtaacaaaaagatgaaaaatttgacaattttaagagtaaaaatctgttaatattttgtctttttgttactgctcgcgtgagtttgctgcttcgtgagttctacgcatccttgggcaaagctggcatgcatcttattagatatctaatacagttcgtttcaaaaaaaaaaaaattctactacagtatgtagttgaaaggctactacattgggccattcctcatattaactgttgcctcaatgattctcatttatactccctccattttttaatagatgacgccgttgactttttctcacatatttgaccattcgtcttattcaaaaaatttacg

SEQ ID NO: 76106 - DNA, 6652 bp, Oryza sativa
ttcctgcagccctattatgtgagaaaaaaataaaacgatgctagccgcacaattgcgcagccataagatctggtaatacaaaagtaatattattaataaatttgctatgaaaaatagactttatatagccatattttctgttttgtcatcaatatatgattagaaaagagtaacaaaaaaatgtgtggtttggagctaaacacttgagcagttaaaacagaagagaggaagtactatccacttgcttcacaacagtacaacacaacacaacaactgccaccaacaaaatttcagttgctgagctattaaaaacaacactaaatttttgcctcccaatgaacaactacaccagcatcttggttgcccttttgtttatgccatcttgagccttgtgccctcgaggccttgacttccttcccctacccccacccccaacatctccctgaatttagctgctttcgcggcacagatcagtgcgcaagccataaagatcgagccttagcttcgagctggaatttatcggcggatcggctggcattttttcagtttgtgcgcgcgcctcaagctcaagaaccgggagagagatgagctgcttcccgtgctcggggtcgtcggggaagggcggggttgacgccaagagcgtggcggcgctctcgccgggtccgcggcccgcggcgagcgcggcaccaggtgaatcccgcatcttagcccccctccgatttctcttcgcagggtgtggaaagattcgatttcttctggtgaatccgcttgctggcgttgccccggtcagctgtatgattctgtatcggtttcgctggttgcgaatttgcagcgagtggctcagtgcggtagctgcgcattggtgtgatccatattggctcgaattctctcttcgtttgggtttaaagggtaacagtgagaaaaaagaagtcaattttgcatagcgttgattgtttattatgctttcttgcaaactggcgctttggtcatttgattgtggtaaataattcaaggctttaggtttgtaaatgttagtctggttgcttgttgagatagtggggttgaaggggacgcaaagctactttcttggaaagaaaatgtaattgattgttctcgtgagaagtggagtgaaagggagaggaaaataaaatctgaactgaagcttgcagctataataataatattattgcaactttcagtctcaggcgaccaggcagtaatgtttgatgtgttgtttactcttgttgtctctaactgattccttcgcgtgggtaattgcttgcttcgaccttgcttgaattacagtccaccctttgcatagttgttgtagtctgaagcgagtacagtaatttagttgcgtgttgctgcgcatgcaagtattatcattctctcatgagatcattgaattgaggaataatatgttaaaatttgcatgttggatgggtcaagatcgatcaaactcatcacgtggttcaggcattaagaaggacgattctgtccgaagaggaggaagctctgcgaatgatggtccagccaaaattttcactttccgagaattggctgttgccaccaagaatttcagaaaagactgcctgctgggtgaaggtggctttggtcgtgtctataaaggacagatggagaatggacaggtttgctattcctaacattggctgctgtgtgctcttgttcattagctgcaatttagagcatgatttttctgagtgtccgacaccttttcttttgcatatatcatctagcaggttattgccgtgaagcaacttgacagaaatggcctacaaggaaaccgagaatttctcgtggaggttctcatgctaagtctcttgcaccatcctaatctggtcagattaattggctactgcgcagatggtgaccagcggctcctagtttatgagtatatgctattggggtcactagaaaaccatcttcatggtaagcttctcagttctcactacgtgattttactgtttcagttcaaagtttgcacattatcaataacacttagttgattgagcttcacataacatacagaagaagaattgtgaatttcgtgacataatgggaaacattaatgtttaagttcagagacactaaaacacacctcctgaaatgtcaatgcacattaaattgatagtgatcaagttatgtccttatggttcctatcacaagatttgtgtttgtgctttagtctcaacctgctaagttgattcctgacctatttgatttgaaagagaacttgccagctacccttcactgtcttactgtagtttgctactgacaacatttaattttctttagacattgctatctatcattttataactcatggggcactttcttaatagatcgcccaccaggcaagaaacctcttgactggaatgcaaggatgaagattgctgttggtgcagcgaagggtttggagtacctgcatgataaggcaaatccaccagtcatatatagagatttcaaatcatcaaatattcttctgggcgaagactattacccaaagctatctgattttgggcttgcaaaacttggtccagttggtgacaaaactcacgtatcaacaagagttatgggaacatatggctattgtgctccagaatatgccatgacaggacagttgacagtaaaatctgatgtttacagctttggcgttgtcttccttgaactcattacaggacgtaaagccattgatcacacccaacctgcaggggagcaaaatcttgttgcatgggtaggttcatccttttatttttaagaatgtgtgggctcaactgtactaaattatctcccttcctttgggtgtagaggggatgttctgtttcaatttcatcatgatgtgaagtgtcttatccttataatttgcaggctcgtccactgtttagagaccgaaggaagttctgccaaatggccgatccatcgctgcaaggttgttatcccaaaaggggtttgtaccaggctttagctgttgcatctatgtgcttgcaggagaatgcaacatctcgacccctcattgcggatattgtcactgcactttcttatctagcttcaaatcattacgatcctaatgcaccttctgcaaagagttcgaggacttgcccatccaccccaaaggcaaaagcacatcgacgaacaaccagtgttcctgatgcccaacatgctgccgattcacttaactggaacttcccagacttggggaggaaggaaactactagaggggaattcgagcaggatcacagtgaaggttatggcagtggcagtagctctggaaggaatgatggtctagatgttccagaactgctggccttgcataatggacaaaataacagtgaagctgatatatatcacaagtccagtgtcaagcttgatgcccatgagaaacagagatcagggtcaggcaaaggcagcaggcagtttcgatgcacatacaaacagacattgttgcaattcttttcccgattgctgccaattttgccagacatcttctctgcttctgttgagggtaggatactctttgttggtacagttgcgcgctgttatggtccaggtgctgtatgactgtacccatggttgtattttagttgtttccaaaggtatacatgaagatcatgatctggttgaagcaagaaaccatcttgtcgcagataaggagcatgcattttgatcggtgtcaattgcattctacctgtaaagatttttattctctttgtaataggtcacagtttgtgccatacctatcattcaggaattaggatgttttatacatacagaaaacaattcttaccagaatgcgtgtacagacctacatgctacagtggattgtttgtgttttttttacatgtaacacaattattttgcggacaatgacatactgtatagaccatagagtgtatgatcatataatgtgaaagactcctgttgttagaaatttacctttgtgcctgaatgtcatattaatttgtagtgattaatgttgtggtttttactggagtggagtggaatgggagaactttgcagtgacacaacaaggagaactgggttttggcagagtttgaggatgccaggagctgaagattcagaaggttcagccttcttcagagttccagcaatccaagcacaaaggccccaaattctttcgatatattgatagctataattttatttatttgttatgagcagccgaatctccaatgcagcatagaaaaggaggtctgagttccgtagaatatcacggaagttagtttttggttggtaagctcgacatcaaataaggaatgaatctgaaactccataactccacatgccaatgtacaccagagacagaacagcgattaatttggtgctcatgttcagtttcagatggtttacaaaatagtataagtaagtctaccatctcaaaaaaaaaaaaggagctaagtcttcaggtgccatgcaaagcctgacagaactcttgttcagtcttcggcatttctgttgccatttgagctttgccagagctctctctttgtccttcccaaagcaactgttttttccttccttccttccttccttcctttctttctttctttctttctttctttttggacagtcttcggttccttcaagaagacttcaataagctgctgaaatcctgagcggatgaacaggttattaaagaaccatgtagcaaaggaagatatatgtggccggctgattgtacaacttagaaccttccaagtaacttgtaagtagataattcaagacttgcaaagctagatcatgcaaacattagccgcttctgtgagtgcaagcatacatgaactatttgtccaaaggttctaagttatgctccaagagccatcgtcccagcattcagccaccttaaatcaggaccctcacatgttgagaaaatatttgccaacacaagatttaaaggtacttttcctacccagatatccttccagaagctgctatccatgtggaaatatgcttgttggaatttggaacatatattctcactgtttttttgtcaaccaaactgttatggcatcttgtttatctatcattttagacaacagtgatatactcaagcaactccgatgacaacagtgataaaaggaaggacaaattggaatttcatgatatttgatgtcggtcaaaggcactctgtgctgcctgtagtgagtacaaacagccaggacatttcccctgtgtttgattttgaaggacaagtgaagaatcaagataccctattggcatggctcaagaaggagagtcttctcttagcagcctttgatctataacaccacacttcaaacgcctccgtcaagtctggatacttagcatgcttcgactgaagccaatctgacaaaatgtcagcttgactgttcgacggtagcgttagcacaattgaaacaatagctgattccaggctctgccagacctcactgtctaggttgatcttaggtgcttcagcatcaccgtcatcgtcatcgtgttcgggatgtccgaccaaaggctttgttctccttgcaaagccaatccaaacattgacagcatcacaacgtttctcggttgggagaacaatgttgccaaatgcaatcgcctccaggacctttgcagacacctcaatcaccttcaatctagtcttcaggcagctgattcccccacaagctttgtcgacagcttcaacgacatcggatgaaaccccaatccagtaaacaacaacacatttcatcatctccagcttgctcaagatctgacagacccaggagatatctgaaacaagagaatgcagctcctgctgaacctcggcgtcgccgtggcctaaaggcgcctctccctgttccatcaggattgaactcgtgaacccactgaacctgctcagcaaagctgcaacacaatccttcacttgagacctgacaatgtcatcatcgaaggctaacaatggcgcgtcgtcgtcttcggtgagcatgtactccagctgctcctgagccgcggacttgagctcctgcggcggcgagcgcgtcgacgtcgcgtgccggaacgccgagaggaggatgccggccaccggcgcgggatcgatcgggcggagccgcgcgaggacgcactcgtactgggggccgaggcaagggatggtcctgaggatctcctcctcgtcggcctcgtcccacggcgcggactccaggtagtcgacgcaggcggcggcgacgcgcgggcaggcgaggtgggcggcggcctggaggacgccgagcgcgccgcggacgccgaagcgggagcacggctcggcggcgtagaggaggcggagcgcggtgacgtgggggctgaggtccagctcctggcagtggacctcgacgcagtagcgggagccgaggatctggcacgtgggccagtcgtcggagaggcggtcggcgaagtacctgctcccggcggcgagcacgccggagtggcagtagagccactcgtcgcggccctccggcgtccgcagccgcaccaccacgtcgctggtcgcgaggtcccgatcttgggccgccccgctgccctcctcacgccactcatctgcgaagctcgggcccgcccgcccgccgcgtgggttcgccggagctccggcgacggctcaggtgaggtggagattggggaaatgatagtgaaa

SEQ ID NO: 76107 - DNA, 895 bp, Oryza sativa
ttctaaaaagaagagatatggaggaggaagagataaggccagggaggagatagaatatattaactgctcctcctcctcctcgatttggcctcgtactctccgccgcccatgttgcgcatgctgatcttttattccggttggtgttaccaatcgggactataatctttagtcccgattggtaacaccaaccgggactaaagataatagagatcttttgttccggttggtgttaccaaccgggactagaaatagatattttgttccggttggtaatactaaccgggactaaagataaaaaaactactctaaccttttgaactgggattaaagatatctttattgcaaccgggactattgtgtattttggccgaccatctttaccaaccgacagaagatggtttctccaccagtgcaagtaaagtcaaggtagagacaatgcaatttacttgagaagaaaaaacagtgaaatatgcagtgaaacagaaaatataataattaaccttaccaagaacatgctgaggttgttcttacctaagcttctttattggccagatcaatgttctcgatgcctccaaatcctatacatattttgtgtgctttatttttcattctgaatgtgtacatttcaagcttggatcaggggaaggccggagaaatcaaatatgccctaaagcttaaaaagacatatgtcagatttacaagctagtagtgttggttgatatttatctctttccaacagaaacaaagtattaagtcttttttacggttctttataaacaatttaaagtgtcgtctgataaataaaagagatgaatgtgctgatatataattcaagatggaaaactccaattcagtcgcacacttcatgccccgtttggcacagctccagctctca

SEQ ID NO: 76108 - DNA, 694 bp, Oryza sativa
cttgcaattgatgtgttaataaggtacagctaagtgctagactacccaaagataaccaaccaaccaccttcccaaatctcaaaaccaacgtcaacaaaaaaaaagatactttgaactttgaaggacaaataagggtttttattaagctggtgttcaagtcgtatgttgtgtgaacagcactgaatacgatggcactgctattcagcaatatgctaattatataaaaaatattatctgtcctatatcatggttttgtcattttcattcataataagcagagatatattggcacatcatgaattgtctaaaaagtagatattgacataatgactcaagcgaacaggaatcatttaccagtcaattcaataataaaacccacccagcatcatcttcatctgaattctacgcaacaattaggagatttaggcgacttggacactcagctatgcaagtgcatgctgctgcagaaaaccagaattccgtgtatttggagatatcctgagtaataaaagaagcagtcaatcaattttgacagataaaattcaaagaaagaaaacaagatatataaatatcatatcacttcaattatagacgaagagcagctattaaaactataacaagatttttcgtcccaaaccaaggcataacaattttccatttacgaccaaggaaacaagatcagttacaaccagcg

SEQ ID NO: 76109 - DNA, 6360 bp, Oryza sativa
  unsure (1)..(6360): unsure at all n locations
cgcggagcccgcgccccacgtgacggccctcgtctgacagcgccgccgcgggttccctgtccccccgcacctcgctcgatcgactcatcgccattgctctctcccgccggcgatcgagaccgcccaccacagcttttcatgcgtgggcgcgcccccacaatattcgttagtccatgtcgcgccgaccgcctgttgccggccggtgataacgcggaatattatgtatccggcccgttcaaacgggatgatatcttagaaatatcgggtattaggtgatacctactaccatcctgtctaaacgagatatcagccgatacctagtaagtatcagggcaggtgatctctctgagagttatcatctcgcctaaacgggataccgttatatagacatttcaaaagtttattacttttttataggagagaactacaaatcgtgcgtccaattcccaccaaaagttttttttgctatcaaatgttttagttaaccactaggtgaagcattaatttatacatggtgaaagaaaagcaattgaaacatttaaaaaaattgtgaaatacagtgaaaatacaagttgaaacaatgttgctgtcacttatgaaacaataagttctaacactctgaaatatatatatatcggaatataattacgggatatcttgttgtaaagatttaattataacaaatacaacattgtgatcggatcatatattggataaataatttaggagaaaatttattttgaagattgctatatgcatgcatggatgaagtggagagagagagagcaagtagtatgttcgaagagagagtaggggtagataattgcgtaaattttatgaaacttaatgaaaacatatgctacaacatttcgctatcacacatgtaacattaaatttttacaactgaaacatatatttttctttcatcaaaatataatcatataacatctcacttctcactgtaaagatctaattaaactaatataacggtgtgattggttcataaattggattaataatttaagacaaaataatttaaagcttaacaatgagataattaatatacatgggagaaagagaaaaaaaagtacaatatagtactgaagtacaaggcaacacatgcatacgcaagagtagcggagggagtaaagggcgtttgatttttattttgctggatcggtcacccgacctagatcattctctctttattcacgtttagctaactaagtgttagaggaatcataataattcactaaattcgaaataaaattaattatgtgttgtaattgttgtaatgtgttttttctataaacttagttaaaatcaaataattgatctaaaacaaactcaaaacaccttacaatatggaatatggaagtgcagagagtaaggccctggttgtttcagactaatattattgtaatctagattattaaatcagattactgtaagctggattgtaataagttaatatagaataagttgcgtgttgtttatttctctggattattggatgtatctaagggtagtgggtatttagctactcaataatctggaaaaaaagctcctctagagaagattattagattatactaatctggcttatagattataataatctacttgtttgttttagcttacttctaataatctaaattataataattctaagctgaatcagggcattaaatatacactctacatgagtttgcatctggccggtgcgacatggctaacgacgccactacgatcatcctcgtccatgagcgcctggttccacccgtttttgtatattctctgttgtcctacctacaggaattgatgcatagatttccctttttcccatctaagttcaaaggttgcaggatataaagatcttgattcctgatcatttatccaccaattacgaggagttggcattctcatatgtaattataatacaatcgtaatgtaattacatgtaacttgcatgtatctacaatgttacttccaaaaatccctccgtaacatcctattttcgtgaaaacggagatcgtgagaacgaatcctctcacatgtgcgcaccctatgactttttccttcctcacttgcacaaatcttgaagtaaatctaacggttcaaaattatgtgaaagttacatgcaagttacaataattacattgcgattgtaatataattacatctatcaaatttttaggagaaaatttctcgacaaatatatagcaaaattgttctgaattattgtgcttttgaaagatcctcttgattattattggactcgttttatttcatgtgagatctttccgcaccaatttttatgcgacttcaatagtaggtttaatttacaaaaccgaataaactggttccatggttcttagttgcatctattttcacatgaaaaaaattaaatgcatttaataagaatatgttatcggaaagataattaataaattaaactaggcataactaagatgttgaactcaatggagaataacagaatagccggttccttaaagttgctgatgtagtaaagctaacgtacaaatgttgtcttccattggcaaaagtagattgatgccatgaaagcttggtgtagcaccgaatctgcaggacaagctagcgttactgtcaaatagaagaaacgcaaagttaccaagttacctactatcttccgttcatccgtgggagaagtatacatgacaacttcatatatgtaaggaacatggtcaggaaatatcataggaccagacgaccaattcttctcttcaagctggacatttccaaagcttttgactcagtctggtgggactacctcctcactctcctgcaaaatagaggattcccaccaaaatagagagaatggataacgggtctcctctcagcatccacctcaaagatcatcctgaatggaatgcctggggaggcaatcaagcacggaaaagggcttcggcaggggaccccctatcccctctcctcttcatcctagcgatcgaccccctacaacgtctgctagacaaggccactgagcttggggcgataagcaaattacgagggaaagcggtacgtttccgcatatccttgtatgctgatgatgcagctatcttcataaacccgaacaaagaagatatgcaagccttcactgatctccttggtcgctttgggcacgcaactggcttatggacgaacctccaaaaatcacatgtggccccaatcaggtgtaataacttggacctcgatgacaccctaatggacacgccagcaaccagagcaaacttgcctatgaaatatctaggtctacccctgaccacaagctggctacggaagacagacctccaaccgctatatgacaagtcgatgagtcgcattgttggctggcgaggaagacacatcggtctagcgggacgctctaccctggtaaaggcggtgcttacctcacaacctgtcttcctactcacaggactcaaagcttccaaggagtccctcaaggtcttagataaacaaaggagaaaattcctttgggcgggaggagaggctttgacaggggggaaatgtaaaatcaattggacgcgaacctgcctccccactgcttccggaggcctgggcatcctaaatcttgagaaatttgcaagagccttatggttacgttggctttggcacgagtggaaatcacccggaaaaacttgggtgggctctggcacgccatgtgacgacactgataagctcctctttgcggccgcacaaccataacgattggaaatggtgccaaaataagcttctgggaatcggcctggacgcaggggaggagattgaaggatttgcgccgcttgtatacgcagcctccaagaaaaagaacagaacgcttcaacaggcttcgcaagcgaaccaatggcttcttgacttggacttgccagggactgcgagctggacgacagacctgattgatcaacttgtcggggtttggatcgccgttcaggctatacacctggtagagcacgaggaggacaatataacatggaagcttactaaccatggcgagtacacgacagcatcagcatataacgcacaacttcttggaaccaccgctactaacttcaataggctaatctggaaagcctgggcgccgtgtaagtgcaagaccttcgcctggctaatcatccaaaatagagtcaggacctctgacaggctggcgacaagaggttggccaaacggttccatttgccccttatgtcgtcggacccaggaaacaactctgcacctcctcgcagcatgtagatacacaaggagagtctgggcggcactagcggagtgggcgacgtgcgagcaactaaatcctagccaatggaggcaaacttcaacggtgctagattggtgggaggctaccgcaaacatacaagagacacctaagaaggcactccgcactttgatgttgttggtcgccttgagatatggaacgaaaggaatcgcagaaccttccaacagaaggagctttcagctacctcccttttagccaagatcaaggaagaggccaaaacttgggccttagcaggagcgagaagtcttaatagctgctttcttttagttagctcggaccaaaggtcctagctcctttcttttttcctttcgctttgtaaagttctccttctctattcaatgaaattggcgctcgtcgattcgttcaaaaaaaatagactaagctgattctaagaattcaaactttgtttcaaaacaagttgattcttacagtttacaaaaattatccaaaaataagttgatttatatatatcctcttatctattcttggtctgtaaatcgacaagttttattctcctatattagccgttatacatatatatagcagcatgatgtttttcatatctcatttctcttcttaaatattttaattcaggtgctgtaaaaaaattgccatgcatccttagttgatgtagaggccgaatcttcactttgtttaaaaagaaaagatgaatacatgttgccacaaaaatcctagggaacctatatatattaccacgaggtacacgctgttgaaatgtccccgtagaaattgttgtcatgcatgtgaagaaagcacaattatcatggttggcatgaaagtgaaaccggtcgatatagaaggatgagaagaatagattcattttttttttgaagaaaaagcggcaagagaattgccgattatattaggaggtagaataaagtcttacagcatagttcttagaaagattaatacatcttgggaagaaaagataggtagaaaagtagagctagtaataaattagcgcggtttgaaaacaaaatcccgatctctaatgtcttccattatagcagttatagtctgcgggatgtctggtgattggttcctgaagatttttgcatttctcattaaccaaatacgccaccatggtgttaattagaaggagaagaatagattcattcacgggtaaaaccccatcagtcgacgtcgtcgcgcgctgtactacgtggtaatcgattccatcgtcgcatctgatctcaacaccactctacatacagtatcttttagccaagccaggtgtactaccacacactggcagtatgtacagtactgcatccagctatagcccccccnnnnatatacggtgatatgcagacgcaggtagcagcatcatatcagcaacgagcagatcgatcgaagaggatagataggtagatagaaataatggcgggaggaggggtgtgggtgttcaggaacaacggggtgatggagctggaggagcaggcgacgagcaggaaggcgctggtgcatgtggcgacgagcgaggtgatccggtcgacggaggcgctggagcggaggctgggggcgctggggtgggagcgctactacgaggaccgcgccaccctgcagctccacaggcgcgacggcagcgccgacctcatctccatcccccgcgacttctcccgcttccgctccacccacatgtacgacgtcgtcgtcaagaaccgcgaccacttcaaggtcgtcgacctccacacctagatttatcacttattacatattaatgcaaaaaccatatatatatatatatatatatatatatatatatatatatatatatatatatatatatatatatatatatatatatatatatatatattgctttgcttaatttggtgtggtgtggtttggtttggtttggtttaatctctgcatacatacataatcatgcagatggcgtaatgcatgcatgtacgatcactggtaatgtaatgtatataagtgtgtaatgtgcactgtgtgattgatatatatgtatatgattgtaaaatcaaatgttcaatatatatctatactagaaaaaaaat

SEQ ID NO: 76110 - DNA, 4440 bp, Oryza sativa
gccattggaaaccacccgaaatggagaaatggatcaaacgccctccccccctcccccccgcgcgaggttgcagagaaatggagcactaatctttgcaacagaaatgccacgaacagaagctgctgctcctcctcgaccttgtcctctccgaatggctcacgcaaccatctgaaacagaacaagaataagcacaccggattaggcgaaaaagatgggagagaattgaatgccgcgcagcatgcataaaaaaaaagaaaagaaaaactcgaaagaaactcaaatcaagaaaccgagaagacgacgaatccaaagagagaacctacctcagacaccgcgccaccaccaaatcaaccgcgagggccaacctttcgccgcccacacgcgtccggatccgacgccgacgagcaaccgtacggtaccgaaatcgcgaaatcgggagaagggtcgcgccgttttctcaccggaatcgagagtccccccctccacgcgcagctcctctccgaccagccggagatgccgaaagagcttcgatcttggaggccggtgggggcgaatcggacgggattagggtttagggagaggggaattggggatgagatgttcttgttcttgcctctccttttctttcgttttcgcgaagaagaagaagagagtttccctgggcgaagtgcttctctttcttctctttttttttttttctcgtcacaccactcgacgcggctctcctttaatatcgtctcgccgccgttaaggtgacggcctccggcgccgtcagttccacgtcagcagtagatgcgaacaagcgttcagtaaatttttcacttaactgcacgttcaccaccatacatgcaacatcctactctcgggacccgaataaatcacagaaataaaaaaaccgaagaagcatgaaaaatatagaattatgttaggaatgcctctttaaaacatatgattgtaaaacaaaagaaaacacaaaaaatgaccgtataaaagacacatgaattttaaggagagacagagactcaaataaaacttttcatgaggttttccctcatgttaaatttcctctaaaagttacatggaatgagacatattctataagaattttatggggttcatttatttgtttcaaatggctatatgggaaaaaaatcctatagaaatacaattcctacatatttccattaggtctccgtctcatacgctcagcccacgaaaaagcacacccacatatgaataatgttcgttgatatcagaatttgaaatcgagtcatgtatccaggacatcaccgttacaccactgatgttttatcactaaatatttatatattgttagcctcatcgtttgtcatatgctaatcatttgtcatatgccggttataacctgtaattgcttattaaaaaatgtgggtaaattttttatatatactatttaaaagttaatgaaaaaaataaattatgataaaataatatccaaaatcaacttaaaactaaaaattaaatttaaagtttaaattttaatagcggtttataagctaaaagacgaactatggagttaggtatgttgttaacaacaaacgagcaactaagatttctattattttccttaaaaagtattattatttcaccctcttcagtaactactttttattatttaaccctgatttttccagtgtgtggctgtgagctttcaccgtttgagagcagcttcagtgctggtgtgtttggatcccagccattgaatgccatagctacagtattttcgccacgctatagtgttttacgaaacgtccgccacactcctgtggcgagccacgccgtggcgtggcattccaagccaccaaccaagcatctctcaacatgattactgcgtaatctgatttttgccaactaaccgccacgtcattgagattgagaacgaaatgtgtacagatgagttaatttggatgaagtggcaaaaggaaggtgacatggcaggcagcatcggcttgattaatcactataaaagggacatgatgttcttagttgttaaggcaattaatttattcacgttggataagatagaaccaccggtccatcaatattggtcacaaatagatacggtatccttgatcagtttatatctcaaatagtttttttttaacaactcacacgaaacggtgcgaagttctattcatagagtagaaaaaaatacaagattacaaccctagaaagtcgtaaccaaaaaaataaaaaaattataccaccacccacatactaactgcgccaaacacagacccaggagaagtctagcaccggaccggccaccactcagcgtgaccgaccgtcgctaggccaacaatggaacacatccgagatcgcccaaaaacatgacccttacaaccaacgcaaagcccgactctacccacatcttcaggatttagggagagggggtgagagagaagatggaacacctctccccctagacccttcgacatggccaacttgtagaaactaggccacctccacaagagaatgagaatctagagcgtgcttgcaccaaaagctcgggtggtttcggcaaggggatgcctagacgacgtctccaaggagaggagcgacggaacaccgccgccgccgtccgtcaaggactcaagagagccgatactaggctttcgctcagcaaccgcccttgaggggtaagatggcactacaacaccctcaagaggggaaatgacactcgagcgtcatcgttatcggtctggccaaggccgggctgggttttcactggccatccaccacctaccaatataccacagatgcaccattgctccactgccaactaaacctccgccgccgcgtgggcacaccgcaccagtgccccccgccggccagtctccacatgcagctacctcactgggctccacctccattggcttcgcctcccgttgcgcatccatcgtgcgccagccgtccttgacgccgccggccacactgcaaggctaccggccgcaacactctaccggcattggccagccacagcccccggccctcgtcgttgccctctgccgcaggcgcggcctcctgcccctccaccgccgtcacggcctccgcacctccatctccagcacctccgcgctgtcgcgcccgccgctgctagccgcaccctccgtcaccgacgccctgttaacagtgaaatttggtaagcccaaatttaccatcggcttagagtcagtatcggcttcaaagttttagaatcagccgatgggagtcaagtcgccgcgatgtcgtgttcttggtggagtcggatcaatcaaatgaatcttatccagaagagaccgagttcaaagagaatgcacatggcaagttatctattaattatgaatagtttgttagtttccttttatctttagaaaagtgtgtttagtgtcctataaggactttatcttttccttctatctttaagaaagttgctttcttgtctgacaaggacttgtatcaacccataggtataaatatgtacacccggggtctatgtaatctatcctcacgatcaatacaattcggtgcatcgccaccttttaccttttctactttattttatcgaccggcaggacttggcacctgacgtggggctacatcgttgttcgatctccggcgaagggataagtccaatgttccgtcggcccaggcaattgtctcatctacatcggcgtcgttcaaggctgcatcagtatattcgacctcttggattgctctggtttggatgatatatttgcctacctatttatcatatgtctatgttaatctagtcttagcatatcaatttagctctatcggctgcttctcgttttagggtttctgccggtatcggctaaatcgcgttgctatattagattagcttagacatctaccacactgaaaactcaatcaacggcttgattgtctagatattatttttcttttcatacttagtgttgcatcagttaagtttgatctactaagtcgtgtttagaactataatctatagcctgcttcttgattgccaataagggtttcatcggggtttcagccggtgagttatctggacgttgcatcggctcataaggattgcatatacatataagttggatttagccgatgacaacaaaggtttcactgtttaatctaatcttgtggatttcatgacatcggacctccagccgatgtgtgctttaaccttcagatcgatgcttatttatcatatcattgctagccgattggtttctactggattatatttctatattatatcatcataagccagttgcctttatatcattatctacattggacatatagccgattgcttaaaccttatcgctatcggatggtatcagcatcggctattatcggctatcggctggaactactccgttggcttgtcagccgatctgctgcttcgatctagctatttgcata

SEQ ID NO: 76111 - DNA, 3223 bp, Oryza sativa
tagtcatccagtacgcttggtccctcgtgcagagtgtggacaggcctagcggcgcccgactgtgggtaagcaaggcactgtagggctcccacactacgtccgtcggcagaaggcggtcgaactccatcacaaactccgcgtacgaccgcctaacctgcacgtgagcccatcggcgctgcaatacaataaggtcagtgtgacgtaggatgaagttaacaatagtaggacaacattaccaaatactagcgacgtacctgacgccggcaccacagagtacccatcgttgggtagtcgaccgccggtctgttctcgtacagcgacgcgtcgtaagggtggtgctccacaagggggcggccgatcgcaatcctctcagccgcccaaagagaaatgaagagagggcacccaccgaagatcgcgccagggtccgtcctggtacaagcctcgcagaggccacggtactgagccgccagcaacgcggagccccaactccactgaggcacctcaccgaccgcggcgtcggcgatgctcctggcgtagtgcacgagaccccggtcgaccgagtgtccgtgactaccacagaacatcacccacccaaaaagccacaacaagtacgcctccaaacaacggctgaaggagtactcgtcggcctcctccggtagctggtcaacctgcaagcgttggatgaaatgttaggcactttacaagttacgtacataatacacgtcagtttaggtagaaagaacttacagtgaactgaagcagccacctcttcgtaggcccggtgttgcggtgctgctgcaacggctcgagcggtagacctggtaggcgctgcacgggtgcgaaacgtgccgtcagctcgtccttccagtcgacacccatgtcaactggcccgacagcgtctcccgcgagcggtagccccaacaagtaagagacatcctgcagggtaggggctacctcaccgcacggcaggtgaaaagtgtgcgtctccggcctccaccggtcgaccaacgctgctaggagggacctgtccgggtcccaacgtctcgtcacgtcatcgtcgccggtcgcggcctcaactagccgagccaacggtaagagaccggcctcacgcaacctgcgaaagcgaaataataccagacgttaaaatgaacacattgctaagccccctccaccgtagtaaggtaagcccggtgtcgtgaacacagtaaaaccatacctctcgacgaaggagtcgtgaaccaaaagtcgctcacgtgacgaccgtggacggaacgtcccaagctgagccccctccaccgcagtaaggtacgaccggtggcgctgatctatcgccggatccaacaactcaggatgtgccatctctgcaagtaacgtgttacatgttagggtaaataagaaggtaataatataattgtaaaaacaagttatctgaaacggaagaatacttatagagacatgcaagagtgcagattattgagaacataactttcgttacacaaaggcacgtaacgagaatgaaataacataaaacaaaattacaagccgtaaaacataaagacattacatgcggaagtctaacaagtggttcgcaacacaacacaatgcgaacatatcgataagttcgaacgaaattacaagcaaagccttttgccaacatacaacacacgaactacaccacgtaaccggtcgttccacgagaacgtctaggacggggtcgccttgaagtagtgccttcacccgtagggcgagctccatctgctgctgatcctgatagacctgcctccgccgcacttggtttttccttgtctttaggacaatacttgtaggtgtggccacgttcatcgcatttgctgcaccgcttcaccctgcctgcctccgactcatccatatcgttgcggatgcgccgagtcttcctccgtcccgccttgtctcggagtttcgttgggtcaggaatatagattatcagatcgttaatatttgtgaactccccagctacaccgaagccaaaaatctcgccactccatgtgtgatatattgcttgcttggagaagtattgtgacacatatactgcatcttggatgccacactcagatgccgcggaaatgacatgggtgcatggcctgtggagcagcgtcggctttctacaggagcagtgacatgtgccgtcgtctttgagaacgcactcctgctttactctcttgcggtagatacccctgcctgccttgtcttggcagagtacctcaaacctgtgttgttgggtaccttgcactagagctcgatgtttcatggcctttgcacgccactccgctagttttttctccatgaaagttccaaataaaatgttgttgttcggcatagagggaaaaactgcttggaaccgctccctgaaatacttgcatgtcccatgtaaaatgaactccactataccaactagtgggagtccacggacaccgcgcatcacccagttgtaaacttccgccaaatttgttgtcattataccatatctagcaccacctgtgtcataagtcttagcccatttctcttttggctcattctcaatccactgagaaaattttcgaatttgctccccagttcttctaaccaatgttacactgtctgttgggagagctccgagtgcttgaggagggtcaggtacagcggccgctggtcttgttgcacgctggtcactacatttgcctgtcaactcatctaatctcttccaaagctcattgaattttttctcctggttctgattgcatagcctcttgaacatgttcatcaactccttgttcttaaattgcttgaagaaattagctcccatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcagtgtattttaattaactcacaccattgcgg

SEQ ID NO: 76112 - DNA, 700 bp, Oryza sativa
acatagcgtttttatttttgaaagtattactaaatgggaatttctcccttggccaacttagaaaaggggtggggcgccttttggtcttttcttacagtcgtatggctctgataccagctctgtggacccccgtttttataacaggaatcaattgtgtaaacagtaccatttccctggatcaagtagtctggtacacacgaattcatagctgaaataccaagtgcacatacacgagtgtctaatacgaattattacatcataaccccgcaggcgtagtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaggcttcatctcccgcttctgattaatattatatttgcaagggtgagtaccaaccgtactcagcaagccaccacagcaatgatgcacatgacagaggaattcaaaggatggctatggttcttttgcgcacagcaagttttgtaattcttttcacaagcctaagacctagcatagactgatcaagttttataccagtgttcatattaaacaatgaccgttctgtccaccatccattgtgatcccaaggatagcttcc

SEQ ID NO: 76113 - DNA, 576 bp, Oryza sativa
actatagggcgaattcgagctcggtaccctcttactttcacgtttaaaatatctttaataataaaatatgtcacaacaaaataaaggcataaatatttatgactataattgaacgagcatactgatggagagatcaagaatccaggtagaagagcatcatgtgcgctttcttttcataaaaagacattgtgcgacaattaataatggcatcactcatctgtcgtcactcgtcacgcatgtgctcaatccgaattaacaaagacataaaacaaagttattaggtgaaaccacctgcgctgcgctatggctcagctccggctgccactggccgcggccaccatggctctcgccgccgccgccgccgccgccttctgctgctgctgctccgccgccactggcttcgagttcaacgaggccaccgtcgacgccatgcagctcggcttcagcaacggaagcctcaccttcacgacgctcgtccgcttgtacctcgaccggcatcgcccggctaaacccgttgttgcacgccgtaatcgaggtcaaccccgacgcgcttggccaggcggggcgcgccgacgc

SEQ ID NO: 76114 - DNA, 1561 bp, Oryza sativa
ttgatgagatgcggacgtgccagtcagtttgatcctgcaactgacaagatatgcaaatagtagatcaaaacatccgatcggctgacatgccgatggagtagttccagccgatagctactaatagccgatgccgatactagccgatagcgatatggtttaagcaatcggctatatgtccaatgtagataatgatataaaggcaatcggctgatgatgatgtaataaaataataatataatccagtataaaccaatcggctagcattgatatgataaaaaagcactaatccgatagttaaagcatacatcggctggaggtctgatgtcatgaaatccacaagattagattaaacagtgaaacatttgttgtcatcggctaaatccaacttatatgtatatgcaatccttatgagccgatgcaacgtccagataactcaccagctgaaacccttattggcagtcaaagagcaggctagagattatggttctaagcacgacttggtatatcaaacttaactgatgcagcactaagtatgaaaagaaacataatatctagacaatcaagccattgactgagttttcagggtggtagatgtctaagctaatctaatctagcaacgtgatttagccgataccggcagaaaccctaaaacgagaagcagccgatagagctaaattgatatgctaagactagattaacagagacatatgataaataggtaggcaaatatatcatccaaatcagagcaatccaacaggttgaatgccctgatgcagccttgaacaacgccgacgtagacgatacaattgcctggaccgacggaacattggacttaccccttcgccggagatcgaacaccgatttagccccgcgtcaggtgccaagtcccgccggtcgataaaataaagtagaaaaggtaaaaggtggcgatgcgccgaattgtattgatcgtgaggatagattacatagaccccgggtgtacatatttatacccatgggttgatacaagtccttgtcggacaagaaagaaactttcttaaagatagaaggaaaagataaagtccttataggacactaaacacactttcctaaagataaaagaaaactaacaaactattcctcattaatagataacttgccatgctgcattctctttgaactcagtctcttctggataagattcctctgattgatccgactccaccaagaacacgacatcgcggcaacttgactcccatcggctgattctaaaactttgaagtcgatactgactctaagccgatagtaattttgggcttaccaaatttcactgttaatagagcgtcggtgacggagggtgcggctagcagtcgtcgtttggctccaccaccaccagatccggccgccatggcatcggtgccgccgttgccgtcgccgtcccacaacagacactgacatccttcccgccggcgccgagcgtcgccggatgcctccccgccagatccggcgcagatctggtggcctcgtcctccgcagcgcctctaaacttcgtcaccaccctcgccaaacgccactgctcgaa

SEQ ID NO: 76115 - DNA, 590 bp, Oryza sativa
gtagggattattactaattatttccactagtgttggtgaaatatgagtatgcaggtattttaaggagaaaacacaccagtcatataagaaaacatacatccggccaattagacacaagtacacggattgaaggacccacaagtcaagtgaaaccatcatggaatgggtcataactgtcgtaactgccatcaggacccaccactcaatctcctagctaaaggagaggctaggaggtggggcccagggttcggccgaaccaccactggcgcctttgatcctggtcttccacgtgtatgctactgataactttacaaagatggttggacggcattttggaaatttcgcatacctataaccatcatatggagcaaataaaaggagtagctcatctcatttttagaacacacaactttaagctgaattacaagaggatctattgtatcttttgtatattagagataggtagagagtcagggaaagctctggagaagtgctcggaagtttggtgctctttccgatttctacctcgacgagtgtagtttcctaggagtaattctgtaagagtccaggtcttctattaagtaagtatt

SEQ ID NO: 76116 - DNA, 1474 bp, Oryza sativa
tctatttctagggagaatgttgaggcaaacttacgatgctgacaagctggttaggtgccgagttggattagacatcgttggttttagtttaagaattgggaagaggttaagaacctagtggaatccactgcgaggggaagtgctgaagtgatagggattaaccctgctaaggaacagagcagagaccatcacaaatccttacaaaaagaaaaaaaagaagaagaacttgtttcggtagatctcgatgaaaagctgcagctcctttacaattatgttccgcacgaagtccacaagaaaaaagacagtgattttagtatgattagtagtaacttgcaaccgaagcgacattttcccctggggtaagagcaaaagagccacgcgatccaccgttgcagagatcaatgatcatatggtcttgtgagtttttttcttaagaacatagtctttccgtaaaagaaaaccaattattctactaaaaaaatcacattccttttatattggtttttttttgacgggaaagtatggtcttgtaagttgtgaggctttctcttgacacgttgtactactgtgcatatcacaacacgttatcttaccgcgtcagcgtcggacctttaagcagcggttacttttttccttttttaatatagttaattccagtatgggatgtgacatatcatacgaatctaaatatgtatatatctagattcgcagtactaagatatgccacatctcatgctagattaacttatttttttatggaagattaacttatttttaaacggtggcagtagtgaaattcaaatagctttgatttaaaaacacttttgaatttgagctcaaattttaaaacagttttccccgtgtaaaccggcacgagataagagataaccgcaaaaaccaaatacttgtattcctacttgttattatcgattttcaacgatcgatgatatttcaaaccataccattttagggtaaagttgctaatgatgtgcatatatttagtttcttgccaaattttaataaatacataataaatcctgtgaaaattttcacaatattattaacttaccaatattttggcaatagatttattttgactataatgtaaacaacctctaacttattgagtactaccttcaatctacaagagattttagcaatacgatatatagtagatggagatagtataaagctgtgtgcatataccgaagccgagtaacgaagaacaatgtgatatgcagttgcgacgcaaaggaacactctatctgcgtggataaggtggacttgattcgtcgatggcgacgatggcgagacctgcgcggcgacaagagacagagacggagtcaagcgtgacagacaggcacagaccaccacctgctcctattcatggtcctcgtttgtgccgtgcttatcctccattctctcactgctccctccacattttcgtcgaggagacaaaatgtccactattatt

SEQ ID NO: 76117 - DNA, 27118 bp, Oryza sativa
  unsure (1)..(27118): unsure at all n locations
ggcgtcatctattaaaaaacggaggtagtacatgatgttgattgctctttatttgattaagtaatgacaccctcttattgtttaaaaaaccatcaagtaaacacttactctacgaaagttggtctctttcccattacaatgctatctaacagcaataattctgacaattttcagcccaaaatccacatccatatggctcccatgcccacattgtacagtgttttacatatggttttggtgtcatcccacctttccatgccctgcttatcagatcgacgtccccagcgtggtcggtggattccatcaccatcgttggagagatcatctgggctctcaatttctacctacaatatggggagtggattctacccctcgtatacctttttcttctaaattcgatgcaaatagttgtgaaatttttttaaaaaaaattaacaatgtagagtataatgacatctactactccaccaaaattcaagttcaaattcgatctacacatcgagaaacaaaaaagacaaatttagatataaacaatacgctactattcatacgctaaatttgtttatatctcgacgcgtgagttgagtttggacttaagattttgtggagttgtatatatgtgttgtatgaatgttgtcaaattttttcagaatttttcataaccgtttaaatattttttaagcaaacaagggagcatcccctcaagggattagaatagtttccccctacaatgccacccttattgtggtggtgatatatttttgcttgacctgaagtaaggtatgcatctttcttactttattttctgttaatccctttttgtgtacgcaaagtttttttttatggtattcaccttgatataagttgcaatatattcatatagtatttagttaacatcatgaatatttttttctcaataatatatatgcatccatccggcccgtctataattttgtgcactcattttaggcatttttctttgtgaatatatgattatgagtcccaacttcaaagtatatatataatatatatcatctacttgatttttttttaccaaagttacacagcaaaattgtttaactactgcgcttttgctttttaaattaagttatataattaacttatttcattcaggcttcattctgcgctttctggaattgtttcatccttcgtcatcccacggtcatccgtactggcgcagcatgcctccagccccgccttggccgaacctagcaccaccgccatgtcctctcggtgtgtttcttccttcaatcgcaaaaagcaattccctactcctccctcattattttccgtgattttacctttcagttcagctttaattcgccggatttaattgattccaatgatgtctagccatcgagcttatcctgactattttcatcctgaattttatgaattcgctctgatgttggagaaaatagaaagaggagattgagtggatcaaaagctctcaatcaattttaggacatcgataaagattcgataggatttggtgggcaaggttggctccagcatcatatgggcatgggacggaattgtcttccgacactagctagtctgctatactagctgcgtcttcacttatgagttgggtcgaagagaggtaggccaagggttttcaattataatgtatatatagcgatcctaatgttttaatttattgctcagcgtctaatagctagtgtaccataaaagaattacacattgtgacccacggatattttttctagtataattctaatactctaggatgatacatactagtataacaaccaatttcccactatccgttctattcctggctatggaagccactttggaaccgcagtgctctatattagtatatagtagtaatgggtttatgaaaacacaacttgctggttttttgtgattttccacaaaattaaattttataatttgacatatacaaaagaaaaagcaaatcaccatatcatgtgtataactttgacctctatagtaaatatgctatggctgctttttagctctaatataactttgaccatagcatacatgttatctctaatatatttttagtacaactttataagttaaatttggaattatgtacatacatatttgttgagtgatatatcacaaattagtttatttttttaaaagaaaatattttttgactatttaaataacatactatctccgtttcaggttataaaactttctagcattgcccacattcatatagatgctaatgaatctagacacatatttgtctagatttattaacatatatataaatatgggcaatgctagaaagtcttataatatgaaacggagaaagttatgtatatacaaactagtttatttcacaaattagtttatatttgttgagtggatatgtttaggccggattcccttgcacggaacacacctacgtaacttctcacaagaatggaggtttgcctccatgcatgcatataataaggtgtattaattaagtaaataggatatccacctcataacgggtatccgtcaaatgtgtggatccatacccaataagatgggtccatatatgtccatatatatcactctcagcagcatatcatcggacacattttctctgtaagagtacgcaccagtaaggtcatatggaccgcatacatgctgaacggaagaaggtccggatttgcagttgcattccggatttgtacatccaacttttgagcatcgaaagatatactgctatatccgttttatgttataactacatctattttatatcacaagttgtttgactttttaagtttgatcaagtttgtacaaaattataataatgtttttaatacgaaacacacatattataaaaatatatttaatgttatatttaataaaactaatttgatgtagatgttcttaattttttctataaatataaagttggtcaaacggtcaaacctacaaacctttgacaagaaaaaatataaccgatttgtaatatgaaatatagggtgtaattgacagccacagaacaactaaacgaacatttatacatgacagtatgtgattgatatttatctacactaaaagagagagtcggcttcctttttatgagaaatcgctttattggatatacacatggtcctagcatcttcaatctccggagacaacactaattttaaatggaccaagcatcttcgtgccaactttaatatgggcggtctttaacttattgaaaaacttatgttgtcacctttcaaatgcatctggcctcatattaaaattcatcctaagtcaactaaaatcgtaaaaacaaaataacattgtagctgaaacaaactttagccttaggccttgtaatagactaggcaaatctcagacgtgcctctctccacctccacaaactagaacctagccctagctttattttcatctagactaaatttcacaaaactacatatttaagattaagtatcataaaactacatatttaatattgaagttatcaaaaaaattatatatcttagagtttaaatccctagcaccattgttatggtgaagctataaacattatagttttgtggctaaattgattctaaacctagttttattatgataactttgttgctaaatatgtagttttgtgacaccccatcctaaatgtgtagttttgtgataaatttagtattaaatatgtagttttgtgatacaccaagttaaatatgtaatttatgatagtttggtcatagtatctgcagttttgtgaaatttactctttcacatataaatatctatgcacaccctctaaaataattgaattttgtttagttgaattttgccaagtaccagtcacgttgtctctagtcctcggtcaattagtcggcaactatagttttagagtcctcaatagttggtgtgttaatttaccgggttgatttaatctaccatttcaatcgcaactattcctttgtgtcagtgacaaggataagacatacctcctatacaacaatcccatatacccgatagtatacgacaagatatcatttaaatgaggaaatacaggggataaagaaggaaattgtcttctcgaaatagaagatgtcagaatccaagtcaaggaagataatttctccttaggcccatgtttagtaagaaagtaaatgcattggatgaactagtgacgacccctccgaccactagtagatggtgcgtatcggtccaccggtgtcctcttttgctgcgggcgtccctgggcagcttgcgatgactccggtgcacccataggctgagatgcaccgatctcttcctgtttttgctcctcctctttgtcatcctctccctccttcctcttgctcttcctgttcttcctcccctctgatccccttcctcttcatttctttgatgacttgtttcttcagcttgtgtgtgcgtgactcttggttgtgggtcgactgttgtcagggttacggataccacatacccaatagtaattgactaaactcggcggggcccaccatataccaagtcttatatggaatcatgccccatatataggagttccggataaggaaggacaagtagagttttatatggaaacgacaaggactactcggattgtatccatattggtctccgtagttctacttggataaggagacatctatggatataaatacaagaccccgtagggggagagaggatacaacaacaaatagacacacaacacacgcggccagacatcgacatcagagataagcctagacagaccccatctggtgcctacggaggtcgacaagagggatctagaacatctctgatctcgacgagttcatatttgaggaggaagactaccctgccgtcgactacgtgttggttatctatgccgtcaagtcgacggcagctagataggttatcacaaatattgtacttgtgtgatccagataaatatatagagcaacaccagcttcggccaacaggagtagggttgttaacttcctgtgaagtggcccgaacctgtatataatccttgtctctgtctcttttacctcaatctcgcatataccctggtaggctagtaccgacgatccccatatcatgcaaataccttagtcgagatctcaaacatcgacagtggtgcgccaggtaggggaattttggtgcttcaaggtttcaacgagatgggttcaagaggtggattctccgacaacctctgtaagtgtttgtatatgcaatatttgtccattaatcctattttcttatatcaccctgtcttgaagtcgatcctatcgttcctttacgctactctcaatgcgtattaaccaagctgcataaatcgggaattggttttcccaacttcatggctagggcctaggatttcgtcagcttctattgacacgaaaaacacgcactggcctgagagatctgcttaactatagtgcaggtccaaagaaattgccttcaggttctgagcatgccagctggtttgatcctgcaaccaacaagatagaaaaaagacaaagagttaaatccatcaacggtagccaatcggtaggattgccgatgacgtatcatccgaggccatgccgatgtaacttgcgtcagatcggcagaggcagattaaacttggagattgttgggtgtacttgatcgactgtagatgttaacgatacgtaatccaatccaatgggacacgcttagatcgagtgattgggatagatcagtcgctgcaccgagacagtataaatcactccatatctaaatgtgccccaaagtagggattatgcatgctcgcagcatagccgatggggcgaacctaacttgtatcggctaatactctaacaccaccttataccaagatattagcacagatgaaatatacaaaactgaaaccaatctagcaagcaggatgaactagcagactgataggaagcttaatatactttaaatggatgagatcttgatataaggggcagatttagatgatccagaaccaaataagaaaacaagacgactaaatcaagtgagatcggctgaaactccgatgctatctctattagcaatcaaagagagggctagataaagcgtttcaagacagtacttaacagatcgaacctaaccgatccagcattaagcatgaaaagaaacataagatctaatcaaatcgatgaaaactcattcaagatggtagatacaccgcatagtctagcttgatatcgaaatctaaacctgccagctgttttcgatgatagagactagccgataaagcttagataacaaggccaatctagattatgcggtatatatgataactcggtggtttacattgacaggattagagtgccatgaagatgtaagcactaatcccgagaacgcaaaccgccattgaaagttcaagcgccattaatttggttttggtgattaatgacaaattcaatcacatgagactaatattgttataagcatttctttgtctactagtctcatatggatatgaaagtggaatatgtgagatgtgattttcggacttcatatgagttgagagagaaacattcattgatggtttacctaaatcacaaggatgaaatgcatggagatcaagctatatgtatcactctttctctccgtgcacatattgatatattcatatataatattttcatgtgattacataaacatgtgagactaatattttgtttgagccatgtcttgtttagtctctttacattgagaacatgtagatgatgaaggtatgcttttattttaatgtctatatttgagaaataccttctattcttatataggataagctctcaatgttttatatcttgttatgcatactcttacttcacacaaatattttgtatgcatacatttagggggagcaaatcctatactttagttatgcacgtaatcgatccaagttattcactttcatttaattgggatctttacatttgagcatacattcaagtatatgacacttgtggtgttgattagtactcaacatttattcatatccttttatatacgcgatcggttggtcaacatgtggaggttgacatccggatcattgggactaataattttattgagttgaatgagagaaataggtcccaaggattgcaaaggtgttgatgttcaagtgatatcattacacctaacgataccaagaatgacaaagtgaaaaatgttgaagatgtgggatacgaagtggctactatggcaaaacggtgaagggcaagcgatgctcggtcacgatggaccatgcggcggtaaagggcaagcaaggggcttggcaccgaataaccaaatccggtggtgaagggccagtgacggctttgtcatgatggatcgtacgagaccatttgaagctacaagtaaccacatcaatcatttgaagaatatatggtgaaacggtgtagacattggcgtcccttaagacaatgaaagaaagatggaaagaaggcattcctattggtataattctcttcctatttacatttgagtttaggaatgccgtactattaagagagatgcaacgtcgaggtgtttgtgtatgtctcggtgctcaaagtgacctatcatagtgctaccttgagagaaacccaagctttaacctatcctttgagtggttgtagaccttggttttggttgagttgggtagtcctctcagtgagctttccatagagtccaagttcatcaaaaacggactcccgagcgaaaagttatatctgtttttctctgtgtttttcggaaattccgaaaaaggatgcgaaactgagatttgcttcagtagattttcggacttgtccgaaaatgcttttcggaaaatccgaaatttacagttttggccttcaacgactagtttttatgaggctcgggtatataaactcctcgacccctcctttgagtggctgttgttcctgggcaacattagacacatccaaagccaaatagccatccctatttccctacctttgtggtgccttttgtgaaggggatttgagaagagaagagagttggattgagagagtgaggagttgagagctagcgagcttcactccatcctttgtggtgcctctttgtgagagggatttgagaaggggaaagagttggattgagagattgggaagttgagagctagtgagcttcactccatactttgagcactctagttcatagcaagcaaatcttcgattgtgtttgttactcttggggactaaggtctcctagatggtcaggcgtcgccggtgagcacccaaggttgtggtgtgccacggaaagtttgtgaaggctttgatttcgcctccacaagggaagaaatcaagagtgaaaccgaggagtgcatttgtgcaacctcgtgaggaaagggttgaaatagacccggccttgtggcccctcaacggagacgtaggatccgtggatccgaacttcgggaaacaaatcaacgtgtctcctctcttggtttgctcattcttgccttctctcatattgtgcttgagcttgtttttacccgatctacttgcatgcttaattgatttagttggtgaccttatatcttgcttagataccttatttgtcaccttttgattcatatacattttgtttattcaagctacaagttcatagctagtgttttatcccgttatctgccgaacctttcggttgagatcggaacttccaatcctataccggaagttccgatttgaatcaaaagttctcatcactctaatatgctatgaagttgtgataattttaggaacgcctattcacccgccctctaggcgacatcaaggtcctttcagccataacaagctttacctcttcgtcgaagatcgtacccgatgcagctcaactcgaaagcaaaaaaactcatcgaaacaatgaaaatagaaaagggtggcaatgcaccgaagtattattgaactatcgtcctttgattacatggtgtcgggtcatatttatacccgaagtacataacatgtacttgctggacacgactcttatctctaagacaatttaaaatgagtccttcagggggactcttaccaaacatatctctaaggaaactggaaaatgtcctagttaatagatacaattgtcctttttaggactccagtccttgtgtggcaatggctatgaagtgctgcgaccaatcccgacgacgaacgtgtgaccatctttcccgagacaggttgcatcggcttgactctgtcggatccggcgcttagccgatatgtggcaggcgatgctgcttgtaaccgatgcgtattctttctcgaacggaatttctccaactcagtcttgactctagctttgaatccatgatgtggtattaccaaatttgttcgttaacaacttcagcttggtttgttataagatttaagctgtctttgtggaaaaacgatttttccataaagatagctgggggctaggaagagtaccagactccaattgctaagggcagctttagcgagagtactcttttcttgtcatgtgcatattcaatttattttcatattatatcgtgttaccctagggcgttctgtcacgtcctgataaattcaccccgaaataaaaatcattctctaaaaggaataatagaattaattaaaattcgaaaagaaattggcaaacactaaaatacacgtacaagaaaaatccgaatgtggcccagagaatttttgttaaattctccttggcctaaaagaagccctcaaattttacttgaattttcagaacgctgtaaataattattaagcaacaacaacctttatcaaagtttattaaaaagaactaaaaatcatcctcctccctcctttgagccaagtctgacccaaagtccctctcctctccctctattttcctcccttctccctcctttccttcccggcccactccctcctctcctcctcccgcctgggcctgccccggcccaagccgagccgcagctctcccgcgcgccgcacgcgcgttgactgcgacccacgcgggtcccacccacccggtcgtctccttcctcccgcacggcctcctctctctctctcccgaaaaccctagttgctttcctccctcaaatccacacgattcaaacatgggattccaaaattaattagggagaattaatcccctttccttcctcttcaattgcgcctaaggcctcgttcggatagagcccggccttttccctccaatccctagggatattggtccaccacccagaccagtggaaatccaccactcgccgccgcctcgcttctctcgtcgcgtgccgacgcctcctcctctcgtcgcgcgtcgcggcgccgccgccgcctccgtcttctctccccgagcggcgcccacgccgcctctcctctcgtcgcgcaccgcggcgtcggcacctcccctgccgcatcgcatccctcgcgcgcgccgccttccttcctccccagtgtcggcgttgcttccctttcttccccggtgccggcgcctcctcccttcctccccgctgtacatgctggacagagtgaagcagtcttctccaagcccagatccacgacatcagccatcaggtacaccccttgctcttctcctcaccgcatctgttcatattgatgtgcatattgattttcttgattcagagcgtttcactattcagatcgattcatattgattttctagtttcatatatgtacatggatctgctgttagagctgctgcatatatacactttttaatcaactaacagttaagatcttaaaagtctggtcaaagaaaaagaaattctcaaaattggtagataccataaaattggttgttagttcagtgtttcactaacaatgagatgttattataaatgaaaagttaattttaatcataactcgaatttttagaagtgtgtaaataaagaaaccatgcgaagttttattatctaagtgttgcatttcaagtctgaaaataagttggagataggtttaaattcattattctcacttttgtttttcatcatcttagactaaatgtctttgttttcatgaaactggaaactcaaaaaagatttactattataacatcttgcttgttcaagcagttctttgttggtttggtttctccctgccggtctcgtcttcttacgtgttcttctcttctgtccagttgaagcagttcgggggactcaaaggccggagggcttgttcgccaacctagctcactgagctgccaagctcgcttgtattggtaaggtggttgcttctcttcctcctttgttcctcgtgcatctgctactgcttctagttttgattccattcaccaagtagtatgtgtgtagtattggtcagctaaggtcataatttatagtgattgcttctagttgaactgcagtatggcacacaataagatcaagtttatttgcattctttgccattggtataacatattacaacttacctaaagattgctttctataaggtccaattgagttagcgatgttagaaacaatcattaaagaacttgtttttgtgagtaatttcatattttagagctatattttactcaagtcacattccaaagaggaagcatgtttgagtgaggccatatcctgttcgaaattttatatgtgtaggaatagatttttctctatatgtgctgctaaacatccaaatgaagactgattgactttgttttcataataatggaagctcaaaaaatgtttggtgctgagaccttattacccttaacatgaataaatgaattagtgatgctgatatttaatgaggaaatcatttttttaaaaaaagtccttattgacccaaccatgatgtgagtatagtatgcatgaacagtacactttttttcctcttgtgtgtagttaaaaaaaaagggttcaagggctattcgaatgaggaagcgggaggaagaggatgacgatatgattcttttccttttccctgctctgcatcttttctactaaacacaagtactgctcaggttatgaactttgcaatgagctaattgtcaaggagcaatcattttaagcatgcaaaaagtaccttttagaagtgtataaatggacagataatgttgcatgatgagtccccctaataatatttttgacgtttgattcagtttcctttacagtccctgtacctgctactttgtgttgcccagacttttttcagtgaagaagttaatggttgcgccaatgtatctcaactatgtgaaataaagataattgcatctttagcatatgaaattgtcctgtttcttcatgatattgttggtttgaaaaagaaaataaagtggggtaagattgtcatgttttttcatgatattgttggctcccagttagtacttggtactcctagtatcctaaatccagaaatagatcaggtgcatgtttctctgaaggatctgttgaattgtcttgtggcatgtagttagttaatttgattaaggtgaatatgctactatggtactaataagaattaattatgtctgattcatgtggatagtctctaagttattaaataaaattgtagaggaattacttacaatcaaaagttagattagatggggctggtcatgggctgaagatttgatgaaatgttccttctgtgattatgaacatgtatgcagttagctaattattaatgaacagttagctgaatttttagaagtgtatttacaggtgcctgtcaggcttttgacacaaataattatactgactttgacatattgttttggtgtgcagttttctgatatgtgatgtccacgggccttttgtttgctgcaccaatgatgcaaggaaatgtattatgatgtatgtcggaaagtgttgttactagatagaactattaaggcaatgaagctcaagttatgtcttgttttcccctcaaaaaaaaagttatgtcttgttcgatttaatacttgtaacactgagagatatttgtgtcctaaatctcaacgtgtattggttcttcatgttggttgccttttttttttttgcaatattgtaacaattacgacatggattttgcagcaggtcttcagtatttctttaattttctacaattttcgtaattttctaggcatttatatatcttttttctgtattttcctgaaaaattagattttgtttgtgcagtatttcgaattatgtgcataatattttgaaatttctggagtgagactattaaattgatatgatatctcaccactcactattatttaccacaccaatatacttagatcccatgggttgaggggattatatcccatggtggagtggattgacgtgggaattgggtggtgggaggggatccacccaatccctgccgcctagtggtattttccctggggaaaaaccaccccaactaccgaacaagcccttaattatcccttgattcgtgctcttattcacccggaacggcctagccattcacggctgccatttccgccgccgttccatgcctctcccgtggccggctccctccccgcgcttataaaatggagccccctcgttccattctcgtgtttttgcctcctcccgagtctcccgtggccgccccgccctctccctcctcgcctatgcgccgtccggccgcgtcgtcaccgccctcgccctcgcaggtgtatcctcttccccggcgtcgcttccgttccgcgtggagaccaccggaggtacatcctcgccggcaaacagtggcgttgccgcgactccaccgcctccagtcgccgcgccagagcgccggtcgacgtggctgtctcctcctttggcatcgcagcggcaaggtcgccctcgacctcgcctcccctcctcccgatccccaccggtcttcgtcgtcgtcatcgtcctcctcgtcatcgtctccgtccgacgtcgccatcccctcctccggttggccgttcatcctcgccggctcgtcgtctcgctgcgccgcctccgtcgtcggcctcgcagcggcgtgttccacgccgtcctcgcctccgtgtagcagctgccggctgccctcgtcggctactcgccggccccggtagtcgtccgcctctcatcgtttcgtcaagtgtgctgcagccccgtcgtcatcttcatcgtcgggtccgcgtcgtcaagccctgcgccggccgtgtctcgccttcgtccaagggtcgccgccgaagtcatcccctcgccgttcgtctccgtcattcccgtccgcctccgctgtgcccgttcgccgtcgtcgttcccacgcctcgtcgcgtggtggtaaggatccctcttctcgctgccccgtcctcgttctttcggtgtcgccccgtgcccgttgtgcggttgtcgaccccgatacccgtgtaccggtgtcggtagtcgttcgtgtgtgcgtgtggtgaccgtgttggtgtgcccgctcggtagccacgtggtttccacgtgtgcagcccgcgtggtgtctagtggagtccgtttgtcggccacttgcctcggttgacacatggggtccgcttccgtcgacccgtggaccgtctctgtgtactcggtctaccgtggtcctttaggttgacatgtggggtccgcatgtcaacagcgcatccttcatgtcttttccatgctagcgcttacacatgttttatagttgcaaaacctaattacaataatccgtaaatctccatgtaatagcattaaacttcggattaccatttcttggtcatacgaattccgaatcgacccgttcaagtctcttagtgtttgttataacctaaagaaccctgtgttttctttttatgtattgttattgcttctttttaggcttgtagctttgcttgtgtgcttcgcgtagctttcgtcgttccggaggttcccgaagcgtggttcgctgtcgtcgccgaaggttcggaaggacgttctctctgagcaaagcaagtcacatcatccttgagcatattgaatcccaatttataaaattaattattttgatttaaatttttgcattatcgctttatttaaatccctgcattatcactgttttatttagcaatacctattaatctttgttatagccttattattgctattgtttattatcaccttgcttaccctaagaaaacaaaaccccaactagtgggtactctattaatggttccactagtatgaacttaactagatgcttcgctgattaattaggcaatactaggtggttttttaactttagactttgggagctctcatatcatttggacattatggaatggttggcttgtgatggaattgaacacacacctcccccctctattcaaaactcccaaaatggttttaggctgggctcaaggtgcatggttttgctaggagcacctcggccaccataaggaccagtcttcgggcctctgttgcaaagcactaccgtactaaccacatgtctaatgggtaaggcttaactcggtgctcagtctagtcctggcaagaggacacggatagatatggacgaagttggggctcgatggacatctctagggcaaatgaaggctatacgggctacggctcggtagtcgagatgtcatggcacagggccggtgttctgctgctaggggctcaatcctgcctacctgtcccgggattccagccgtaggcggggttgggtcagtacttttgtcacggctaggatgggtaaaggggttatgtcacatgtttatgacgggttccacggccttggaatgtgaagtaaagatgtgtcttgtgggtaaagatgtacacctctgatcagagtataatctattcgaatagccacgccctcggttatgggcaagcctagcaatatacccaagttagtggtttaattcttaaaacttgcttaacaactaaaatgtggaatggttggcctgggttggcttgggacgaactgagacctgggtatggttgccagtttggtctgaatcatcataggccttgggttaaggcaggttcgtgtgggttcacggccttgattaataatattgtgtagccctaggatcatacttttgaaatagctttgagcaactaagtgtcttttaaatgctgtttactgcaaaatctaacccctatattatcacccccttgtacccccttgcattttgtctaaagaaagttgcctattagtaagcagtcttccctctttcataaggctctaacttgcgtaaggaatcaaggagctacagttgtttcttgccccttttgtatttttctgaacacaagttcaccgcatcgcgcctcgtgcaccttcaatttcaccattggaccattctcaaatgccatctacatttatccccaatcctccttcatgattcgtctcctcaaccatctgtaggcagtcgatcgcctttacttgccttcgattcttctggaccgccggacaggtcagtcaacccttgagctgtactgaggggttggactggaaagcatactttatgtgattcctccttccccattgtcctctcctacccgcctttcccacatccatcaaagggatggcaattctatgtgattcgctacacttgctggcgctccaccccataagctaactctattgcctagcggttagcgacacttttccggtagtacaaatcactacacttcgcttctttttctttctatatgataatatgcaccgtcggttgctgcgcaccctgcgggtaatagcaagagagtgaagaacgaacgatcctcagtcagcagtgaatgagtccgactcgagttcgtgagtcaaaggcgtggcaagagagcgagttcgactcgcgaacgacccgcaagtgaaggaccgatcctttaacgccagtactgttgcgagactggtacttgggggctcacgagcaacatatagactaaggttgcccatcactccctcgctcctttttgaaggcccaccggcttgcattttggggcgagtactacagttcctccataatcacacagaacgcccagcttcgcagagctgctctctccccagtccacagcaaggtgtggaatctggatctacagtgtgttctgaccctattggatcaagtcagatactaagccttctactactacttaggtacttaggagagaaaatgctatatttcagagattggactctcttactgtgtttttctcagggcagttcccgagccgggattaatcatgcatctcccggtgtgacttgttgagtactgtggttgtactcattcttgctctatctcccccccaattcagtaagagaagctttggagaagaagtcctaggtgaagtcctggcttataccctagttgagcgcctgtgaagatggagccataggcccgctagtccgctgctgtttatttctgtttgtcaagccttaagtgcctttgtaataatgtaaatattatcgatataataaagatgtgcctttcatatcatgtttgtgtggtgtaccccgacttttcctgggacggggattaatacactagcgttctggaaaaggtatttttccgggcgcgacacgttcgctcgggggctatttgtatctaacaatctgttctgagtattgatttcaggaaagtcatatttcagggctttatcgtagtcgagaatggttggatgactactcgattattcaagaacggttggtggagtttgacaaagattacagaataaagcgatggtgtacacgctgtgaatgagtgaatattagaatctgtgatattgtttttcccttttcatttgttgttcttgaaacatatccagatgatccattgagctcatctgctcatgtccagaaaacacatctcttaactgttgtttatatgcacggttgatttttttggctgctatgttggactattgaagcgctgattaatttttggctttcttgcttctgcgttggctcgcgagctaaacgagctagctcgagctggccaactagccgagccgagctagacttttattagcatgttagtataagcttgaccgagctgagccgagccgagccaagctagctcggtatccacccctagtcgggtttattgataccacatacccaatagtaatccactaagctcggcagggcccaccatataccaagtcttatatggaatcatacctcatatatagaaaatcaacggtattgtcagactaattccgtagatacatctggtatgtatctacaaaggtacgccatattttatatgcaatttatcgtactatctatacaatattgtcatatcagtaatttgttatgtttacctagaacatgttttttatacaatatctattgtgcgagtgtttctgaagttagcccaactacagtttaatactgggggctcgctttattttcttttgtataaatcatgcttgcttatggtttacgtaatgcctgatatttaaatatgctcgttatatcctaataatgctagaagattcatgcagttctttgagtacatactcgatattctctgctatatatcttgccttctagacaatatttttcaggaacaatcgagcactcaagtagattgtggtcgagtacaccccattatcgagaacgttctcggtaaaggctgagttgtcacaccaaacctaccaatgaagaccgatgacttatctcatgtatagcgccggctacgcctggactatttgggcataggttgttaacggataattcctcgtgaatgttgttggcttgatcacccgatatgattgcgaacagacatctggataagctacaagttgggtatgtgagtcatgctggccacatgagatgcacatgtaatacctaactgtagtgcccctataggtgattgagagatgtctatttttggttgtcgaccagacatttgtagtgacatcttgccgcctatcagttgccttcaggtgatcgatagatgcctactcctggttgtcgaccagatggtcgtagcgatctctcgacgcctatcgtgacaatcaacatggccatgataacgataaccgagactgacaggatcgtcgtagtcacccggatgacaacgtccaggactgacgagatcaaggcgacaacagacaaggttaacgacatcacgacatcacatggtgacgatgaaactcgagatccccagacttccagagggcctgaggatgaggtcgtaggtccaggagacaaacccccgactacgatagtccctcattgacttcgtcgtcgtcagcaggcagttctcgcaggttgcgaggatgccgtccatctatctttctagattctcttcaaatggtcgagagatacctactcctggttctcaaccagtaggtcgtagcgatctctcgtacctcggcttcaaatggtcgagagatacctactcctggttctcaaccagtataggtcgtagcgatctctcctacctcggcttcaaaaggtcaagagatacttactccgggttctcaaccagcaggtcatagcgatctctcgtacctcgacttcaaaaggtcgagagatacttactcttggttctcaaccagtaggttgtagctatctctcgtacctcgacttcaaaaggtcgtagtgatctctcgcgcctctatttgttgagtacaactatacacgtggtcttcgcccagtgtggtggttgtctcatcaagtacatcaacttctataagtgtttatatgtgcaatatttgtctattgatcccctcttcttatgtcgccccgtcttgaagtcggtcctatcgtccctttacgctattctgacaaagcctccgagaaacctaaggggatttcagctggggacgcccagaactgataaggctttgttagatgctgcagagccaaacgaccatgtcagatttggtcatgtcagagtgctcactggatgcgtattaactaagcagtgtaatcgggaattggttttcccaacttcacgactgggggctaggattcgtcagcttcatattggtttgttataagatttaagttgcctttatggacaatggttttttcataaaaacagctgggggttaggaggagtaccaaactctgtttgctgagggcaactctagcgagcgtactcttttattgtcacatgcagatttaatttattttcaatttttccatacatattatgtcatgttactcttgagcgttcgctcgggggctatttttatttaacaatttgtttagacttcaattttaattcacttatggaccgttggactccattcagcgttgtcgaggactccatgtctctacggtcttacaccgggatcgactaagcgagtatgacaaatgttgactagagaagtcgcggatgacaacctgagttcatttaactctacccaatgtcagagttcagaacagttaaatcagatttcagggatctgtcgcagactctacgcctactcgattactcgagaacggttggtggagttcgacaaggaatataaaatgaagcgacggtgtacccgccgagatggaatttcttgactaaaatccaaattctcgattacggtaagacgagagacttagtcgtatgctccgtactttctcggttgacatcggagattaacctagacaaacccaatatggtgcctgcagaggtcgataagagggatctagcgctatctctgatctcaccatgaacggtcaagcgagcacgacaacagttattccaaaatcttcggtcgagaacttcaactcatttatttgcattgaagtcgggggctactatcatggttatggataccacatacctaatagtagttgattaagcacggcgggacccaccatataccaagtcttatacggaatcatacctcgtatatagaaggagttccaaataaggaaggacaagtagagttctatatggaaacgacaaggactactcggattgtatccatattggtctccctagttctaattggacaaggggacatttatgggtataaatacaagaccccctagggggagagaccaatagaacaatcaagataggcatagaccaacatatacacaagccaacacacgccgctagacatcgatatcagagataagcctggacaaaccccgtatggtgcctacggggggccgacgagagggatctagcaccatctctgatgtcaacgagtttgtactcgaggaggaagactacctgtcgtcgactacatgttggtaatccatgccgccaagtcgacgacagctagataggttatcctaattattgtacttgtgtgattcggatgaataaagagaaacaccggcttcggccaacaggataaggggctcgaacatatataaaatccttgtctccatctcttttacctcaatctcgtatataccctggtaccgacgatccccataccatgcaaataccatagtcgagccctcaaatgtcgacaactgcgtctgtggacgtacaaccaagtcttgctgccaacatttgactttgttgttttagcctttgcaacaacaaaacaattgagttagaggcaagttatatgaattgatggattaaactcatagcttaattacctatagtacgctccgaagaatacctacttcatcttctaacccaggaggtgtgccaagggccacacccgcgtcgtttacggacatcattagctcaagtgcctgtaggtggatttaatctagtgagaagtaggtgtaatgtgaaatgaagaactctaagccttaatatcttactactcaaccatcgtccttgctcgagtttggttgtcgtactcattcatctccacaaacccctctggatctgtagttatgtcagctagagtctaggccttgttgtgagcgactcgtgaagcacaacatgagctgcttagtcactatgtggccgagaaattgcacttctttcatccaaaattcacacttagaaaaattaggcttttgtaggattaatcaaatttgctttttctcgttctatctcagagtatccattcattcgatcttgctatccgctctcaattgaatcccttctctgttgtcgacatgtgtgtccgcatctggaccagaatcacgatctagtatctccgtactcgaatacctcgtactttattaattaggaagtgaagtagggaacagtttcctattcaaagtacagtgccttcggtacattggtgcattggatatttccaggtagcaggtcggtagagtgagggctccatccataacaaaacaagaacgtctactgaaatgacggaagatgcatattattctctctcgtagctggggctaagaacgatcctcttatccaactttctgtctatcccaaaaccgaaccttgctcctgcttctacttgaccggtgcttgcttattattggcattagttagtagcctagctagcgcccttctgtgttattaagcatatcttgcaaacctactgaatgttgaatctcgatcgatgtcaaaaaccaaccgtagaaagagaggtcgaagcacctgatcactcattcaactcgtttttcgctcatgcctgtatggaatgcataagtcattgcgttttggtggtggagttcgctctgccgcgtaagatcctcgaatcaaccactgccactgtcttttgtctttttttcgttctcttccctatgctctcccttggcccagggagagatgtaacaaactcaaatttttagggaaaaaattttgcgaaatattttaagacttgatcttctcgattcttatgttgagcgaccttgctttcttttagtctcttttactttagatctaaattttatttgcgaagttaaaagatctcttttaaatttcataaaatccttaatttattctctaattcgtttatttcaaattttacaaaacctctctatttactttctttaatctctaactttggctatagattataattcctttgaatccttacccaaatatctccaacatccaaaaataccttttctatcctcacctaactatccccagagtacatgaaatatcactcttcaaccatccctagagtacataaaatagcgattgccactttccctagaaccaatactttccctttggatctctacccaaatattcccagattccatgagatatccttttcaatctccttgagtcaatatacctatcctttggagcttaccaacctaccaccaattacaatcctatagaaattcctatgattccccatttaaaattatttctaatcccttctattcaaaatccaacttcctttagccacaactatttcaccgagaatccataccacatatttggaggccaaaatcctagtcatttgcctccatctatttttaccatcatcccaaaatttatccaaagctagaaggttaatcatttgtatttctttcccttcctattcaaccatttcaatttttaaacttttaaaatattagagaaaatcttttgtgacaagttttacatttggttcttattgaattttataaaattggagcatttcgatccttttttcaaataaatatctttgattttattttaaaaatatttcaactccttttgcttcaaaaaacttatatttaaattccttttataaagttcaaaagaccctcaagcatttgtgttttagattttatctcttttaaaatttatttaaaacccgccattcaaaattcccctagttttcaattccttaaattctatttaaattccttgtccaaagttcaaaaggttcacaaatatcttcctttagaatttttcccctttgaattctagtcaaattcaaaaagttcacaaacattcttcctatagatttcatctcctttgaattccattcaaaatcctctaaacaaaaattcccaaaggttcctattcaaatcgggccgaaattccttctcccatcggcccatttcccacctcagcccaagccgagccagccccagctgagccgcctccttcctcttccctgtgggcgcgcgtggcgcacacgccaccatcactatggctttgcgccaccgtcgccgtcgtgtggatattatgaataacccatacccacagggcatgtatatctgactgggtataggggtaccatatgtagatataatatctttaaaggactcggattaatttcctaacttgtgtatcaaggaaatacccgaggatcttagtcggttacgattgtaatttatctttacctacctattccgttaggaatatgggctgtaccctgtaatacggactcctccccttatataaggaggggttcgggtgcctcttgcggcataacttttctcccagatcatacgatcaataacatactcggcggatcaatccccggacaggagtagggtattacttctcattgagagggcatgaaactgtataaatctcttgtctctaaacccatccacttttcctgcttgatagccacccctttttgtattgccgaaatcttgtttcgacagttggcgcgccaggtaggggtagcgtcaagcttttcgccgatcagtgcgatggtgatacgacccgaccaaggccattcacacataatgtgattgttgcacatcaatgcaaggataacgctatgcttaactccaagtcttattgttttcatcaggaaaggctgctacttggcttgtatgattgtaggttaaagcatatcgttgtgcttaaagagagagacttaactcagattaccaccactacaccaaggcaacgtaatcgtgcactacccttgctatcatatgaacgtaaaccaacaattggattagtgccaccattgcaaggaccaactacgctaagccatgttgtgactccatcaccaagagattgtgctgagcaaagatggagtgcacaacatcattcaataaaaacacgacaaaaggttaattcatttcttgctaaattgaactttagtattgatgataattttatactatctaaatggtgtatatttgctttgctaaggttcataccaaaggagatggtcactactacaaatatcaatgactacatcaatgggggtnnggnttccacagaagatgaagtgacatttgctcaagtggagatggtttacgacaacgagcagactggttacacgcagatgctccaacttccaagggatgtgcgatccagccagtcaaatttctccatgcataatatatatggttacaaagataattaagtctagtttcacctccaacaaatggctcgtcatttcgacttcccaataaggagttatgaacaaatcattgaggactgctcagaagccaaacagacgcgtgagtcttctcggaaattcacttattgtgacctttgagatagcctatgtcctgtaaactcccaagacctttcattcccatctaggagggttgttcctagtataaatatcccttatgttttatcatttggaagacttttgagaatcaaaatacaaacccctttgttcagctgtgtgctaacaaacaccgagagatagagatctctacccctttgctcttgtgaattcctcgtgggattacatagcggccgcttcatcggcacccaatctgtgctcctgctacttcgtgtgcaggctgcttaggttggttctttgagagtgtgattgggcgaatccttggttcaggctgccgtatagagacggtggttggctccttgtgcgtgtcgtcaggttgcattagttatccggctgctcgcagctagttatcttggctgattttcagctagttatcttgttcaagatcctacatcctgaagatcaggacaacatccatatcatctggtatcaaagctttcgttgtcacggtaggattttttatccctagctacatatatttgttttcttcctatccagaaaaagactacaagtaaaattttccgtagcctttgtttgcatctgttattgtagtgagtttggttaagtttcagttcattagagtctttgtttagttgctgatctattttccttcgcgtgtcctttgagccgatctattgttgtctctaagaaaatccctacaaaaaaaatagtagtaaaccatatctatcctttgcgtataccttgatcctattatgttctaattgctgattttatatttttggtttggtctatcatttgtgtaagtgttatacatgttatagtgttgtctttggtgaaaagaaaaaaaaagttgcaaaaaaaagggacttgagaaaagattgaagaaaaaaaaaagaaggaaaagtgaatagataaaaaagaacagaggtgaaaaaaaattgtgagaagagaaaggtgaaaagaacaatctgttggtgttatatgtgctgaaccgtttatgccaccttgcaaaatcagccgttatctacctttggtgcaaattttgctagatctgaaacgtaaatcatccatccctagtgtaatcctttgttttgcatcaaaatatcctatgtttctttgtgcgtgagtttgtgtttctattccaaacattttggatcagcactaggcattgatatctagtttggattgctacttagctttacaacaactagaattcagattgctccttgtgctttatcccctaccaagctccacataaaagccatcgtgtacggtttactggtcttgtattcgctcaattatcactttcactttaccaccacacggattgccttagtaacctcataagagcttcggttggtaagagaaggtgaggttgtgagagtttccacatactatcatattccacatatattttgctacttgttttactaaccatggcagggagaatgtatattcatcttccattttatggaagcgctgatccagaggagtattttggatgggtaaatcaaatggagattgaacttgaagcccaatgtttttgtgaagagaagaaattgcagcgtgctactctcgagttgaaggttatgcctatacttggtggaagaaattttctcacaagcagtatgtgaagtgttgggaagatttgaagaaagtgatgagaaaggaatttattccaaaagagtacgagttgtttttactttgttgtttgaagcatgtgaagcaaggaaccaaatctgtccaagcatattatgatgagttgagttcttgcttgtgccgagcaaatgccattgatgatctagatgcaattgagtattttaagagaggtctcagtcctaaaattgctactgcaattgagggaagatatgcaagaagtgttcgaggtttcttgatctatgccattaaagaggagaagaaagtaaagaagttgcaagaggggct

SEQ ID NO: 76118 - DNA, 11383 bp, Oryza sativa
ttgatgccccttgttatgctgatttggagatgcaacaaaacccaagtgagaatgagagccacatagccaaattgagtgaaagagataaaaagagtgtgttgtctgattccaccaaatatgaggttgagagcatccacaatgagagtgagagaaatacaccacacaaaaagagaggattagagtgcaaagcatgtgaggatgtttttgattctaacaaacttatctccacttttagtgttgtctctcctaatgttcaggtttgcaaagaaaaagatgaagagatagttgtcaacccgatgaaatgtcaagaagataaaagaattgagaagatagaccttatggagaattacccaactactgccctgagtattaaccatgatgataagggaggtaaaaattcagaaacgacacccacattcgatacgtctccacaagagctgaaaggtaacaaagacgaatcatatttctgcaagcatgaagagttggtgagtgaatttgttgatacacttgatcaacgtgatattttaattgcaaataaatttgatcttgtggaactgattactcatgatgaagtctttacaaaaatattgcctgttgaaattttgtgttatatcatcctcgataaacatgttgaaatacacgatatgcttgagaaagtttctgaaatagcttcgctgaaatctttgaatagtattcatgtatgcaagtatacttttaatttgattggtggatatgctgaaaataaattctatatgtgtgctatttgcattacttgtgacaagcttgctgatttgaggttaaaattagtgaataatcatgcttttgaaccttcttatgctcagcgtaagttgaacaaaatgtttggtgcttgttgtttggaaccatttatgtcaccgacatgtgcatatttttcttctgagacactaaaacataatggtagaaatgatgattctttgaaaattttctcatccatgcttgaaatggttggctttgaaactaatgaatttgattgctcgaatatgttgcatgatacaaaatcttggaatgcagatttggtcgatgatgatagggatgaccgtcgggtggcaatacgcactgctcctttcaccgatatccaccggcaagacacgaggcgccgtgcacaactccttcccccctcctcccaaaaaaaaaagacgtgaatattagggaaggacctaatatcaaataattagaaggggtaaggcttcgaacccagttcgtccagcccaccaccttgtggagctagctggtagacctctgggtgtttctccacaactccttccccgacctcatcctccgtacagcgttgcctcgttgcacgctactcgcaccgcccctcatcgacgggtagtcctccttgctcattcaagagaaaagaagaagagggagagagaaatcccaaccatcaatgacgccacgtcgggctcatagctccatcgatacaaccattgcgcggcttcaatccatcgccgccctggccgatgattgtcgccagtcatcgaccacgccgtcgctactacttcgctgcccatttctagggttgaggagagaggatggggaatgaaggtagggacaaaattgtactctcacatcatcacatcattaattttatctctccgattcatccggcaataataaaataaggccgtgggtgtccagcagctaattaccagtcttttgtgatgtccgacagcatatatatattcttgcgatgtccactagctaattacacgtttttttgaatatcttgtagcaaattttacctttttaatttgggatgaatttatcacgacttgacatcccatgcccacatccaatgtgctctccttctcgtacacctgaacaagaatggaaagtggccaacaacgttcgcatgccatctcaacatatcttctccatgtatcagtgcaatccataggcataagctcccaaaaataacctacaagttgacggttaaccaaaacataaagtactataaggccatgggtctgtggattgattttaaagcctctcatcagccagttgcatacacccccggaactcctttcgacaactctatcaatgcccttagtcatactcttgaactcgaacatatctacctcattctgaccatatctaatgttgccttcactgtaatacaagtcgaatatcagcttacttaacatatctgctcacagattaaagtctcgttataatatattaaaataaacgcaattgctatctgtgttgctaaatgtataagtacctaaatatgtcataaggttactacagcatacatacgtactagatctacacccctagcattggatgttattactaacataggatttctatacaaattaataagttgctaaaatattgtccctactcaaacttgcaatgcattgaaatggtaatggaaaaaaaattacctccaatcgagtgtgcgatccggcagggctctgctgcttccttcttaaccttccccttacccctctttcttttttttcttgatttttatgaataaatgagaattttcaagaggaagggagggttttatatagggctgtcaaaaaagctcgaggctcgcgagctgctcgagctcggctcgtccctaagctcgcgagctttttttcgagctgagctcgagtttctaacgagcctagtaatatatgatttttgttgttatttaataaattaggagatcaaatatgttatttgtatgccttatattgacatcatatatttattttattcttttttcctcttctattaatatgatgaactagaaattaattattttttaaagattatctttgaaatatatattgttttccttgaaaatcaagctcggtagtcgagctcgagcttggtcgagctcgagcttggtcgagctcgagccgagcctgtcggaaagctcgaacattttataggctcggctcaagctcgactcgagcttgtattgagctcgagcctaggcagacgagctcgctcgagctcggctcgttgacaaccctagttttataggtgcggggagggggggttgaaaaatcaccctccccttgggcggggaatggccggtcccctggccgggagggggcgtcgagaaattttgcagtggtctcctcgcggtgataaatcgccctagcgtagggcgagaaggggccgcttgcaaaaatatcacggcgcgcccctctccgcggccgccatgtcactcttagccaccgtcccctaggaaaatttatatgccccgccctacgggtggagtatagttttgtaaaatttaaaatggaaatttaattttgtaaatcttttcaaaaataaataaataaattcttttaatttcaatgtctgtttagttttgggccggaacaccacccgtttgggccgaaaatccagcccgtctcccaccatcgcagcaaccgacgaagttctcgcctccccccaacacgcgtggccacctccgcggcgcctcgtgtcatcccccacctcctcgcctctcctcctcgtcgtcgtcggcggcgggccggagccacatgggccagaccctgcgcggcgccgcggggcgcgtgagggccccacccaccccggcgccccctcgtcctcatcaccttccgcctgcgccgccgtcgccggcgggcgctggcggcgcggcggcacaggatcgtctccgtgtcttccaggatggtacggcttccttgctgctcgcatttcgttcggttcttagacgccgtagcttgctcttctaggcagaaaaaatgctccctctgaatgatcgctacagagagcgggatgctttgatttgctctacactactacttatcaaagatttctcatctgctctaacttgcgtccaggcaaattagttcgttcttgagaggcctcgcaccttgtaatcttgctaagggaggggaggaggagggaggtgctagggggggggattaaggtgctagtgggacatgatgttgattataagctcgaacaatatggccctggttttgattcttgattatcttcggtcatgatgtgcttagggatgtcgtctgcgtgttgttcgattgaatttaggtattgttttgtctaatgtaatgtttttgttgcagatttcgtgaaatcgggtactgatcccatttgggaagcatatcctcctgggctctctatcgggtctcttaataattgatagatcggtagatatttcagtattacaaccaattatgttgagttaagaacatacaattcctatccatcccaagctagttccgaaattagtctcccaagtaagctcgtcaccagtgcatgctaatgaagagttatatataattttgataactcatgtgggatgtttactggaagtagcacagtttccagttagacagcttatttccagctgagagtgatgagggacgagggtcaatgttcctccacaaatcattaccgcagcttgctcatcacattattatcttaatattttagaaaaagaagttgttgtatcttggtgggttttactgctaagcactcagcttccagtcaatttgtggccctccagccaagtaaaaggattgctcaaccgtcacaatgtagcacttttgtgaactgagacctgaatatgttttagaatcatagattcagctagggtttactatcagaaattcatattcctttctaggattattcatattctttctaggattaactgtctggtgggtcatttgtttgggttgagcctgtgtatcagaattttaattgatggataggtgacttctccaacacaatataggcagcccacaatatatgggttctaaatccttgggttcaattagggtttattgagggttattttcaagagaactgaaggatacttgaacgttctcaagtcctcagcacaagcttgattgagatttaccaaaacattttacatggttgtaggtttcagattgctgtggccactattttgctttgtagtttatgatttttaaagaaatggactgcagatgtcacaacacaaccaaaagatgcccctggtgtacttaaggagcgtgatccaagttatgatgagatgcttaagcacatggttgggagaatcactacaaagcctggaggaaagccagaaatgggtgaagtaagccctctaacttcagttgttcccccatgctgaaattatgctgtttccctggtgtttttatctcattacatgaatcggtaaataaccaaacctaaagaatcaggttgtttagtttgaacgtaatcaaatgtcggaggatggatacatcatacatgctacagcgcttacatctgaaccatgagaattttctccttttatttgaaacatcattgctgacattacttgcttttcctggtaaccattgtatggggaaaaattggaatactttagcctgaaaatattgttgtaacaatatcagtgttcatggggaataaataagtttcattatgtactctgtacttgaatatccaaattttctttgcattgccatactaattcaggttgttatccttgtaggctttcgtcgtagatcagtacaacaggccactcccaagggttagaacatccagacctgaacccggggaaggcggacacagacaactacctccaggaaccattagcgtcgctcatgtccatgaaatcatccaactgtaccaaggaaagtccagtaaccaccctggcccaatgagcgtggacaagattgcctcaaagttcagagtcgaagcctcagtggttcaaaacatcgtgcagttcgtctcacttccgcaggaagaacatgttaccaagaaagaggaatactgagagtctataggatatagcgatcttgcaggctgtctaacacaattcctttgttcatgtttccgagtttgttctgtggtggactactgggaacacaatgtttcgtagcttaggttctttcttcttgttgttgctgctgctgctgagatagtgagatgagatgatgatggaactggaaatatatatgctgtatgaataaaggtgaaggacgtgttttggccccttgatgctcaggatgagcatagctgcataggttgttaacttgttgtatgctcttttgtcaggttgacatctgctacatcttggaaacatcattaattggctgtgtactgagaaaaacaccaaacgtaaatccagactttttaggtgcgttattcattttcgtctttttatttttacccagccatgtcttgatgaatgcaactaccaaatgaattttcataggaatttctttacatactggtagcttgcaatttcaggcctttcttggaatagcagaattgaatttaaggcccttttggattgaaggatttcttttttaaaaaaaacttggaggaattcagtccttaggaaaatcttcttataagcatctttggtacaaataaatatcattcgcaaaaatcctctggatttgcttcatatgattcaattccataggaaacaaagcataagcttatacctcgtgtctttattttcctagtgcaaaccatctaaactgacattgattttctcatgaagatatagattttacctcggtttccgttagcatgtttttcaaactactaaatggtacgttctgtgcgaaaactttctatataaaagttgattaaaaatattaaatatatccatttgtcaagtttgtaataattaaaacttaatcaatcatgtgttaatagcttttttattttacttgcactaacttaattttcatcttcatgagtttccaacaccaccatagcataacatccgttattcatattcatagagaaggaaattatgagataatcaacatccaagagagtttgaacatagggcgatgtgttgctcctggtagctacctactagctaggctatgccatgttttttaagattaaattgcacccacggtacaccaacttagcaggtgggtgcgatatagtgcaagaacttgagaattgaacgtccgggtgcaacaacttgacaagtgggtgctttctagtacaagaacttacaatttagtattttggtgaatcaatttggttaagcatatgctaggtgaggtttttcacgatgtcaatatgccaatacacagtaatcctatagatattacattataatattgaatgtaatctttaagaattatattgcacatacaatttacatatacagttacctttaagaattttttgttttcttcaccttctcaaatatcaaccgaaatataataatttctacatccagtttaattgactcagttattagttattagagttattagttattaggataaaaatataaatatgtttatacaaatccacgctagtatattgtcaagtacttaaaaatttgaatttatataaaaaatgctccaaataattaagttgtcacaacttcttaatttattgtatcaaaatcgtagctaccttgcaagttgtttcatttatacgatcatcacttataaagttattatactaaattgcacattcttgccaagttgttgcactagaaggctcatttttcaagttattacaccaaattgcacccacctgctaagttgttgcaccgtgggtgcaatttactcttcttttaatataacgtgaagtggaaaaagcacatgaattcaaacacataagagctatgttttttttatcacatgaagattttgaagacagatagatatgaaacaaaacgactttccattaagctaaaactagatgttttctttcctatagaaatagaggaattgccacctctccgaaggaatcaaactgttccactcctttgtcccaatcctaatctgaaactccaaacgattgcacgcctccaaaatttcttgaaaaaatattcgttccaaatagcgtagtgctcccttcgtcccataaaaaaccatataatattttctgatacaatgaatttgggcatacccctattgagatttactatactaggaaatggcacatctcattttaagttggttttttatgaaacggagaaagtatgtaggattaggaacccaaaagggtgtgaatgacatcatattcctatgtttaatcaacttgaagttggttgcaaaccctttcatcaatcaaaagagaaaaaaaaaaagggaaattggggtgaaaaaacaattaggcaaggaatccctctcccaagccgtaggatcacctctcgcacgaatcacgaggcgcatctctccaaagcctccggctccactccaactcctctcgcctccgcggctccgcccatttcgcgggtcgccggagcagcagcagccgccgcgccagatctcgaaccttctagaagcttccgcccgcttccacccatctcccccgagggcgcctggatcccgaaccttctaggcgtcggcggccggggaaggcgcgaggggaggcggaccacgggatctgcttcgaagcccctcgcctcctctggaaccttccgggcgcggcgcggcgggatggcggtgagtttccttcctccgcgctgcgagttacccggatcggcttagacgatgcaatttctaggcgagttaaccagggattcctcaaattgttggtggcttgctgctgctggtctcttcgaccattgaacccgcagttcctgcgagttgatgatttggttttggttcccctcctgggcatgtgtgctgcaattagaactcagaaatttgtagagatggtggaggattggtggtatttgttcaaggcaaatcttagctacagagcatgccactgtttgaccagaatgtgtgtttacctgtcacgcaagcttggtatttgtagcatttctgttcatgttgctatctaggcgtgtagaatccatgaattcagtattatttgaaagtcatttgctggcattcaggagagtttgaatttcttttttctctttctttttaaaccatgaatgatgtgtgttctcttataaccttttcacgtttcatgtcactagagtgcaaaagtgtcgcaccccgttaaatcggcctccgaggagtccaaagtactcgtggtggagaatgggaagatggttgatgttcaggacaaggaaatcaccatggaaggcctctgttccataagttcttatgaccagtgggcacggatccctgtttctggaccgcttccgaaacctcgctacaaggtcctcctttttttacttgcatgatctctaaattccgtctagtctgttgtgctgccatcgtcttctcttggtggttttgacatgctgcacttatcttctacagcatgcagctgctgtggttcaggaaaagatgtatgtttttggtggaaatcacaatggccgttaccttggtgacatgcaggtatattagtcggtcattatacttaatatgtttttttcttgtgatggattcttggtataaactttaaaatagactcaaaattccttatttgcttattaatagaggttaattgtgcaagttcctaactttactctcgagcgttgagaatgatatgcatctcaacaatagtatcttcctttggttgaaggttctggatttcaaatgtttatcatggtcgaagctagaagctaaaatacaatcagaagaaccttcagacttgactggaacagcttcgcttcctccttgtgctggtcatgcactggtaatcaccagatactctttatagtcaagttgagcggaactggattttctcccagatagatataactgtgtagcgtatttccttctggcatttaatctccgcaggttccatggggaaacaagatcctctgtcttgcaggacacacaagggaacctacagaaagtctcagtggttagcctaatattttgctcctttttttctaatcttattttttttgtgcgagttatatttcttatataaaataacatatttatgtcagttaaggagtttgatccacaaacttgcacctggtcaaccttgcgcacttatggcagatcaccggtaccttttttttaatctatttatattgtcagaaagcttctaaagtactcgctgctttttttttttttgtctaagaatatgtggcggtaatcttccttttgctttagagctcatgcggtggccaatcagtgactcttgttggaggcacattagtagtgtttggaggtgaaggtgatgggagatcccttctgaatgacctgcacgttcttgatctcgagaccatgacttgggatgaatttgagaccacgtaagttttgtgattgaagcatgtttttcagttgttgtaaagtgaacaaatgacaatatatttttttaaaaaaaaaagtgatcaaaatgtttatggtccttaatattaggattctgctgaatgacctgaattttgtaactcgtgtgaaaatgctattgcaggcgtactccacaagttatatatttttaggcattaattatgaaatcattcttctagtaaattcattaccaagttccttgaggtgcagagctgatatctgactattttaaactgtactgtaattttccagaggcacacccccttctccaaggtcagagcatgctgctgcgtgctatgctgatcgttatctcttgatatttggcgggggttctcattctacatgtttcagtgatctacatctccttgacatgcagacggtgagaattgaatcttttctttagagctggtattcactactttaggaagtccaaataaatggttatctgctaattgcagatggaatggtcaagaccagaacatcagggtattactcccgaaccaagagcagggcatgcaggtgttacggttggtgagaactggtttattactggaggtggtaataacaagaaaggtaaggatgaaaatccagcacctaccttatactacgattatgacttccaaaacaattgagcttattcaatttccatggttttatcacccttgagtgtagctccttatccatttacagatgatatatttgttatatcttttcttgatagtttttgagcttttctttagaaaaagaaaagtagctcacgaaacagttttcgctcacatgtgcttaatcggctaatcatgatgcactgcaggtgtcccagaaacacttgtacttaacatgtcaacatttgtatggtcagtcgttactggtcttgaaggccgtgcacccccaacaagtgaggtgagctctttatgtaactgggttctcctagtaaataaatgggagcatcatctttgttctgcatatttactctgaatcatctgatagtttgggtgaaaagttttgttggatcttgtattcaaacattgaagttcatattattctaaccaatgacatatttgtaacccttgttaattgcatttctttcatgttatgctcccatgctgttggtgatattgaaatgctgttgtacatcagggctcaagtttagtgctgcccaaagt

SEQ ID NO: 76119 - DNA, 1971 bp, Oryza sativa
cccctggcaactaaatgaacctgaaacaaatggattggcctctgtggcagaaaattctagcagaggggtcatatttgaaattgaagaacttcaagatgaaaaggtaatggtagggtgcagaacttcagttttttttccaaatatttttagaagcatgactacttgaaacttgtttaagacatcgaaagtccctagtgcatatgttttgattattgttttttttgtttttatattcatagaaaatactaaaaatataactaattgactactgacgtcattttcatctcaaatcttaatcagttaatattccaaggcttgagtgcacacatcctaaaatgacgtccgtttaagaatggagggaataactcccaagacctgttcatgcacaacttatgtgttcttaatcactcagacttatatgttcttaatctttcagactattaagagggcagatacaagcaaaactttgttgcaagcagttaagggtgagaagagtcatatagaagaaaaacttaaccaggaagagctgcagagttccagactgaagcaggaattagctaacgtggagacaaaaaatgtggaacttaccaaggcaagctgaattgtttttatagaattgtgcaggaaatgtgatgcttttttctttcattttactatcagaagttatgtctctacctatttcttatgcatgggctacaattttccatttaagttcatttgatatttaaggctcaattgtatgcaattcagaaaaatatttatcaaagcaatgtatgatgtacctcagtgaaatttgttgctctaggctgctatttcagttgtgtttatcaagattctgtcattgagtgcattcaatgttgaaacctcaatgtgctaaacttcacagcatatcactttggaaatactagaatatagatcgaatagaagatactacctctgctagtgtaggtgctctctgcggaggaagaaacatgctttagtctctatgctatcaagtttaattgctgtgctctctgttatgcaggaacttgacttagtccgcaatcaactttctgctgaagaagcaagggcgtcgcaacttgaggtaggtaaaaagaatttagggaatgaacacatgttcaagcattcagtgaattgttcagatcagaaaatagggtttgattttacatctatactcattttcttatgaaaagctatgaatggtgtgcaacaacttagggtggattcagcattattgttccttgaagacacgttttcttaatgataaaaggaaaacaaacaccttttgcatggattggaacaaagctcattgacaaattaaatcggaaaccagcttaacatgcggcctaaccagaaacgagaaaggcaaactgtttatccctgtacataattggaacctgtacttgccatttagcttatctagctagtacctttatttttttaaaaaaaatggtacacaataaattaaaaagtgacatactttttttactattttatttatgtccatgggctgattctgttgttttcagataacattgttcatttacaccctttacgttgcagccttgaaatgtcatagtttaacctttcacgtcctactactcccatggggatatagatgcaacgataagaatcttttgtttccaaatgccagaacgaaatttcggatcttcaacaaaggctgcagaagatggagaccctggaaaaggagtccgaatcgcttcggcttgaaaaggatgcagagtccgacgattcatcttcaggcagcaaccagcggcctgctgataagggcttctggaggtggaatggataaaaattcatcgatacaggtagtagcatactagcattggatgtatggaggatatttcctgcagagttgcacattctttcaatttttgcccatttcttttttcccctggagagcccagtattcacaagtagatcaaatatcgaaaaatgtttactcacaga

SEQ ID NO: 76120 - DNA, 682 bp, Oryza sativa
ccgtctgttaatgttataaataagtcatacccaataatcttgggttagtctctgcgggacccaccatatacccagttctatacggaatcatacattatatacggaagatattttggataaggaaggggaagtaaagttctactcgggcactataaggactactcggatcatattcatactttgtctctctagttctatttggacaagggggcacctgagggtataaatacatgaccccctagaaggagatgagagatggcaagccagaagatagatctagaacaaatctacacaagccaatacagatttagagaatccaagacaagccaacatatatacaccagaacaagcctagacaaatccaatctgaagctacaaaggcaaacatgagggatctagagctacctccaatctcaccgagttcacattcgaagaaaaagactacactagctgttggctgcatgtaagggtgcaatgccgctatgctaacaaggattggattaagtcatccaattattgtactaatgagatattgatatataaaggtaactctggatttggctaatatgagtagggctattacttgtcagttaagggggccgaaactatatataaattcttgcctattgtctcttttaccctaatatcgcgtacaccctgataccgacgaacaccataccct

SEQ ID NO: 76121 - DNA, 576 bp, Oryza sativa
gcgtgcatggttttagatgccgcgaaaattttttagttagactttgctttacgctggtgcattcatttgtgggctggcagatctctttagcagctgccagccggtttatgctagctgacatttaaaaggtttgcctaaaaaatatagtattttttatgcggacctcttaatgtgacactgacggactcgtgacccccgaattttctacgccggcgtttttttctcgtagccgccaaaaaaaatattttctagacgccattaaaaatcgtttttctagcagtgatatggggccgttccagtacaacccgtcccgacccgccctgttaccatccctaccgggtcagtcgcccgacctgcttggtaggtgaatccgccactgcgaattaggtgagcccacacgcgttctttgaacattcctatggtacatcagtgcatatgtacctggtgtatatatataagtcattgggataagattgatcacacaagctatcttctgcaaagagcacgcagagcgacccgtgcctactgccttgcctacaaggggggtaccgagctcgaggtcgccaatagataagg

SEQ ID NO: 76122 - DNA, 541 bp, Oryza sativa
cccctccttacaaaaatcttgactaaacccgaaacccgaactaaactatcaactcaatagctctaaaaagcactaccgggaagcctcacgctccctatctatttatacatgaggcaggctgcctaaagccacgaaccaaactcatactagaagtgctaatccgcataggaaacctcatcgtacaagaaacaaactttacataaccaatcataccaaatttggactccttccaaattcgagtctgcatcccatacacacacaatacctgcatcgtatgcaatatggaatcttcaccaaccacgtgcattgaactctagcctaagtatcccgcatgatatctgaccatcgcggacattgcctttccacgaagtcgactcccgatccatcgccggcaatactatcccgaggcatcaagtcacctacacatgaaacaaataaagaaaccatattccgagaccaagctatctccaacttgactcattagtagcaaacaactgtattacatacgcatagtatccatctagaagccataatcatgaaa

SEQ ID NO: 76123 - DNA, 558 bp, Oryza sativa
ggcgaattcgagctcggtacccaatgggtacagtcaaaaacataattggttaccttggtaaggatgggaaaggcacattattagactcaagtccagaatcactaattgtcccaacaacggcactttaaaatcatatattacacattagttaagttgctgcagcctaggagcaataaaaggttaacaaagtggaaagtggaagatagaaatttcaccttgataggctacccaagatttgacttgacatagcagtaggatcaatgttttcagtggcaacagtggcagcagaagtagattttggttttgatttccttttcagttttctacaggaaaatgaaaataagtgaagtttgttggcaaaggaaatcaacatgaagatatggatatagaaatcacctttgttttgccactaaagcataggcctctttggcttctggatctgcttctttgcaacttgtccatctatggccataatttttgcagataggacacttttgctgacatttggtacctgcttttctcttgcccttcttattcccctcaaccccacctttgtgc

SEQ ID NO: 76124 - DNA, 561 bp, Oryza sativa
ctttcttatcatccttcgtggctgcacagttctttctccttgccaagatttaaccgttccttaccaggagctaatcaattttttaccagttatagcatcattttttatgttgggttttgtgagtctaatcgctttaggctttgtttctcccgcctgtaccctctggcccggctattctaatagtttttttctggccagatgtgtacctctgtaccctcgatactcggcccctcgacatgtcaccatgcgcctcaataccgtctcggtacctcgtaatggagctgtgacagtacccctcacgccactctttccacccttcgcccgttcctggatcatttcacccccttatgttcacggcatggactcccccgtgacccccatttgctttctccgccacttctctgtctggtgctccaccatgagccctgctatacgccaggtttagccgttgcccacgctggcttgtggttggtgcggttcatgtttctctaccttaactcgtgacccggtcttttttttctttggggtccggctcgtttcccttattgtgtgtttttcacc

SEQ ID NO: 76125 - DNA, 908 bp, Oryza sativa
tggtcttctgttgtgaagatataacaatgccatagcctggacaagtgttttcatgtatcagaacatggtagtaattattttattggtggcctggatggttagaaatatgataattgataaggattgcagtaaaaatgtcccagctatattctgcttctcatcccatataagtggtgccacctagccatcctcccagtagtatttaactatgatctagtgaatagtgataattacaaaaaggaatagctacataaagccaacattatgtttgaatgttggaatctttagtaccatgatgtgaaccaggctactggaattttggagtgtatcttcatatcttgaggtctagtcctatttttcattttatgtttgttatacagagtgcaagaacaagcgtcctcgaagaaccatcaagccagcagcgaggaatgtttcgaaaagtgcattgccttccggtcttgatgccctaaacccaaatagaagaacgcttcgcactgcatcaagcaacagggacaaaaagaataaagacaaattggatactgagatttttgaattatatctggagtatgtcctctctctctctctctctctctctctctctctctctctctctctctctctctctcttctgtgcgtgcattagtttctcttcttatttacttcataactttgtgaatagggatctttggaaggacattgatgaagaaaagaggagtgcttatgcatactttgactcattgtggtttcacatgtacactagcggacataataaatcaaatgtccttaaatggattaaggctaagaaagtattttcaagacaatatgttttcgttcctattgttatatggtaagttgcttcactaccagtaaccctatggtttattaatttcattatcaaatatattcaa

SEQ ID NO: 76126 - DNA, 822 bp, Oryza sativa
taattttgggatgaatttatcaggacgtgacaaatccaccccccttacaagaatctcgtccccgagattcgaggaggctagcaagaagataggttgggcggtcttctcttcttgtctgacttcttccgtcgcgtcttctataacgaacttgcctagcaaaacttctccactctggactgcttggctcgatctcctgttatagatggaatcgtctcttcacctgacttttccctggttgcacctctagctgacttcgactgggctgcggcattggaagatggggcttcagttccagaacttcttataactcatatctttggagtcaacctcatacaggttaccacttcatgttatgcgtcaacactagcttgtcattactaggataccatgtttgtcatcataagaatatcatgcttgtcatttacttctaacttgccaccaactgcctcatattagctttcctgctctccgggtgctagctacttctgctattcgatgcaagggtcggtaactttgcctttgaattatgtttctaaaaagaaccaacttatcccacttgacatgctttgacgtcttcccaaatggctttactgctggacttcttattgtctgatcgttatcctgtcaaatctgaagcttcgtttgtagatgtgattttaatctgacctctatagactatcttcgaacatatcacttggttcataactgggaatagctctcatgaacaagcaactccgattcactttctttatgttcagtttactttccactattctcttcatgttgtcatcatttagcattcaaagtattcctttacacatt

SEQ ID NO: 76127 - DNA, 538 bp, Oryza sativa
tgagtgcgctgcgcgcgcaccatggcatcgccggacttcccggtgaggccggaaggtggcgaacccgcggcagaaggcgaggggaagaggatggcggtggcccacttggcggcgcggacggttcgttggttggtgcgggattcgctgctcccgatgcggcgacgccgctacgcggggcggcggcgcagccccgtcgcccgatgtggaggcgcgtcttgaggagacatagccggggaaggtgagaagaaagaaagagaaaaagatgagcgaagaagatgatgaggagaggagcttatgggtggtgagtggtgaccccattgccatgatggaccaacccttcgatttcaattattctgagagtttttacttgttgagcgacggtgggggtaaaattgaattgataatgatttgtttagatggtgaatcagaatttttttctctacaaaaatcaggtgaaatttctgctctctcatcacttgtccatcttcgcaacttcaaaatgcaagattgaatctggatgatatcaggaacccaaaag

SEQ ID NO: 76128 - DNA, 535 bp, Oryza sativa
ggaccgccgccagccgttgttgccgcctccaccgggccaccgccgaggtcggccgcctcccctccggctggattcggcggaggggagggcgcggccgccacaagccgctgccgcctccaccgggccaccaccgaggtccgccgcctcccctccagccggatctggcggaggggagggcatgtccgtcgccagccgctgccgccacaaccgggtgaccgccactgctgcctccgccgagccgccgtcgccaccgccaccgccgctcccacttccgccgggccaccgtcgagctgccgtcgagacgagagagagcgatagagggaggcgaaagagagagaacgatagaggtagagcaagagagagacagagagagcgagaacgatagataaggacgggcggaccgagagatgggtggaccgagatatggataaggccggctcggtggctcggctcggctaaggataggtgccggttttttaagaaaaccgtctcggctcattataggtgccagttttttaataaaaccgacacctat

SEQ ID NO: 76129 - DNA, 27737 bp, Oryza sativa
aacatgaaatcaattaaattatgcaagaaatttatattgctggcaatgctacatgttttaagaatttcattaagcgcatattccagtgttatctgtatcacggcatttctttgatatgcttgggtgcatctgtgcgtacggaaaaatgtacttcaaaatataaagaagtgcgcaagattgcatagagttgtgtacctcctcggtcactagtgctctagctctttgatgtctcgcaaccagttcggatagaactgcaacaaggcgctgcttcacttcacccgtcagcatccttccttccttgtactcctgatgagtttcagaaatgttagcggaaatcagttgaagaaaacatgttaaagaaacacatcaggcaaattagctctacgcctctacatatatagcataatttgtattaccttctttatgtgctcgagctcattgtcatcttcaaggaagaagttcaggtacttgattggaacatccacctgaacatcacaatcacaactgacattgatttaaggagaaaaataaaatacttttttctgaatctaaaaatacaaatacagaacttgagcattgcacatgcgttaaagtaatgaaagtgcctaaaaaggtaaaatttttgcatgtgttagtgtttgggggaaaaatattgatggcttcaataaatgacaaaagtacaaacgaaaaggaaaggtcctgaatgtatgaactgtgaattagcattcttcctatattcaaattatttttctttaatttacatgttgcatttcaaacaaatatatgtcaacagtgcataactcaggtaatcgggggaaagcatactttactaagtacacacgtttcacaattaacaataagttcaatataacaagaaaatgacttacatcaaggttagctccaagttttctatggagctcaattgagtcccggccacctgagaacgcatatttgttcacctggaaaaaatggtaaaataaatgacaggcccatgaaaagcagaaccataaggctacaggacgcttgacttaattgaagaccaaaatttgaatggcctcaggtaaaatataaaattgcagtagttttccactaaaatacaatgcttaaagcaaacctttgtctttatttctttagcactatctgtcacatatattgcagaatttggatcactggccgacatttttgtgttctccccctgtaaatggaaataagcagctcacataaatcaatgtcccaaatattatgctatctaaaataggaaataagaaaaataaatgctgagcaatggacatgagcgatgaacttggcgaatgaagatgcaatcttatcagacatagataaatgcaatataagaaaatagcaagttactaattaaccaggagctgtcaaacagcacaggaaaattaagtggaatttcacttaaaaaatcgtgattaattgcgattgccttttttttaactttactagtaataatgattctagtgacaaaacttgcaagaaaaatagataacccgtcctttcaactgaaatttcgtatgtaaacaatcgctttgctatcattgaaggactaacttcagattgaggtactgagcatgagctctgtattatgcctccattgttgaattccttttctatgctcattttacacttctatacagtgaagatattaagctataaacccatggtcctaaaaaaacgtacctgaagagcagggaaaaatctcgattcaattaatgatggtttctggtaaccaattcttggagcaacgtcccgggtcatcctgaaataaggatcctggaagaacaaatccaatgagcaactcaaatccaatgagcaactcaaacttgcataacagaacatgaacatctacaatagctacctaaaattaaagaaattacaagaataaatgtatcatggtctgattgatgtgttcctagacgaaatggcatgatagcagcatggaaaggcagccaaaccacaaattcacagggagaaatggaatcagggagcccagatatgtttatacctggtctattgcacatgggattaagcaccgtagttggtcattcccagagaagagatgtggaaatgaagaagggaatgatggaaccgcttgcacaggaggaaagctgacttttcctatatgatcctctggggtgaatccaaatattccaacaacctgtcgttcaagagtaaacaatatcagcaaaagacaatggttggatgcaaacaagcaagtaaccaagcgatccactgcccaaaatattgctagactaacttaaactgctcaccttattatatgtcacacatctggcaactttaaccatgttttcataaaaagcactgtaagaaaatgacagaggattacttttctatagaataaataaatctcaagaattacttgcttagcagaagaacagtcattaaattagtcataaatgaaagataaatcaagactacagttaagaagaaccttaccctccaacataattaaaatcagagaaaatgaaagtcctttcgacatcaaatccacaagcaatgatatcttttgcattttcacgggcaagccttttagtttcctcaacagtcaaattcttccataagaacttctcatcatcagttagctgtattactaggggcaccttgaaagcatcctgcagatatctgaaaagggatactgacagttaatcgacgttgtccaagcattctcacaattataaattagaattaagccaacaatgtaaaggttcatcaaacaagatattgcaacaaagtttggaagctacattcagactagaaagcataggaaacattacacaaagcagcatatctatgttatattgtttccgtgcaagatgtaaaagcatgtcttgttttaaaaaaatgtttaaataccgaattttctttcatgcaaggaacatggtaagatgaaatgttccggggtaacattcatcacacccgacctttcaactggtccggtaatctattgcatcgctctgctgattcaccacataaactacaataagcatatgaaaggttctaccaacactgaaaataggtaaagttcactaggtcatcccagcaaataacacataaaaggtttgtgcacatcaccaacaaacgcattatccaagattcggctgctctagccaaacatacaactactccctctcaatactgccgcggcattgcccagttatttatacaacaacacgagtgaatcaagaacattgcaggggacagcgagtattgcagattggaacaatcgcgcttacttggtgaacatgaaggggatgagatggccgaggtgcagcgcctccgacgagggccccctccccgtgtagaggtagaacttctcccccttctcgtacaaatccagtatctcgttcaaatccctgcacacacacacagagtgagggcgagcaagcaaaccaaaatccagtacttagaatcgggaaacaagcattaagctagggtttggagggcggcggcgggcgcacgcaccggtgggcgaagaagaggccgcggcggaggaagcggtgaggggggcgggcggtgaggcgggcgacgcgggcgacgagcgcgtcgtcgaggcgctggcagccgaactggtcgacgagcttgtcgtagtcgatcccgcctttccccgccgacacctcccacgggttcaccacctgctcctcctcctccccctcctcgttcgtggcatccacctcggtcacggcctccgctgccgctgccatggcgggatctcacgcctccggtcgccggggacgctgcggcggcggcggcggcggcgaggaggaggggattggagagggtgggagataaacctcgtgctctggctgacgtgtggggcccgctggtcagaggcgagggctttgatggtggtgtttcttgctacgcgggttcgggtttgggtctcgttttgtaacgggccggaaggatagtgaattcttcacaattttggcaaaattcaggggattgtagccaaaataatttttggtaatgataaaattttggtaagttaacagtatactaaaattggatttcttagtgtctgttcagattatagccagaataaaccttaccaaaattttagtatgtatttaccaaaatttggtaagaaactaaataaatgcacatatttgacaactctatctaaaaccggtatggtttgaaatggcatcaatctgaacaagccattatatatttatcaaattttggcaaaaactaaatgacttaaaaaaaaggtatagtttgaaatgacgttaatctgaacagcctcttaattcaatcgaattcataattattatgcccaggattgtatctgtaaatttgaggtgatattgaagaatgcaaaacataaagcactcaaatttgcgatgacaacgtatgtattctgagctatcccatcgactcttggtaagaatcgccagtgtgttctcttgacttaggaatatgagatgaaaggacaaaagatgataaaaattcacgtactagctgttgagggtgaactatactctttcgtaattttacttcaggtacatgtattaggttaactaggtgaaatcccacgcattgctgcaagattttagtatgataataataaataaaaataatgtgtaagatagctagacaacgtaagattacttaagttagcatggttcatgataatttaaatttaaaccgtatatagaatgatgatttaaatgtaaaagtaaggtgatatgattttatgaaagtagaaaagcattgagataatttataccatggattaatcatctaaaggctaaaaatcattgaggtaatatgaattaatgagagatgaaaagtagagagataatttgtaccatatattaatcatttaagcattaaaaataattgatgtaatatggcttaatgagagaagagagaaatatcattaactaagtgaggatgaactatataggtacatagtatattataaaaaataatgaagatatatattaaaatattatgtgaattatgtgggatgataatttagcatgcttgtattttaaaagctctaaaatttaataaattataaaattatagatattatagcatgtttacataatgtttaatttaatgattgttagtagaagataatgtggtatctttgcatgttaagttttaggagttagtgggttataactttataataagagacgatatagattttcttcttactcaagtttagggtctaattgaggaccgagcgtagctcggttggcacgttcgcagtggagcgaacggccggtcgcgagtaactcgcgggacctcacctcgacgggattttcccgtctttctttaggacggtccttcagggcagtctcgactagaaatagggcacacacgcgtgcgcgttcagtgagactacacgtttcccgtgcactgagacctactggtctccaatctctttcccagcgtgtgttaaggacgcacacacgcgtgcgcgttcagtgagactacacgttttccgtgcactgagacctactggtctccaatctcttttccagcagcgtgtgttaaggacgcgcacgcgtgtatgtgcgtgtgttgtggtgtgagtgtggtgtatgtgagtgtgcgttctgagctgtaccccttcttaaaaaaagtttagggcctaatttgtcgttatatatgacatccaggtcgttattcacagtatcatcgtttaaatcaagtaaattagttactcctattaacacttctttgccattaaatttaagatatttttatcggtattttggtacgtcatacatatatgagtcaatttttaaattcgtttgcttttcgaaatacatatccatatttgagtcggtttttaaaatcgttcacttctcttctctatctctactattataaaaattgatgttgtttttgctggtaatttgatacgtcatccgagtttgaatcggttttaattttatatttcggtattaacctctatgtctactactgaaaaagaacgagaaatttccttggtctgtaaaaatggtaaaagaaaaaaagaaaaagtccgactgtaaaaaaaagtccgactaaaaaggtaaaataaaaaagaaaaagtccgactaaaaagcgaaaaaaaaaagcttctgtcgtagtaaaaagacattttgtcgtaataaaaattgtccgactccggaaaaaaaaggaaaaaatctctcaccagtaaaaaaacaaaaagtccgtttggttttttttaccggttttttcccgactttttttttcacgcgaaagagttttttttcccacgcgctaaccttttggtttttttcgtctggtttttttattccgatctctgttcactgcacacctcccgagcacttttggtttttccgtcagttttttctgtcaccattttttctcccgtgcgcttttttttacttatccagttttttaatccgatccgttcgccgcatgcctcctgctgccgccatatcgatactgtgttttctcctccaatttgattgcaaaaatcgtttccccacccctccctcatcattctctccttgattttccctttcgattcacctttaatttgttggatttaatctccgtttaacatttgccgatgataaaggccatcttccccggtcgtttttatcccgagtttcacgctctgattttggaaaaaaaaggaaatagtagatcgagtggatcaaaaatcctcaaccaattttaggtgacaggccaccgtactagtacgggattatcttcgggaggttgaagatggtagtagacggtgcgagctgggcttacggctccctttgttctaggtcgaagggaagtaggccaaacgaagggaggtagtggactgacctaggctaaaaaggaaggaaggctttcgaccaacgcacgggtattttttctagtttagtaatacataagaaatcatataaaagaatctatttaacaaaactcgcatgctaaagagacgatcgaactcctaactacagctcatgattttctaaaaatatatatatatccaaacgaactctcatagtaaatttcattttaactaaaccatataacaataataatgtcgacgtttgatgtcgcgattctggtatttgtatagtatggggatcgttggtactaggatatatgcgagactgaggtaaaggagatggggacgaggatttttatacagattcgggcccctgaactgtcaggtaataaccctacatcctgttggccaaagccggtcgttgatcttattcatcataatcacaccagtacaatatttggagtagcctatctaactgttgtcgacatggcggtatgaagttctgactcgtagtcgacaacagggtagtcttcctcctcgaatccgtgcccggcgagatcagagatagcgctttcgtctctctagacagtatccggagacaccataggagactagccgtgcttatctctgaagtcgatatccggcatcttgtcttggcgtatgttggcttgtatgttgatcttgtgtcttgatctattgttccgtgtatgttgattgtctcctctcctcctagggggtcttgtatttatacccataggtgtccccttgtccaagtagaactaaggaaactaaaatggatacaatccgagtagtctttgtcgtttccatgtagaactctagttgtctttccttatccggaactccctctatatccaaagtcagtttccgtataagacatggtatgtggtcagtcctgccgaaatttagtcgactactattaggtatgtggtatccataaccttgacagtagcccccgacttcaatgcaaatgaacaaattcatattctcaaccgccgaccctggagtaactgttatcgagctcacgtaaccgttctcggtgagttcagagataacgttagacttcccttatcagcctcgtgcgggcacctatagggtttgtctgagtcaatctccgatgtcagccaagaaagtacatagcatacgactaagtctcccgtcttgctgtaatcgagaatttggattgaagtcaagaaattttatctcgacgggtacaccatctcttcattccgtattccttgtcgatatccaccaaccgttctcgagtgatcgagaaggcgcagaatctgcgacggagccttgtcaacatttgtcgtactcgccttggttgatcttggcgtagaaccatagagacatggagtcttcgacagagtcgaatagaattttcctgaaatcaatactaagaaaagaatattagatagaaatagcccccgaacaaacgctcaaagggtgacatgttataatatgtatggaaaattgaaaatgaattaaatttacagaccaatgttttgtatattagcgtcttctcttttaccgacttcgattagtcagtttgttgagtcatacactctccctagcccccagccttgtcgtcggagaatcgttctcggaggataaggctcttggacccttgacctgccttggttgaaaaagcactgatcctagcccccagtcgtgaagttggaaaactcaatttccgattacacggcttggttaatacgcacggcgagaactcttacatgaccagatcttagatggccgtttgtctctacaggatccgacaaggccttatctgctctggacgtcctcagccgaagttcccttaggttcctcagaggccttgtcaggacggcgtaaagggacatgaggataggtttcaactctaggtgtcgtcgtggtaagagatctctgggtaaaacacttagcgatattgtgtacctgatatcaactttgttggagtagaggtagtgggagaatcgctacaccgctggtcgaggaccaggtagtagtcgtaactcgaccacttaaagtggcggtgcgagagattgctacggtatactggttcgagaaccagcgagtagaattatctctcgagcaccaatagaagttacggtgcgagagattgctacggtatactggttagagaaccagcgagtagaattatctctcgagcaccaatggaagttgcggtgcgagagagtgctacggtgtactggttcgagaaccagcgagtagaattatctctcgagcatcaatggaagttgcgatgcgagagattgctacgatttaccggttcgagaaccagcgagtagaattatctctcgagcaccaatggaagttgcggtgcgagagattgctacgatttactggttcgagaaccagcgagtagaattatctctcgaacaccaatggaagcgctagagttggtttattacatgggcatctcatgtagccaacatgactcacatctccaacttatagcatatccggatgtctgttcgcaatcatgtcgggtgatcaagccgacgacgttcgcaaggaattatccgttaacaatcttttctcgagtagcccagccatggccggtgctatgagataggtcgtcagtcttcgttggcaggttgggcgcgacgactctgcatttgtcgagatcgttctcaataatagggtgtactcgaccacaacctactcgagcgctcaattgtttctaaaaatattttctagaaggcaagacatataacagagaatatcaagtatgtactcaaaaaactgcatggatcttctagcattatcaggatataacgagcagatgtaaatatcagtcattatatacaccgtaaataagcatgatttatatagaagaaaatagagcgagcccccagcgttcaaccgtagtcgatttaacatcggggacactcgcgcaatagacattgtataaaaaacacgctctaggtaaacataataaattattgatctgacaatatctaaaaataggtacggtaaattgtatataaaatattgcgtacctttatagatatataccgaatatatctacgaaattagtagattaatttaaaatcaatcttactaattaccttcgttcgcatatttataaagatcagactatgcgaatatctgtttttcctcgtcatatataaaggtgtcttggttatatgactgatcaaagccattaattagcttcctgatcaggcgcacgtgtagaagcagcatcggtcttggcttccatgtgtagccggccggacatggcagttgatctcccttccgtcttgctgttgtacacgcgtccgaactagtcacgtgtgttttcagtattggatttggagaagatgccatgctcggtttgaattcgtaaggatgcccatcgatgcttgctccgtatcctccttctcgatgccggatcaatttgtgacgtcgcctccacggtcagagcaggtactccgattgatgaagtagattggattgttaatgatgatggttctgatcttgtcgggagacatacttcgatcgggttagatctccccttcagccaaagtcgccgagtagattattgttgaagaatccatcttttgaacccatctcatcgaaatcctaaagcaccaaaatccccctacctggcgcgccactatcgacgtttgatgtcgcgattccagtatttgcatagtatgaggatcgttggtactaggatatatgcgagactgaggtaaatgagatggggacgaggatttttatacaggttcgggcccctgaactgtcaggtaataaccctacatcctgttagccgaagccggtcgttgatcttattcatcataatcacaccagtacaatatttggggtagcctatctaactgttgtcgatatggcggtctgaagttctgactcatagtcgatgacagggtagtcttcctcctcgaatctgtgcccggcgagatcagagatagcgctttcgtctctcctgacagtatccggagaaaccgtaggggactaaccgtgcttatctctgaagtcgatatccgacgtcttgtcttggcgtatgttggcttgtatattgatcttgtgtcttgatctattattccgtgtatgttgattatctcatcttctcctagggggtcttgtatttatacctataggtgttcccttgtccaagtagaaataggaaaactaatatggatacaatccaagtagtacttgtcgtttccatgtagaactctagttatctttacttatccggaactccctccatatctaaagtcagtttcgatataagacatggtatgtggtgggtcctgtcgagatttagtcaactactattaggtatgtggtatctataaccctaacaaataacattaaataaacttcacccattgtaacgcaagagcttttttttccagtttgaattaaagatttgaacattcaacacgaaactatgaattgtgatgattcaaattcaatttaaatttttcttactttttcgtagtcgccatcagctccagaccaaaccccatcctaaaaatcctccaaatctcgcccatgtcgccgccgacgatgacgaccgccgccgccgccaccgccaccgccatggccgccggcgttctcccccgaccgcgcccgcacttcctccgccgcggcatcctcccctcgccggcctccccgctccccttcgcttcccgggtctcctccgctgcgcccctccgccaccgcctcccgccgccgcgcttctccctctccccgatccccaagaccctctcctcgccgtcgcacgtccccgtccgctccctcttcaccggcatcgtcgaggacgtcggcaccgtccgccgcatcggcccgccgcccgcgccgccctccggcggcggcggcgaggcccccggcgttgacctcgaggtggagacgagcaccctcctcgccgggacgcagctcggggacagcgtggccgtcgacggggcctgcctcaccgtcgcggccatcgacgcggcggcgtcgacgctcaccttcggcgtcgcgccggagacactccgccggacgtccctcggcggccggtccgccggcgacgccgtgaacctggagcgcgcgctcacgccggcgtcgcgcatggggggccacttcgtgcagggccacgtggacgggacgggggagatcgccgcgttccgggccgagggggactcgctctgggtcaccgtgcgcgcgccgccggagatcctgcggctgctggtgtccaagggcttcgtcgccgtcgacggcgcgagcctcaccgtggtgaacgtcgacgaggaaggcgggtggttcgacttcatgctggtgaggtacacccaggacaacatcgtgctgccgaacaagaaggttggggacaaggtgaacctcgaggccgacatactcggcaagtacgtcgagaagctcctcgccgggagattggaggcgatgtcgaaggtgtgaatttgccatttgttgagctggaagaagcactgctcttcattccttttcggtataaataaggcgcaatctaatgttcatcagtaatggcagattctgtatttctcctttctgtatatgttgattgagatgcatatttagttatttatgatcaattgatttcggtgacgctaccttattcatattgtttcatagtcattgaatactttttgcttgctgcggagtaaagtgcttggtgtgatggtgtcttatcttggttggattggtctagtagttcactggttctagttcatcctcgcgctacttaaaagttagtgtttgatcagtgccatgtcatttgtcatgtctgttaattgttcaagaggtagtagcctggttataactatctccaatttattggttccatgcaatgtcgtaattcttgaaagaactggtatcaattttaggtggtagtagcgtgattttctgctgccatatatgaacatttccaatttctggaatagatcgtgatgtagggtgtgttggtagttgtggtatctgtttgcgcagttgtatgtacggttatctgttcttgatgggcttggcatcttggggaaacaggccacactaatggaagtagaatcagcaaaccttcaccagattgatctacatgttaccttttcgttgtgtttttcctgtatatttgatactctgtaattgatatacccgtgctttgcattgtgcaggcaggaaagagaagggaatgaaagcggatcctgatccactgcttcctttgcggaatcgttctggagccaggagcaaggaagataaaaagagaggctcttttcagacttgcatagctccattgcatcgacgaaaaattataccaacagtgttcttgtaataacgcagcttgtaagttgtaagcttgcctttccattgcctctgttgaacgaagcggagacagttgaagagttccatatgataattcagagttataaagtttttgacattgtgtaaatttggtgttgcttctgctgctgctcgtgtaattctggtggctgcttagcttgttgctgaaggctgtgtttagttgaggggaaagtttggattttggttgaaattaaagatgatgtgactgaaaagttgtgtgtgtatgacatgttgatgtgatggaaaaggactgaagtttggatctaaacacagccgaagctttgctccagattttgtatggtggttactggctgaggaattccaggcaggttgttgtcctgatgctgttttatagagtagggtagagttaagtgagaacaattagtttagaaaatgatcagttgacagaaagcgcatctggtgtagtggtatcatagtaccctcccacggtactgaccggggttcgattccccggatgcgcatttgttttttattcttttcactctgtcttttttacttctctcatcatcaaaaacaaaatgcatcagtctgatgatcaaccatgttttttttgggggggtttctttttactcataaacgaaatggatcagtctgttgatcaaccttctcaccatcaaaaacaaaatgcatcagtccgatgatcaaccatgtttttttggggggtttctttttactcataaacgaaatggatcagtctgttgatcaaccaggcgttcgttttcatctctttctcttgttttttttttaatctctaaaacaagatgcatcattttgtagactttctgatgatcaatcaggtgtcgtttcttttcttttcaactccttaaacaaaagcaaagtgcgtcattctgataatctgatggtcaatcatatcagggtgaggattgaagaatgcatcgtctaaaaaaaacgtgaatgctatatcattctggccggttgtcaatcagggatgacttgtgaaagcattcgcaggctgcactgcactgctacagtcaaggcagctcactgaaggccgtgataaccgatttggtcgccataaattatgctaaggattaattatggtcagtctactaaccctaacataattataattacattattaggtccacggttcaccttcacgcttcgtgaactaatacatctccatctcttacactctcctactacctacctctatatatgtgctggatttggatacttccatttgtgccatacattttgtcatttcgacctgctccatggcaaccacatgcatgttctccaaactagtgatccctaacaactacaataatcggagttggcatcttgtaatttattttttggtatactaactgtgggtataaatttagttcgtaaacttaataaatgtgtgcattattcctaaaacttcgtatattttttttcgaggggacaggcagggagctcctgcaatttactatagaaaaagagagttgatccagtttataaggaaaaccggacccaaaaaccttacaactgcacagttaattaaaggaaaactggcgaaaacccggcattgacaaaactgaaccaaatgacaattgtccaacaaggaaaaaaactcctagaacgaatccttcaagaaggttacgctgacagaacggcgacaacgtccgatcctaacgaatccaaggttttcacccgaagagtttccttgaagtggagttgaaacgagggctccaaacgcaacgccttcaagaaggtgaacggcgtccgagggcgctgccgttagtagcaccagaagcggagcaaggttttcacctcggagaccctgtcaaccaaagcatccaaaacggaagcttccaaatgcctcctgcacaccgaagggtacctgcactatggacaccacctgcacaatgaccggattctgcaccacccttgaccccgactgagaacgcgccggatctagacctaaagcccaaatcggccgtcctcctttcaccaccatcgccagccacgggcgaggttggctgccggcgccgcacgctccaaacaccaccggacgtcgcgccaccgccggatccagacgcgccgccgccggatctgttcaccccaccgccgcccgtctccaaccccgccgccatcggccgctgccgccactaccgccgccatctccatccccgccaccgtcgcccatcgccgccccgccagatccggccgaagcggcgcgaatctggcggtttaccgccgccgcctctccggagagacccccggtctcctaagagtggcgcgagagaggagccccgccgccgccgtccttgtggccgcgcggctttgccggcggccactcgggcagcggcgaggcggaggagggaggtgggggagagagaaggggtggccgagtcgtcgcctcccgtgccgcccctgggggaggacgacgcgagggaaggttgtcccctcaagtatcacacacttaaaaacttcgtatatgagtgcaatttagtccaagaagttaataaataaacatataggtgcaacaacttataagatgggtaagattttgtacaaacttaagaagtgatataacaacttacttagtttgggcatattttttctatacatgttcggtttttgaatagttgttttgtggatatacatgtgcatatttgtataagcttactcaaattttatcattctagtaaataaaacaattagattttactatgtagaaatttttgtatttcggttgagatttgagaatgtgaagcaaatcagtggtgcaaattatatgatcaatgtaattcttatggattaatttagattgtgaggcaatatctactggattagcatgtgatggcaaattgacattattgaaaaaaaaaactcagctaacactcattaaccaaagagcaaagttattacactcacttgccaagttgctagaacaaaaaaaaataaaaacctaagttgtcaagtggtacatactcacttgtcaagttattacactcgaatgttcaattataagtgttatataatgaatacaatttactcttattttaggagaacaaaaatacgagaccgactgtctctgcaccatctgaaatacacacaaccatatttcgtgaattaacacctaatctcgatctattgtacataacctaaatatacacacacttatatatttatagacacgatttgaatcctggtgagagtgatggaggccaaacacagacgcgcacgcaacttaatttaccattacactaatggtacttattgtgcaactaattgacagtggattaattttagaaaacgagtttaatctcaactttgttaactacttcctttgattcaaatcattttagcattttacatattaatataaaatggtagaatgacttacatcgtataacggaagggtacaaactaatatatataggtacatgcgtatacgtacactcatcacctggacctggtaggtagattaattaggcctggtcgtagtagtctgatatatatataggcgtgtgtgcgtgtcatgttgccatgtacacacgttaattagtacgttacgtagacatgcaaagcacacgttaattagctagctccttggctactagtaatgatcaggtcaaagcttagtcattagtataaattctgaactaacctatgggcgcacacatacgggaaacggtacgattggccgtgtcctgcatggtggtcaacgtaggcacatatatgctcagagaccttgcctggccttccaaaatatcaagtcgtcagaagctattctaaacggtttagattgtaagttagattatgagaatatccagtatataatatggaaaataaattaaaagttagaagttgaaaaactcagtttttctagctagattctcacaagttagggcccttccattctataggaaaatttcctatgaaaacctttcaaacaaagaattaaatcctatgttatcctttcaaattcctatgtaatggataatcctatagagattttaaagaaaatttagcaagaactctaacctattggaaatttccatttgattctatctctctcatctgattcatggttttttttctacggtccaattaatcggttattcatgtgtttttctgtattttgcaatcatctgttttacaagtacattcctattagaattctacgttttaactattcctccgtttttacattcctactattcaaaagggccctaacattttaccatctgattctcataagatccctcaattatggcttttggctctttccaccttccgtgtgggtgttagtactatatatgacatttatataggttttatggtattttatagaaattattttaattataatatagtcgatagagaagtcacaaattaatatatactgctataattctcgtactctgaaggagaggacgagttagcacaagcaaccttcttaggcaatatttccatacacaaagaacatgccaattatattgttcctagctaagtggatagtggatacaatatgccttatttattagaaaagaagtcgttagagcgatacaatagcagattattagccagctgtaaacatattttaatgagataaaacatgagagagaagagcagcgggctacagatctgtagccagctgcagcgcggactccaagaagcaatatgtatataacaggtgaaaccatatattaatagtatatgacggagcgtggggctcctcaccgggagactgcgcgggcccccctttgccggttcggccgggggcgctgagtgaggctctaagcccttgatctgtggaatgtttcgcgagaaaggaaacgcacaagacacgggcgatgtatacaggttcgggccgctgagaagcgtaataccctactcctgtgttctggtggatctgagtgtgaaggaattacagagagcagaagagctagagagcttaggtgttctctcagttgtcttcctccttttttctttttttcttccccttttttcgtcctttcttttcccccctctcttttcgtcctttcttttcccccctctcttttttcctttttggtgggcaaggtcctccttttataactcaaggggatcccacatgctccacttctacctacttttcttttgggtggagacccactctatcttcaccaaaactcgactcaccttctcttggaagctaaaacacagcttgttcttcagtgtggccaggcgtgctcactcgtctactctcggagatcaccctgtcatcccttcataaatgggcggagatttgcaatggctgctgtccgaatgaccctccgatgggatgggtcatacctacctccactccgctggaaggaggtgcaaaacgggagcgcggttgtccgcctatgacatgacaggcgtcagaccagtcacagaccggtcactctcgtccaccacgcgtcagtttagcaagctgcatgtctgcccttcttcatacaaagacttccttgcaatggttgggatgaagcctggcatatatctgaccgggaccgacgtgccatcttcaggagctggcacgccgtctccggctagggacaagtgcctggaggctctcatcaatccgacgggacggggcgaggcgtgtaacaggccacctgccaccacctaacccgcgatctgaccggtctgtgaccggtcacacgcgcgcccggtcacggaccggataagcgagcgcgctgcgctgcattacatgcgacgtgacgcgctcgttcaacccgcaataaatgcggttaggtgagccccgctgtgctcacctaacccatatacgtggcgccaaacccacagggggtcggggcgccccggccctcggggccgaaacgggagcggtccgacccctcggggagacaaaaggaggggcggccacatcaccctcgggcccgacccccccccccccccccccgagggggtcaggccacgtgggtgatcgcggctgcccaagcctctagtcatgatactcccggtcccatgtcaccgacagtatagtaagcaactattgtatgaattggctattgtattgactatatatgaattggagctagtagtgagctatactattaaacttgctcttatggtggtggagttgaaaaatatttatcgaggatcagggtttacacttccattttccaccaaaattttgggctcacttaaaaaagagtaaattacaccaggggtccttaaacttgtaagcatgttttacatatgtccatgaatttggaaaacgtgcgtcaatgtctttaaacttggtttattgtatcatcacggtccaaaatctcgttcgaccgtggacttacctacgtgacatgctacgtagtcaaatgaggctttaaaccgagatgatataataaatcaagtttaagaaccttgatgcgcactatgcaagatatcgcgaatttaggtgaaacctccctgtaagtttacggagcgctagtgtaatttactctttaaaaaacatcttccgtacatagatactacgtttaagtactaaacatttcctttggtttcaagagtttgatttctccctgattggttgaccatgtataaaacgtgtatgcaacaagacaacgagtatagtacaatgaagacagagcgacgaccgagatgaggaatttcctccggtttttgatcttttcatcaggactgtggaatgcacacgaccgttgccaaaataatggccatgacagctcgtgcttaattaacaagtaatctcaaaaaatttggtcagcgttctctctcgctcgcaacgaatccaaaatccaaagttatgatcgacgacccaaatccaatcaagcaaagtggatcctagttggtagaaaaaagaaggaatttaattggggcatcaagtttttttttgagttcaagaaatagattttgatgagtatatgtttccatggaatttatgtaatattatttttactatctttgaatagaagtttcacatgaaattggtgtgacattattttaccgttctcgaggcgaggataccaaaataacatgatataaacctctgtttcacatgtcataagtatctatttggctaaactgttaactgtgcattataatcagaagtggatttttaattttaactttagaaataattttaggtatttatttgtctatttggttgccggcatgatttttgctagctaggggacaagtaaaagaaatccttaaaaattttcttacaactcaaaagttaaaattttttcattgtgaatgtagaagctggattttaatccattttctaaaaaaaattatatcattttacctacagtataatttaagataaatgagctgtttaatttactcgtgtgggtaggagatagagagaacattgtcattagtaatcactgatttacagattagtcactcatctgctgacacaagaatgtagacaccgttgatgttggaacatggaaatcactgcattcatacgcatcaacacaactatataaaagctacagaaacattgtttttgcatttcgaggtaatagataactctagcccccattacttttgagtgccgaccaacacagttttcaatttggctaaatatctttcacaaaatgccaatgaaattgtcataaagatgatccaaacaaagccatgttaggtaccacaaccttttgttccgtacttcttcataccacacaaaaacaaaaaaaaagataaagtcacaaccatttcaacaaaaattccaacaatgtcccaatgacaagtgggcccacaacctgaaccggctgacacggtcccacatttcagtgacagatatgaacaccctgtgaaccatgtggacggtctcttgcacacacaggagaatattttgttgtgcaggggagatgaacatggacaacctatgatgatcagttgatcacctatgatttgttgaaaacaatgagcagaggaaaacaatgctggtttggtagacattctcagggttgatggagctcaaaaactggtgacagcggctagtggtttttcacagctcctgttctttgtttaactaacaaacagctgcatgttcatatgtttgtgcctaagaactttcttaagcgtgtcccaacaaccccttttggtgagagcaatggctcaacaaccttagccactttgtggattttttttcttttgttccatgatgattaggaactgcatgcaggggacttgttttaacggtgctaatcttttgtttggttcgttgttgtgatgtatccatgcagataagagataattcagttggcctaactactttactgatgagcacatggttttttcatcaaaagtttgtctggatttttaatattgatgacagtatgctataaaaattactaaaacatggtgaaaaaaagtacatttgtctcattggtgatagaaataaatatagcacattaattggtaaaaaaaacataaatatgtagtttaggcctttagggtgcatttcgactataacaatttatttcgcattttgcctggatatagtaaatgagggtgacaattttttaataaatgaacttatgaacacaaccacaaaaattaggctaataagtccacaaaccttaagaaaattatcaatatttttttaaaagtttatgtaagtaatacattagtggtaccattaaagagtttacgagttagaactattaagactttcatcccatggaccacaccaatctatctagtttagtgctcatttgtcatctcccacattgaacatctcataattaatcttctcctaactccaaaccagccagccagccagagaacaagtacacaaaagaattaagtatcctaggagataaataccatgtcacattgtcactcaaaagcccatgaaacaatcatgtgctaaaaaaccaggctaagtcatgcatgtgtccatgtagcagagaggataagactagagagcagccaggccacattataatagagggcaacaaaaaaaacaaaaaaaatccagcagctagcttcactggttttgaaggcttccctaactagatgctggatttgctgctgcatgggcggcgccccctgtattggccacctcaccacctccatggattgcagctgtcctctctaccttaaccctttgaccagtgcttgtttgtgtgtagcactagtagacaaagcaccatccatgacttgaaaagaaaattcaccaaattggttgcaagtattggttgatggctcttatctatctagtaagtagaactagtagaggagataatttgcagatgttttgctttcttttcttgtcctcaccgaatcctactaacctcctctttgtggtaggcatgtgcataagtgtcaagtgtctatatatattcttctgcacattctttgctccctgcccatagatacacatttcctcttcttcttcttcttgttcttgttcttgtgtcctgactgttcttgataaagctcagatttgggaattggaccacatcataacattctttggcagagtttgtgaaggtacatttggagtttggattaatttcaggtggttagctgttcttgatcgttcttcttgttgttggttgctggaagattcgaagattttttttgtgtgtgtgtgtaaattgtggtgttcttgtttggcattgttgctcagttagttgatcatggcgagccgggaggagagcggcaatggcggtggcggtggcgcgacgccggcggcggattaccggagctcggacagccggagctcgagccggcggagcacgcggttcaaggaggacaacgagtacgtggagatcacgctcgacgtcaagggcgacgacacggtcgccatccagagcatccgcaacggcgccgacatgcccgaggtcgccctcctcgcgcgcggcctcgcgcagcagccgccgccgtccgcggcgcccggccccggcgggctctcgtcgcggctcaaggcggtgaggaccgagctgaggcggatcgcgtcgtggaagttccccagcggcgttctcagcggcggcggcggcggcggcgacgcgccgggcaacggcaacgaccgccgccctcgcctcgaccggagcatgaccggcgccgcccgcgcgctgcgcgggctccagttcctcaactccagcgccgtcaccaatggctggccggaggtggagaagaggttcgagcgcctcgccgtcgacggcttcctcctccgctcccgcttcggccagtgcatcggtcagctcaagctcaagctcacctctgaaaattcctctaaatttctgatgaattcgaactgaaaccgactgaattttctcgccaaatcgtgttccaggaatggttggatccgaggagtttgcggttcagatcttcgactcgcttgcgcggcggcgagggatcacggctcagttgctgaccaaggatcagctccgggagttttgggagcagctctctgatccaggatttgatgccaagctgcagactttctttgacatgtatgtgttcagttctatcaaaaattcaagtttacattcagtcttgaagtagtagaattttagtcgttcaaatattgttagttgcacatgttttgtcttgtaatagtgaaatttgccactgaaccttttgattagtatgcacatagattcagttatgacttttggaaagggactctgaagtttgttgactgacatctgagtgctgaatttcttgcagggttgacaagaatgcagatggtcagatcactgaagaggagctcaaagaggtaagaaactggatcaaagcaacacaaaaaaaaaattaagcataatttttccatgtaatttgaagcagattgaggattctgaatttttcttgcatttttcaggtcctcaccctgactgcctctgcaaacaagctgtccaagatcctggagcgcgtcgacgagtacaccgcgctgatcatggaggagctcgatcccgatcaattaggctacatagatgtacatactctcaccctcaaatcctccacatatttgaaaaaatatatatatctgaatttgacattgttaagaacaagaatctatgcaattctgaatctgaaattgttcagagtactagagtagcagtatctgcaattctgaattctgacactgttcatggtcacctcccatttccaaagatatcaaacctggagtcgctgctgctgctgccgccgtcgcaggcgccgtcgaagctggtgacgcacagctccaacatcagccagctgatcagccagaagctggtgccgacgcacgaccggaacccgctccggcgggggctccggcggctgtcctacttcatggaggacaactggaagcgggtgtgggtgatggcgctgtggctggccatcaacgccggcctcttcacctggaagttcatggcgtacaagcgccacccgacgttcgacgtcatgggctactgcgtctgcgtcgccaagggcggtgccgagaccaccaagttcaacatggccctcatcctcctccccgtttgccggaacaccatcacctggctccgttctcgcaccaagctcggcgccgtcatccccttcaatgacaacatcaacttccacaaggtaacactctttcacacaagtatttttacggtgatctctactgttagtagaatatgtaccgctactagtattatcaccagtagaagcgatctaaatcattgatttataaattctactggtagaaacaatatcgtaccatcgatagttaaggttgtactataaatagacattgtccatttgacgagggagaaaaacaaaataaaaggttcagatttatcctattacaatattaccggtagagaacatcgtaaaaactcagtaaggtcattattgacagttgtcttctccggtgacggcaggtggtggcagggggagtggtggtaggggtggcgctgcacggggtgactcacctgacgtgcgacttcccgaggctgctgcacgcgagtgatgcggcgtacgagccgatgaagaagtacttcgggcagacacggatcccggactactggtggttcgtgcgcggcgtagaggggatcaccggcgtgatcatggtggtgctcatggccatcgcctacacgctggcgcacccgtggttccgccggagcaagcttagtgacagcaacccgctgaagcggctcagcggtttcaatatgttttggtactcccaccacctcttcgtcatcgtctacatcgccttcgttgtccatggcgtctgcctctacatcaaccggacttggtggaagcagacggtgagtgagccagcttctggtcgatttgcgcccgtcgggttctttgtggtctgaattctaaaaaatgttgctaacttttgtgtgatttttcagacatggatgtaccttgccatccctatcctgctctacgccggtgagcggattttccgggctctgaggtctcatggcttcaccaccgtaaggattgagaaggtaacccaactcttttttgtttaacatcaaaaagaaaattagttctgtagcactgaaagtttatgggaaaaaaaactttattagcacagaaagatctttctgttcactttgacacgacaatttctttccctgcaaatgtatactgatatggtactgaattctgttcaaggaaattgaattaaaatggggtaaatttgaaacgtgcaggttgcaatctatcctggcaacgtgatagccatccacatgaccaagccccatgggttcaagtacaagagtggccagtacatctatgttaactgcggcgaggtctcgccattcgagtggtaaatcctcaaattcctcaaaattctccggtcgcggcacgcgaaccaatactggttttcacctgacgattgttcacaactgatcatgccaatgcttgtgtcatgacaggcacccgttcaccatcacctcggctcccgacgacagctatctcagcatgcatatccggtgccgcggtgactggacctcgagcttcagggccatcttctctcaggcaagctgatcgccgagccaccatggcgaatcggggaaaatttcgggtgctctgctttgtgaaaatttgtggatgatgatggctaacaatgtggtgttcttggttgcagatatgcaggcctccgatgaacggccagagcggcctcctccgggctgactgcatgtccatggagcaccattcaaggtgcgctttttttccccggaattttgaacaaatttttagtttttgagatgaattcgctccaatgatttgttcttttgaaaaaaagggagtaaaatttaaaaacctacaactattttttgtcaaaattaccaatttgctgcaatttcaaaattcagaaaacaacaacattttttttgtcaaattagatatttgccacaatttcagcttggccaattcaagaggacaacaacaataatgcacgactttacctgtaagccggccctttcaaaaatgattttgtcagagagctacaataatacctaaagtcgcccgaataattgctgctttacgaaatttactccaaaaaaaatcattctgattccattttgacatttgacatttcaaaaacgattttatcataaagctacaataatacctaaacttattcaaataattgcaattttttttgggtgaaatttgctcgaaatatgaactcaaattttggcatcttgtgcaggttccccaagctcctgatcgacgggccgtacggcgcgccggcgcaggactactggaagtacgacgtcctcctcctcatcggcctaggcatcggcgccacccctctcatcagcatcgtcaaggacgtcctcaaccacatctacgacgaccccgagtccgccgcctcgccgcacaccaccaatggcggcggcgccgcggccgcggcgaggagggcgttcatgacgaagcgcgtctacttctactggtgcacgcgggaggagggctcgttcgagtggttccgcggcgtgatgaacgaggtggccgaccgcgacgccgggcgcgagttgatcgagctccacaaccactgcaccagcgtgtacgaggagggggacgcgcggtcggcgctggtgacgatgctccaggcgctccaccacgccaagaacggcgtggacgtggtgtccgggacgcgggtgcgcacccacttcgcgcgcccgagctggcgcgacgtgttcaagcgcgtcgccgtgaaccaccaggggcagcgcgtcggcgtcttcttctgcggcgaccaggcgctcacgccggagctccgccgcctcgcccaggacttctcccacaagaccaccaccaaattcgtcttccacaaggagaatttctagatcatcggattcatcgtcgtcagctgcctctccggcggataattgagttctttcatcctctgagcgagctcagattaagtgtacaattatatacagattaatggtgagagataggactacatattttagtgagtgattggttgttcgttcgtttgtttttttttctccttctgtgtaggtagaagaatggtagggggagtgatgattaagttagttgatgttttttttgtttcacaagtttgtacaaaattaccagaaaacgatgatat

SEQ ID NO: 76130 - DNA, 2704 bp, Oryza sativa
attaaggacctaggagtatgacttatacgctccacccgaggggtagtctacagacggtctagtaccagataagactctgagtaaaacttgcttgcacaagacttgcaattcaaggcgtggtccattgttcaagttgtgagtaagtgtagcttggagttctaggtggatattcaaccttaatcggtcttcatcgaaccgctagtatataaatagtacattggaaaaggcaaatctcagtgggattttgagatttggtgagggattgttggaattaatagatgggctaaggcccattcgaagattagttctttggaaaattacaaaagcccacctcatgggatggcatgcatgtggagtttagtaccaccttgcttattctaggagagggggacctctttaaaagggaggatgccctcctagccacttgaagcatgtgtggtgggagaagaggggaaacacgcgcgcgcgcgcgctcactcgcctggcctggcagtgcaggcggcgcgcgtgcacggcgtacgcgtcgaatggtccacaaaattggctcctcacccttgcgcagatgcagcctccttttgcagttttgttttgctgcaggaaattcagatttgttttgttttggaaacattccgaaaaatccggtgcgtgaaaatggcgtggagtccggataagttacgcgcgacttatctggttcggtttacgcgggcgccctgatcaagcgacctaactctatacaaaccgagccgccgccttcacgcaacatacgcgaactcaatctagggtttgcctcctactctgtactgcatcgtggctcgtagactactccatcccgctcgccggcgtgcatcggcgatcaggagagcaggtctccggaacctctaccttcgacgtcctacaccgggagaaggcggcaataaggtttttgggaagcgcttcgcgcgactgctccatgttcgtccgtgacggctcgccttcctctccgctcgcgtgttgcgcgccttcatcgacgcccgcaaccgcgagtagttcctgccgagcaaccggtctttccgccacttttgtacgtgttcgatatgttacgcatatttgatctgttcatgttttactgcttagtttacatgtgtagatctaatgatatgatcatgctagtttacatctggaatatcatgatttatttatggaataaattaaatcattatgtgcttataatttcaacaatatcgaggttgataaagtcatcgtaggtaaaaaaaagaatggtaagcaagaaatatgagctttgatgtgctttgatatgcaattttttttctacttatgttttagtaatttcactgttgacacacccatgttgcagagtgagttgatgggaaactaaactttctacctgaggacatcccgaatgtatacgtagttctcgtggacaacattacgcttcttgagaaattcgcgtgacacttcctacaaattaaaatgttcagctaatgatgcacatatgtaaaacttgttagttttgttaaccctagatcaattccattaagtgtatctttctaccctttattcctctgtttctttttccggtgccactcccactacataatgaggctaaatgatatagatctatttatatacttcactttaagatatatgtgtactatgtagcatatcatatctgtttccgctacataattcacttatataagtctaagaacatagcagttcctagcacgtatgtgcgagcttatggatgattataatgtacattaatttcaatattatcatgtgagttaacggtttacataactaattctgtaagcaatcctagctattttaccttgtgttgatccagattaattcatgtatgtacatataaatgtaacaaggtatatctcagtacatttttctactttgttctagcttcaacacctcgattgagtattaatttctctaagttaaattatcagtgttcgtgaacgcgcaaaaggttaaattccagtgttaattattttccgtcacatacatcacaattaagttcttaatttccgcattgggtcaaataattaccacataaaaattcaacagaactctaattagattattatgctactttacaacacaatcgttgtcacttatcagtgattcgatcgagccatatataactatatatacagagcgctaaatatgtcctcctcaataattagctagccacgacaattcgccgcaaatatgttaccaagtcatctcaatttggtaattactaatgattaaattcattttccatgttacatcagcgcatcagctagcatatacaagttggcttaggaagaatacaaaactggaactatatatgatcaagaggtcgatcaaatggcgtcacactcaggatcatttttcagacgatgtgcaagcttaattatttgatgactagaagtctagctagaaccacaccaatcgcaaaatgattgaagcattaaaatatagtaagttactaactactctctccgccccacgatacaaaggattttgagtttttgcttgcaacgtttgaccactcgtcttattcaaactttttttgcaaatataaaaaacaaaaagttgtgcttaaagtactgtagataataaagtaagtcacaaataaaataaataataatttcaaaattttttgaataagacgagtggtcaaacattgcaaacaaaaactcaaatt

SEQ ID NO: 76131 - DNA, 13958 bp, Oryza sativa
tatgggacggagggagtacatgctctctctaagtagataatacttcactttaaaaaaaaattgtgatcgctatattctattataatatatataaatatcaatcaacaaatgaatttattgaagtatattttaagattaaaatgtagatatgcatggtcttcatatttttaagatagatattttaaagattatttatcatcacattttctaaattttgttaacaattttatttaaaatgcgaagtactatcaatttgagaggagcaagtatcgattttttttcacgaacttgcaaaatgattgcacatcagtatattatattactccatctatcccaaagtaagtgtagtttgcattgtttatgtctaacgtataaccgttcattttatttaatgtttttatgattaatatttttattgttattaaatgataaaacataaatagtactttatgtgtgactaattttttaaatctttttaataaattttttaaataaaacggacggtcaaacgttagatataatatagatatttatagttatatttattttagaacggaggtagtagaagaaattgagttttgttcacaacgtaagataccaaaccgcaatcgttgccggttacaaggaaatgggatctaggcatctagcggaatagaaaacaaacagcaggagcaagttacaagtatctacgtatcactcaggtttaggtttataaagtgggtggtcctatatagaactccctttatattttaatatatgatattgttatcttttttactaacgtttaatcgttcgttttatttaaattttgtgtgtaaatataaaaatattcatatcaaacttaaagaacatttgatgataaatcaagtcacaataaaataaatgataattatataattttttaataaaataaatgatcaaacgttgtaaaaaagtcaacaacgttatatattaaaatatggatgtagcatttccagagaaaagcgcgtagactacgtggaagaccatccgtgctcctcgttgcaagtcttgtcaaaacttttttaagtagatattagcatctagtcgtagataattaattaagctgggcctgggaagcttcgaaaaaaatggctgcacttggaaagtttgcgtggttagtggccgcccatatcactatatcatcagtgccgatatagtacatcgaaaagggcaaaatcggtcgaaaaaaaacaatgtgcgaaaaggtgcaaacagaggacgaccgtacaccctatatatcgtcagtatcaataatatagccgacatgcttggatggtaattagactagccacgcctcttattacttaacaattggttaggttagtgcatattgtgtgatggtaggccataggcactaggcagcggcacggcatagaaaatacagaaatatgtaaagtatttttggcacgaagtctattggtcatgtaaaaaaaccaatcctatctataaatctagacacatatatatccagattcatatctagaattaagaattatttttttcggagggtgtagaagtactcatgctgctgatcaatattctctgattggttaacctatgagtcggctatgactaataacccgtagatatattgaatgaagcgatatggcacaatcatcattttgtttatactggttacataccacaatagcttattaacaacaaagaaataatttacaaataaaacttacatgcacgctcttatcaatttgagaacaaatgctgaaaaataaaccacgtaaaggaaaaaaaaaggctaaaatcaaatctaaaatatggttttaaaatctaaattttagctgcggcttgtaagctaaagggtaaacaatgtgaccttaacattttactggtaaaagttttatgcatgttaatttgtggtttagaaaataaggcagaaaaacattccacgataaaaccctagaaattaagttttaaatttaaattttagttgtacctgataatctaataaacagatgataaagatcacacttcaaccgtgaataccgatgttgcgtgtcagcttaatcacttttacccccatagtgccaaggcaagatatatggtactgactacagtaacattgtcgaatcatatcacaacacatacaaacatgcagacattatatgggcagcatccagcatattggcaaccctacacgtacaaggaaaggtatatatcaccttatctagatgtccctctttgtgcaaagccatattcattcactccaatcattatacctaatatttccactacaagtaaaggcaaatactccctctgttttcattggtcagccacctagctcaccttcataactcaaaatagctagactcctggtagcgatcagaggaccccgtgaaatgttagtacaacacatcgaggtacgtggaggaaacatgaaaataattgacacagtggagacacatgatatggttctagaagataagatgagtaatgggagtgatcgatcatcgatccacagttacacttttttttttcgaacacgcaaaaaatttacacattaatatattagaagaaaaatagtttttattacacaacgcaattggctagacagacctatgccgttgttacactagcacattctttcttcataagcgagatgagtatatttctacataacaacaattttagaactctaaacatgcaatgtaatagttatatcattagaattcaatagcaattacttcgctaaagcgtaatatctactcactccatcaaaaaaaactcaatctagaagtggatgtgatccctcctaaagcaacgaatctggaaaaaggtagtacatatttattgtcctagtaggagtcatattttctcgtagttgagtgtttttttttgaacggagaaagtatagctattcgttttggtatagcgtaataacggtcaaagtgtgatcatgctcagtcaaactaccaaaatgttgaggacaggagatcggggttatccagcaaaaccaaccaataaaatcgcagcttgctcgatcgatcacatgcatggacagtgcagaggtgtcccgggcgagtcaaggaatttcccttctgggtccagacacccgcgtccacgccatgcccgggggcaggccggtttccatccaaatggtgtggattcgttcggtcgtcgatctcgtccccgccggcctacggccgggggtgagcccccatgtgccgtgctcggacctgcctctccgagactctgatctccaggtctctcctcgtttgcatgccggtgcggttagctgctgcgtctcccatctcccgaaaacggcgaattgtcccgttccagtctctccttgtttgtccatctgcccctcatgtgtcgcggctgttggtggcaaacccccttggcttcatctacgtacactacccaagggattttcctgtaccacctgaaaaaaatactgtagcaacagggtgtcttgctccttttttatttttttttacctctgttcccctgaaagaaatgaggggaatgtgatagttggtctctggatgataatctagtttgcttaattattacgagtgtttccacgtttatgttcatgtttcgtcttttccgtcggagatgagaatgcttttagatctatgtatggatcttgtttggattgatacctaaggacatatataaaggtagaatctaatatgagctatctatattaattaatatcactagagactatccttttacaatggtagaaacaataaaatttctaaatcattattgcactaaatatttttttattatacttctttccttttctccaacctcatgcaacaaactttccgttaataaatactaagaatcgattctgagctgttgtcatgcgtagcaacgatgtttctcttttcttccctcttattcttccaggtcataaaatttacttgcatgacaacaaagagagtccgttattggacaccatagtacatgctctaaattctaaggaagggttaggagtaatttaacttcgtttttttctcatgtcgaaggagattgtcagtctcatttttgtctaaacaagatctatgaaataagggctaaattgaaagaagaacggttttcctactttccagttgtagtgcgcaaacgcgcaatctatcaggtggttattcatgtcaaacatttttgactagttgtcgtatcccaaagtagaaacgagtagctttgctttgaaaaattttcagctactgcgtcaaacattggataagtggaattcttccttactgtctagactttgagcgaatggaaaacgttgaataagatggaagagtcgtgtacaccttatcaagtgaatgagtcatatcggtggttgacatgggtatgtcgggtgattttctctttatcctcgtcctattagtcaacattttcgaaagatttcgcgaactaggtattgaaatgaaacgtacacatatatgctaagattaggggtggatctaggaaaaaaaattagagaggctcaattatagagtttcttcaacctccaatcatttagggacctttagtttattatttatggtgaaaaaaaatcaaagaggtgctcacgggggtatccatgaatcttgtgggtgtaggggggatccacgtcgaatcagcccctggctaagattgtgatgaatacatcaagatgactagggtcgagtttagttccaaactttttcttcaaatttccaacttttccatcacatcaaaacttttttacacgagcaattctacggtccttgaggaagtaccatgaggtaccaaaattttagtgtaaaatttggtacctcatagcacataggtaccaagaggtaccaaatttacaatagaaaaaatggtacctcatggtacctcctcaaagaccgtaaaattgctctttttacacacacaaacttccaactttttcgtcacatcgttccgatttcaaccaaactttcagttttagcgtgaactaaacacactctggtagtacagttctatgggacaaattaacaattgatatataagccctggcatcatatattgatgccacaaaagaacatagcgataaaacaaaccatgacactaaacagtccgattaataatctccagcacacctgaacactgataccaaacgaacagctttttttttcttttaccaagatagtgtgaacacaaagtaagctaaccccgaatgacaatgtacagtcccaagttacaggcttccagagctggtaagtagcagcagtaccactgcatggcttcccaaatcaccaggcccggggttttcatgtcctggcggtaagcgtggttatcgcgtagtaaccgtaataaatcgtacgaaaccatataaaattttaaaatattttttaaatttatttaaatttaaggagattactgaggtttttcttttatcgtaccccgcggtaaccgcgatcacagtttaggaaaccctttgcaaaaaaaaaaaaaaaaaaaaaaaaaactcactgccacttgcttcaagtgctccgctgcgttctacatcagctcacgcagatcagctttcaatatcatcatcacatacacttattaaccaaataatgtactacggagtactcactaccgagcacattaaccaaaaagtctccgtttgacattgcagtagccttacaaaatcaactgtgtgtgccgctatcattcggaagcatttctcggagcattaaaggctagattttatatctcctaaccaattgggactactccaatattccagtcaccctagggccatgtttagttcacctctaactaccctcaacttccaactttccatcacatcaaaactttcctacacaaataaacttctaattttttttccaaactaccaacttttctctaaacttctaactttttgcagaaactaaacacagcctagatgaaagagaaaacagccgaaatcgaatgacctgttcactttgatgctattttcgaccatagcattttttggtaaaattatctaaaaaatatctacgtttagtttgttgccaaatttagtaaatatataataaatcatgtcaaaattttagcaatattatcatcttgtaaaaagtttagcaatactaaaattgataaagtttattttggctacaatataaaaatgccctaaatcaacgagctaaagatcgcccggcacgtgatcccgccgcgagccgatcgagtcatcgagctcccaaccagaccgtgcagggcgcaactggccgtcccggcctcccaactccaaagtcaattcgcctacactcgccgcggcgatttccttgatcaacgactagtggtcatcactgccgtcaattcgctcgccatccatccccatcatgtgggcacgccgccgcccgccgcggacggcaaacacaacagcatcattaacaacttagcattaactaccacgttacgtcaagcccggagacctccgcgttattactacgagtatttatgtgctatatactcctcctctctcaatcccctcggtcgcatgcaatacggagcagatgggggttaaaaaacgccattggcccaagtggtttcgctgcaacggttttgacttttatatgacagcggcggcgaaaacacgcgatggatggatgcgaccgagcccaaatgtgggagtggtagtcgtgaactacaagtggtgggcactagcttttattgacgagcaataatactttccataggttacaacaactgggagaaattcagtgtcgggggaaaactgaaaattcccagtgaaaaatacgggatcgatccgatgccggctgatggaatggatcgatatgtgatcatccgagaccatcgggcatgcacgcctcgatccgaggaaaaaaaaatggcgccaaaagattacaagaaacgaaaggaatctgctactgctgctactagtatagtgtactgtgacgtagtaatgtactagtatgtgctactactggtaatagtaatggacatggtgtggttttgttcttggcgattatctctcggccttccggtcggcgatggacggggtgaggcggagcgcccacttgatggcgagcgggcagctgacgctcctgacggggacggcggcgcggcggagggcggcgttgtcgccgccgccggtggcggagtcgacgaacgacctgaggcgctgcatggcgacgtcgagggtcttggccgacatgttggcgaagcagacgcggaaccagccgggctcgcggcagtggcacgacgacccgggggagatgttgaggccgacctcgaacaccaccttcttccagagctccatctcgccggcgaacgaccggctccgcatcaggtggctcatgtccacccagcagaagaggccggcgttgctgggcaggcacccaatgccgatctccctgagcccgtccacgagctggtcgtgccgctccttgatccgccgcttgttctccgcgacgtagctccgggtgaagtccctgtcgccgagcagcgccgcgaggaggtactgcgtctgggacgacacgaggccgaagctggacatcttggtcgccgcggacacgacggcggcgttggcggagtagatggcgccgacgcggaaccccgggaggccgaggtccttggacaggctgtacacgacgtgcacgcggtcggacacgtcagcgccgccgccgtcgcgcccggccacgacctcgagcgcgctgacgaagcccgcgggcggctcggcgaacgccgtgccggcgtagatctcgtcgctgatgaggtggatgcccttggcggcgacgaagtcgacgatcgtctcgaggtcggcgcgcggcgacgcggtgccgagcgggttggacgggttggtgatcagcacccccttgacgcgcagccggcgcttctgcgcgcggcggtacgcgtcgtccagcgcggggcgcgtcacccggaacccgttcgcgctcgcgcagtgcacgggtacgatctccgcgccggtgcgccacttgaggtcgcggtcgaacctgcatccacccatccatccaccgttagccatgcgccaccatgcacgttgtcgcgtatggtaaaaaggtgtagcagcagcggcagtgccagtgcgtaccctgggtagtatggggtggggatgaggaaggcgtcgccgtggtcggcgaggcagaacatgagcgcctcgttagccgaggtggcgccggcggtgagcacgatgttgctggggtcgaacaccaccttgtaccctctctgctccgacatgaaccgcgccaatgcctgtgcaatccacgtgcgcatatgctcggggggttagccaactgtaacttttgacgaccgtgtacgcgaaccagagtacagttgatttaattaattacatttttgaaagccgggaggccgtggtagtcctggaacagcgcgagctcgcggaagacggaggcgccgccgccctctcgccggaggccgagcgcgtgggggttcttctccagccactcctcaagcaggtcgaacgacagctgcaacagccaaggcagagcaaccatgtcgtcagagacagtgtacacacatgtacaagtgtgtacatgcaggtgtggcacgcgcgtgtgcgtacctggttctcggcgaggcccatctggatgatgccggaagggttggagacggggtcgaacgggtttttctcgtactcctgccaccccaggaagtaggacgagtcctggccgtggctgttgcacccggccttcttggacagcagctgcggcttctcctcggcgaccacttggctcaccatctccaactctccttttttctctctctaacagccgatcgaatcaatccgcttgatgagtcggagcaaaaatctgtgagagctagtgtatagctcgaagaacactggagagacctgagctgctgctgctgctgagtaggagtagctagctagctggctgctgctgggtgcctcccaaggttggacgagctgcttatatagaatctggtgaggagagagagagagagagagagagagagagagagagagagcggctagtgctgtgatgtgatgcgagtgacgtttttcttttttttccttctgcttttgctttttgttaatttctcgggggctaatggaagctcgctctaaccgcgtgtagtacgcgactgccagtgtgcttagcgtcagtgaggggagaggttaacgtcgggacagcagcagagtgaggtgttactgcacgccgacagggatgccatgccatgccatcgttctcctcctcgtcgtcgtctacggggatggggttgttaaacgcgaacgaattaagaagcttctccttctgctgctgctgctgctgcttcgaattcgacccgtgagcaggggatcgtgcgttccgtgttgcttgccggctgggcgagcttaactttgctcttgctggggccggcctggccgatgctcggtgtcgtgctcgtgcatgctgctgccgaaagggcttctcgcgccgctccaattttgcggccgagtaatatgttacgctgcttctttttcatccaacagtggaacacgtccatgctatacaatgacatctgtaacaacattgtttgtttccttgggtatttatatgtgctttacagttaatggctgtgcatatggttttcaggaacaaaaataaatggctgtgtgcatcgtccagcacatgggctccacgcttgttcagatgtgccctgtggcgccggccgtgggctctgtagtctgttcctctgttaattgttagtattactgacatcataaaaatgaaatcatttgcatttggagcaacgattctctgttttggatagcaacaggtggtagcagttccaactctggctgatgtacgtacgtaagtatgttctctctcctgttgaggtacaatatgtatttcttccttctctcctttttatccccaggtcgcacaaaagtagatggcgatgatacagtggcaactttgatacaaatctcagaaaagtagatgacgatgataccgtgacaactctgttggatagtactttgcatcaaggctgaattatctgtaaactccacgtatggtggcgcagtattagatcctgaggataagttgtgggcaaagccccttttattcctgatgagagcaggtggatgtagacaagtagcgccgactattcagaaaacggagtccgtatcagaggaggggacgatacgaaaatggcagcctgctaccgagtgctctcttataccttaccagatgcttccttccttagcccgtagcgtttgttcctttgccttttcttttagtttcaaccattctagtttttcagaaatgaaaaagaaaagatccggccaatcagcacaggcctcgtggctgtgttatgatgatgggcaggtccattcaggtgtggactcttgttggttgctcaactcgggctgtgtttttgactatttgcactcgtcttcagaatgtttatcccatcctcatgtgttggatcaccagaatatttttgaaatggacgaagtacttaattaactgacagtttaattggtctgaccaattattagtagacgtgagataaataagtaccaccatgccacttgacacccaaaagaaaatctctattagaaatggagtgcatatcactatccattttctccctggtatgaggcccaaaggtagcaaaaattgggataagagccataggcacattgccaatgaggaacaaaagggttacaggtatgcaactggattatattcaaatcattgcaagatctattcaaatcaaccatgcaaatttacaatgtcacttcatgctttattggcatgagtaggatctaactgtagggatttttctttttcatactaagtttagtttgaagcaagagggcaatagggcatcatagtttgtctgcacatatgacagaagtaaaattagattcccacatacaagtagatacttgctcactcaattattctgcaatcgggcattggctgttttattaggtaagacttttctttagtcgatagtgcataattcaattaatgtcaagttgcatctcagcaatttttttccttatttaatgttgccaaattgtccctcgtagccaatcaaatctatccgtccggttcagtacatccatggcagaggagagaatgaaaattaataatcgcggcaaatttaaaaaagagagaaattagtatagcggtgcaaacagagaaaatacaaatttattttaaccaacaaattaaatgaagtgattaaaaatgaaaaattgcaccaaacaagtattcccacctctttttagtactccttccatttcatattataagttgtttatctttttctagtctagtgtctttaggtttgtttatagaaaaaaaattaacaatatctaccccactaaattagtttcattacgtatagcattcaatatattatggtaatatgtttttttagaaaataatattatattttttataaacttggacaaacttaaaaaatgtttgactagaaaaaaagtcaaaacaatttataatttaaaacagtaagagtaattgacaaggttgattttaatactcaaatttgttcaaaaatattttatgttgttctgttcttgtgttttttatggagaaaaactcgggaatgtatgacttaaggccatgtttagtttttctaaaatggcaaaaattttgctgtgttggagcattttttaccaaaatggatttaaacacggcaatttggcatttatcatttggtagtatagagtagtaaattttactaaaaaagtgtgttgggagccgtgctctctctatctttactattaaaatgacaaaactttaccatacatctaaatacgaactagcaaaacttaaatgccaaatcttttgccaaaaaaatttgccactagaccggataccgttatgtcattccttaaatattttatattattcttattcatctgccttctgcggagattctttttgttttgcatcgtactactttcatagttctgcataactcatgctacttacgaagatgccttttaaaattaaaattttatgtgataaatgtttaaaggatagtattaacaaagaataatttggctcggagaaaatgtaatagtagtatgagatgttatttctatatgaaaaataagactatccatcatttattcttgaagtgtcattatgcaaaaatttttttgaagagcaatacatatttctctggtttgtattcttcacatagtatatctcatatattagaaattgacttgtgggtattgataaaaaaaaccagcaaacttattctcgtaggagcatccgttgggctttatgattgagcagaaattatatagtttttgacaaatcatcatttatatcttatatgcatgttcttctcagggcaatgtactgactccggttctggtctcaattataaaagtgtgacgatgataccaggcaaacaaaaattgcatgtcacgaacttgagtaaaaggtaatgcagtttttcgccaacttcaaatgaagattcatatacaggattcaacaattaagaggtttatttaggtgttggcgatcattaatttgtgtttgcttcagtttatctaggtgtgttttataagacttgttgatgtgccattattattgagtgaatttgtgtaatatttagatataactcgttgagcaaaataccagaattttatttcattatcttaaaaaaacagtcaaagttggtataacttgttcaacgctgtcagttttaaaaacggggataaggtatctcagatcttgtgctctactgctctctcattggagcaaagaggttaaagaaaagcttcgagatcccccaaaaaggatcatgctcatgtcctcgtataactttataatgacatcgtgacagaaaccaaatgctactactacccaaaaaaaaaaaaaagagcatagaggtggggctcaacatgcttcatgcgagtttatggtgtttgtacagtagtgtacagctacctgggcacctagcaaagggcagaaatccgttgacggccacaagttttgcgatggcaaagctcattggtttgaaggtgcactaatgcacaaaatccaggattcgtagctaaaagacagcgattgaccagcagcgagtccactgccagcggggatactatacgaagttgtttgggacatgattgtcttaattgggcggtgctttgtttaagttaatctatcttttgtcgcttcacgtagtatttttaatgcaataaaaggctcccttcacatttcgtctttgatctttaatcatcatcgatgacccaagatcacacctaatggaggcggtggatgctctttggttggaatctgatggagagttggagagtggagacgaccctgttcaatttaatatctccaatgtttgcacatatcatgtacggaatgcataccctaccaaatgctgctatttacacaaaaccccggatactatgatttatgtttaatttgtaaaaacccacatgaactttaacatgtactcccttcttctcaaattaattatcatataagattatgcaccaaaaataaggacaatttaagtcacattaatcaagacaccatgcacattcttccgcaatgcatgcatcaattaaaaccccataccaattacaccctagcatgtgcatattctcccatactgcattaattgtattccgatggaatccgtatccatatagttatatggtgatcaatttgagaaattttgaattatattacatgatgatcaatttgggaaggaggtagtatcacataaccacgagtatttaggtgttaagctcttattaaaccgtaatgttaatcaatccatcttattactgtagcaaaataaaaattaatccacgtagaatactacaacatttatacgacaaacttaaaaaaaagctatatatttcagatataattttggaacttataagtattatatatttaaaaaataatagtggtagtgtggttttataaaattaaaaa

SEQ ID NO: 76132 - DNA, 531 bp, Oryza sativa
cgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaaggacaaccaatcacttgggaagagtttatcgaaggattcaagaagacacacatacctgcaggtgttgttgctttgaagaagcgtgagttccgggcacttaagcaaaaggatcgtaccgtgacggaatatcttcatgagttcaatcgtctagctcgctatgctctagaagatgtgcgtactgacgaggaaaggcaggagaagtttttggaaggcttaaaggatgaactgacagttatgttgatctctcatgactatgaggattttcaggagttggttgacaaagcaattcgact

SEQ ID NO: 76133 - DNA, 1539 bp, Oryza sativa
ttcaggggtatagaagggatcgggcaaatttcaagggtatgaaagggatggagtgagttttcaaaggtatacagggaattgactctttaaatttaagcactcatatcagccttcttactctaaagtagagtaaagcaggcaaggggcatcctctctattttggtttaagctcacttccaaggatatacagggaatttactctttaaacttaggcactcatatcagccttcttactctaaagtagagtaaaacaagcgagtggcatccctcttcattttatttagctcatctactgattatctaaccgaaaaagcaccccaacaccagtttgatactgttcgaaatcactgcaacgagtgggtgacacaatacaaggacaccatagtgcaccgcaaagcaaattttggttcgaaattttcgaaattcttttcccccccccccccaacggtatgctcaaatctcgcctaaaattttgggttttttgtaacttttttttgtgaatttgggcaatttttattggaattcattcagattttcaaataatttcggccagaaatttccgtaatttcggtgaccccggcatataaaatccaatttcgaaatttcaaaccctgaggagacacgcccgttggtaatgttgttacagcatcgacatgttcatcgaaatctgaggtgctacattgcatacctctgagtccaggtcattgccttgtttcgtacttgtacgtgtgggcgatttcagggaccagaggatcatcagggttcggatcagtcagtacagagcaaattgacagcaacacctgaaagcaaacagagagcacatgtttgtcggatttgttcagcccaactggaggaaccaagcaatcgtcttgcaaaaggaaaatagcattacacgagagaggcaaccttggaaatggttagtgctgtgaagaaaccatagcaagtaaccatcgaggcatcgacactgctgaggtctcgctgatatgagtagtggtgcacggctgcgaagtcacgggtagaagggaatggggaagaggagaacgaaagggcaaacaaacgaatgggcctggttctatgggcttaaagtgtgcattgccgacaagcatgcacgacttagtttttccggttttgttttgccacgccaatctatctatctattatattgctaaaacaactttgaaaggaggtatcatattcatcgtgggggctacaaattcccacattaatcgaagaaaaggaaaagaagagtccaagtagaaatataatttaaaaataactgaaattcggaattaaaaataagcaatatagaaaaaatgcacgtgcgttgcaacaggtaaagacggttttttcagtgatatatcaagagaataagtggtaagcaataaataaattaaaatattaggatcactatacattataattgaaaatgttaatgaaaattctaacattgggatcgctatatatagattataattaaaaaaggtaatgaattttttttcttggtttttggccgaaagcatttctttcttttcaaacgta

SEQ ID NO: 76134 - DNA, 3009 bp, Oryza sativa
ctacaaagctgctacattgaggtcatgagagctaacggagggaataggtacaagatccctcacatgaacaaggagaggctagaggcacttggcgttttgcctaaagcccttagttgtgatcgtggactatatgagagagtcatggagtctttggctaactagtggtggctattttgtgttatatatgtaaattgctatcgctatctatgtaattgtggtttggagaactaactggtgttattttgtgttatgcgtgtaaattgttagcgtcatctgtcactacgccatccgctggttttggcaacaaccaatatgtattgtcaacagtcatcatataatatgtgttatatatgtattttcactgttcgttccatccttaacagatacatcaatggctgactatcataaaatattcctaaactatatgaatcatgaatcatgcatttcgttgttattatataatgatacttagtttacacaagcatttactgcatgttatcacaaagaaaatataatgtcggttcgattgtgcaccaaatgcttagcatactcaactcgaaattttgcaatactatatttacaatcaaaatcttgcagcatagactacaagaagttttttttaggttcgaggtgcaaggaatactgagctaagtaaacaaattcaccaaagatgacacaaataagctttaaaaggtccttataattaattagttaattacacatattgatcaagcatctactgcttacatactacgcaaaagggagtgtgcaccaaacagccttggtagtcatgctagttcttcattttttacatatatgcagagatcaaagcggtttagccaaaacaggattccatctctagccttgatctcctcattattaatgcaatactaatatgtcttactcctagtgatattagtactaatactcctagatggcatatcttccatggcattatttgtgaggtatggtgaagtacaggggaagtaaaatccgtaacatactttcgcgaatttcagcaaattcgtcgacgcccccatctccggcagatacaccaacatcatcttgtaggccagccacctcctccccaccgaccagctgttcaatgccatccatgtgctgctcctccaagttggcgaagatgcctttctccggcttctgctccaagttaaggacgccgccaccacttgcctcatcctcggagtcagggacgatgcagccttcgggtggcagctcggagtcgtggacgccaccactcgtctcgtcctcggagtcagggacgacgcaaccgtcgggtgccagctcgaaatcgtggacgcagccacttgcctcgtcctcggagtcagggacaacgcagccattgggtggcagctcggagtcgtcgccaccactacttgcctcgtcctcggagtcaggaacaacgcagccatcgggtggcagctcggagtcgtcgacgccaccacttgcctcatcctcagagtcaaggacgaagccgccgtcgggtggcaagtcggagtcagggacatcgttacttgcctcgtcctgggaaacatggacaaatccactgtccggtggtagctccgagttgtcgatgccgccacacgcctggtcctccgactcagggacgaagcaaccgccggggtgccactccgcatcagacaagtatccacatgcatgctggtcctcggtgagtaactggacgccgtcggcgccgagcaccccaccaccatggcgctcctcggtgagtacctggacgccgtcggcaccaagcaccccaccaccacggccaccatggcgcctacatccacctcgccttgctccacttgcctgttgtgcttcaatgttcagttccgccaccctccgcttgggtgcggcccttctaaccagccgagccgtttcctccaaagccgcgacgggcagtgaatcgacgcgcgccggccgcaccattgccacgcgcccacgccgactgttgaggggagaggcgaggtgaggaggttagggattggggattgaagttgagtgcaacataggaaccggattgaggtgggagagagtgaggatcagggttgggggtgacggaggaaccgaatcaggtagggaaagattggggatcggcgatggttgggggcgatggagattggggatcggcgctggttgaggacgacggagagcgatggatgggggcgactagagagaggataagatcggagtagtactagcgcaacaaataaaaacgcacttcttttttctggttcacctccacgtatacggaggggcccaccacttctctctcgacgacattttttctgggacaatccaggggcggtgaaacggcaggttttgtgggacggagggagtaggatggagcatccactggggtgctgatattgggcttcgggccttacgtacggaccaaagacatgacctaagcatggcccactgtcagccattcaagcctgccacctcgagcccggttagactagccccgaccccgatgtggtaacctcagatttccctcgtgttggtggtcacctcaagcgatggaattacgtgtgcagccagcagcagggcagctttacagtgctctcccctctgcgctcttgccacccgtgagcgagggagcggttgattgatttccgttatctcggtccggggctacggcctcgccgagtggctggctctgtgtgaccgcgcgcgcgccttggaaaaggatgaaaagaactgtgcgcagcagcagacagggcgcggaagagatactctaggcagatagcacagcgcacggcagggcagagcaggaggaggatatagcatcgggggtcccggcgcgccgtatcggaatggcaggcagcgggcagcggcagtatcccgagcgcagcggcgcgggcgacgacgagaccaccgcgtcacgcgtgagcgttgcggatttgttgggattggtcgatgttttggatgcatttcgggggcggtgcgtgtgctgctcctgtatgtggccaaccaaccccaccgcgc

SEQ ID NO: 76135 - DNA, 911 bp, Oryza sativa
cccaccaaagaatttcccaccacctgtgggaaggtatattgaaagaagcccaccttcgcgcgtcgatgttaggactgcttatcctccacttggaaccactggaccgtatggaccgccaaagtatgttcaatggtatggtcgagtcttcaagctgaggatgagagattaatcaatagtcctatctaacctctactgccacggtagtatgacttaaggacaagcttaaggaatagtctaggtatgtggtggcccattttggaagaaaatcgtggtatgtaatatatgtaatatggctgccatgtactccatttatgtaagaacttgttggatggatgtaatagtaactaagaactcgtttgtccttaatttagaaacctctgtgcttgctgtccagaactttggaaaatctgtaaacataagttcatctaagttagaaatctggttataagctcctgttaatatgaaccaacatttatcttgttggaactaacttctctagtgtcaatttaactaactatctaagcttccataaacccacaactgagtagaacttgccactcacccgcgaaataaaagtttccaaatgttttatggtagcaagtctgtcatacaacttaaaagaaattattatctgctgtcaatgtcaatcctctggagatagtcataacttaagccaaccctacccaaatctcggggacgagatttattttaagggggatagactgtaacatacccgaaattttaggacttaaaatttcttgtcaaaatagttaaaggttaacttctccaaatttcaagagccaaaaattccggttttaattaggggaaggaccaccttaacccatggaaggataaattgaagaccaaaataaatttttttcattcccaccataagactagaaaggtcacca

SEQ ID NO: 76136 - DNA, 915 bp, Oryza sativa
agctcggctaccgagctcggtcataagtagtatagatatatttgagtgatatccccttgataagtgtattattttctagttatcacactaaataaaaaagtaaagaatgattaaattaattatattgtgctaacacatgatatttaattgtgttaatagatactaatatatatatttatctattagtttattaaatcaataaggtaaccaaccaatataaattgtacacagttaagctcggtagaaactcgagctcggctcggtaaagcttgcgagcttttgcccaagctcggggtcggctcaattggagctcgagccgagcttgaattgagcatagaacgagccaagctcaagctacttgtgaccttcgagctttttttgacagctctaaacatatcccagtgcaagcactagaagataatgagatcgaactagagcagcaagatgatggctccttgaatatgtcaggtatgactacaatgaagatagctaaaaccagtaggacgaactaaatgtttatattgaaaaattgggctcagctactattgttcttgtttaattttataggtgagagtgctaaagaagacaaactttaacacatccactactagagaaagcgtttttgctcccggtttgtaaccccctatactcctagttttacaatcgggagtacgaatccgggactaaagatggatatctttagtctcgggcgaaataattgggactaaaaatccatctttagtcccggttggggcagtgccagtcccggttggtcactgttggtatttgatatggttacagataaaatccgcaagcgcacggatataccgatgtagcacttcccctacggagtattccaagggtatcgaatccaagggaacgtgtgtgatcagagcttcctccggttcacccaag

SEQ ID NO: 76137 - DNA, 729 bp, Oryza sativa
ctagttagaccgccgaatccgataaaacacaaatcgacgaactctcaaagtatatgacaactttattgcttctctctgtgtttacaaagtgcaacagccgcactccttacaaaaatcttgactaaacttgaaaccctaactaaactatcaactcaattgctctaaaaagcactaccgggaagcctcacgctccctctctatttatacatgaggtaggcagcctaaagccacaaaccaaactcatactagaagtcctaatccgcataggaaacctcatcgtacaagaaacaaactttacataaccaatcataccaaatttggactccttccaaattcgactccgcatcccatacacacacaatacctccatcgtattgcatatggaatcttcaccaaccacgtgcattgaactctagcctaagtatcccgcatgatatctgaccgtcgcggacattgccctcagacggagatcaaagcatgtcaaagaagaaagatgatgacgatgatgtcccgactggttttcaagaccatcgcaaggaactcaatcacatctttggcagacccctagcttatgaatctaagagaaagcaaaagctgaccgaacgggagattaacactgttcagcccgatacgccccaatatcttcggtggtcggagacaacaattaagtttgaccactcggatcatcctgaccgagtggtccacccggggcggtaccccctggtatta

SEQ ID NO: 76138 - DNA, 559 bp, Oryza sativa
tgaaagaacaccctctataaggggacaacagctcggtacccgtagtagtgcccagggaggagaccttgatacgatagccatctggggttttctctaagtgctgcttgacttctcccatagttatgtaaggaggagggcttccattgttgtctttctcattatacacctgcgccatataccccgagatgaccttcacatttcggccaagagcaaatgagcacctcgctcactgaaaggcagccaatttgaccaaaaccttaatattgcagagcgcacatagaggcagcatgggacaaaaaagtagcaagtagggccaggtgtatgacaccagccttgttgtccatatagagtagtagtagaataacaccagccctggtgaccatatagagtaggcagaaagctccacaaaagtccgggagatgcttgtaccaccaagaagtgatcggccgtcggtagacaccgaaaggaaggccgggtcggtattgatcttgatgatttgaatgaggacactccatcgaatgaaggatcttgggaaaaaaaaaggcaagcactggacacc

SEQ ID NO: 76139 - DNA, 10361 bp, Oryza sativa
ttgaccgtcatgaggtactcgaacgaccgggacacgaccttcgacacgacgtcgtccgccgcgccgccgccggaggcggaggaggaggcggagcccgcgatcgcggcggcgcgcgccacggaccgccgcgccgccgcgagcgcgcggccgtgggcggtgaacgccgggtcatggaacggcgacctgggtgagtcacggtggatgaactccacgctgaatccgccgccgctcgccgcgcactcgcacagcctcccgccggcgacgaggaggacgacgccgaggagcacgagcacggaggaaggcgccatggccgccatcgtcgaacaccttcacacagaaactcactctctactcctcacgctgctaatggcgtattcatagggagattactcgtaacgtaaatggtaaatcacgagtgattaaggggggtgattaatgggatgatgagtatgaactggcataattacatactactaatcacctgtgcatgcatggaaacatgcaaaatgacgatacagatagctttggcagtggagattttgattggaaggagagatacgttttttaaatttttgcgcgttaaactgatcctttggttgagctaatttatatactacctattttggatttaagcattaaagaattcttttttgagtgtggatgatttcaatgtgtgtgtgtaaattcggtgattaattaatatccagcaatttttcctgtatagtcaattaatcatagcctattcggtttgatcaattgtgtctatccttccattatttgtttcccttagtgttcattacaggttgttttctcttgttctttttcttcttctctcttttttttttgaaatttcagtagaatttgcataatataagaggatttgattcctatcggcgacgggtcgaggatgtgagtaaagtcctttcaggatttcagcctggcccatttctaaacagcacaaaggctgcagatcttgcgtaccattcgcctaagtccagtttagtcccgaaaagcccagttcagtgggccggaggcccgtagataggatcatgagaggagtttctttttctttttttttctgagaatataagaggagtaaattcatgttgggcctagaatagcataatgaccaattgatggacctctacctgtcatttcatcacaactatgatttttcttttttcagaaacaggaaaaaagctgaacagtaaggaagtttcgtattttccctacagaaatactaatttgacatcattttgtctttttagtagtacgcaattttttaacatatatcccttccgtcttagaaaaaaaagatcaatcctagttatgaacctgtacatacgtatccaggttcatagctagaattgggttttttatgggacagagtagtagttagtaggaataaatttcaatttttttgattcaaatttccacacatggtgttatctgggcagtatcttggatggttctgcaggaggtgagacaacattgcacagtgtcaaacaagcttagacgtcttctattattatgtaatatttttgtaagatatggttagtatgaataatagtcaaatttgtttcatacaaattctcacatgatgttatttgcgcaatttcttggatggttccatgcagcagcatggcacacaggcgcagtgtcaatagacaagattagacaactagtgagatttcagaggcaacaccaattgaacaaccctatttgtaaccatacaacctctctaattaatagtctaattagtcagtggtgttacttgcaaatgatgcaaagtggcatctgatgcccctcacttggcagacaaagtgtaggttgactgaccaaacaaagccctgaattacctcgtcttcacagacaagtcattaccaaagagaaaaggtccatcttttcacaggaattcagaaaagaaggaagtaccagtactatatatcactgcactaagcaaaaacaatttgactattagcaaaaagcatccacagcttgaagaaagcaagtactagtagtagcaagaagattctaattgacctactgtttgtgcaaatggcctacttaatggttcaattaagtaggcacaactaggtactcctaggtgagtatgctgtttgtgacaaaatgaataaatagagagatgtgacaaaatgagtagagatgattcttttcagatagtagtgtcatttgtttagcacaaactcatgtttgtacaaatgatgggactactaaattccatgaccaaagtgatgagtaagggtcctatactaatgtaattccttgtcttgaataactgtattaacagtattcttctccttctgaatactgaacctgaacatgcaacatgcagagcagagacatggaagattcaggatcaaactggatactgcagatcgggggcagtacacgcttttaaagtagtaggaaatctggaaccacgaggatttgattctgagtagaatatgatcagtactatacttagcaactgaatttggattaggttaatcgttcatgtgtgattaactaaaggggagagggattttgtcaagtcagaagggcgtgcaacctgtttgatactgtgatccctgaagatctctggtgttggtctggtcgagcagagcattttggatacgcaagtgcagtgcaggtcgtcgatcggtcgctggccgccctctctgaatgatcctgtcgagagatcccaaacaggacaagaccagaccatcaattcacaaaagaacgaagttttgcagaatattattccgtccgttttcaaataaccgataattttaactttgctatctaaactttaaccactagctattattggatggttagactaaggccgagtttagttccaaactattttttcaaacttccaactttccatcacatcaaaacttctacacacacaaacttttaattttttcgtcacatcattctaatttcaactaaatttccaattttagtgtgaactaaacacaccatggaagcgaacaatgtaaaatttttgggaaaaaaaagacgagccattgaagcatgaaagtaaatagtgtcagctgctggttattttaaaaagcagggagtagctttgaagagcaaacgaattttacacaaaagttcagatttttttaaagagaaatttgtgttgttttttggggtgaaaagcgaggaaagtcaagagaggggacaagcaaccgacaggggggcacaatcacatgtccccgctttatgctactcgtacctcattggctgttcactgatgctgcctccgtgcccacccaaccatttcactttcacccctctcaaatccaatcccaattcgattccaattcaattcaattctggaggctatttactcgtaaccgtgtgactcactccatctaccacagagtgtctttagttcacgtcaaaaatagaagtttggttgaaattggaacgatgtgacgtaaaagttggaagtttacgtgtgtaggaaagttctaatgtgatataaaagttgaaagtttgaagaaaaatttggaaactaaactaggccacagtctactacgatgctactggaagacaacttgtttatttgatgagtaaatttaataaaaaaccatgttttgagacactcataatggagaatccaaaacttttttatagtttatttcataaaatcttagattttagggtgaaatattttacgaaaactcatggtacatgcttatgacatccatttaactaatatatacatatataattgtgagaaaattgtatgagatattttctaagttatgtagtagtagatgaaagttccttttttttaaaaaaaatgtatttttaaaatcatgaagcaaataattcgtggtaaaaaataggacaaagtacgaaaagaacatggccatcttgagttttcttctttgacttctctatttcttacattctaaaattccaatttagagtgacaacttaagacatacaaatactgaagttgtctactgtacgtgtgagttcttacgtcaactacagtaaatacatacaacatgtacagtacccattatatgtttattattttaaaaatgaaaactaacatttttttatgtttaataaactcatatcgttgtcttgatttttcttctctctatcttgctgtgcacgagtgcctgttttattattattaactgacgaacggattctttctcatccaccgtacgaaaaaggaaaaactacgggaaaggcaccgtggccgtcggatcgggatcgtgcggcgatgagggtggcgtagcgtggagccggtcgctgcagggcgcccaaccgacagcccgggcccactgccgggagcgacccgcgcgaaatgctcggccactatttccttgtttattccgttttgggaaaacacacaacactaaattaatttcccccctttttgcacttaactcctacctttcctatcttttcatctctaactgcatttttccactaacttcagtttatttgatttttatgaaagtttggtgatttgaaaaccatcttttatgcactggttagattacttgttgtaaactatttgtaaaaattattttctgaaatatttttatttttataattaaatacatattcctaaaaaataacgtaatgattaataatctacgtctctctattccgtattttatattataactcgcattgatttttttattagttaaatttctttagatttaattaagtatataaaaaaaagtttgcaacagttagcaacaccaacaataccaaattagttccagtaaatttaacattgaacgtattttaataacatcttttttttgttttaacaatattactagcattgattttttttattagttaaatttctttagatttaatcaagtatgtaaaaaagtttgcaacagttggcaacaccagcaatacaaaattagttgcactaaatttaacattgaacgtattttaataatatgtttgttttgtgttaacaatattactatatttttctacaatctcgatcaaactgtttttttatataaaaatgattaggaaaataccaaaacaaccaatcaaacggggaaagtaaaatgtaatttgacatgaggtcaggtgctaatgtgtaaaatggcagtcccgggtcactgaccgttttgaccaccggtgacctcccagctataaccaacccaacctcttcccttctcccattttgctttgctttctttgctttcctctcctctctcgccgcccacctcgccgtcgccgccgccgcgagggccaacgccggcgaagtccgcgagccgaagcatcacacagctgcgccagcgatgtcggtggagacggagcggagctccacggagtcgtccgccgcgtcggggctcgacttcgaggacaccgccctcaccctccgcctcccgggctccctcgccgccgccgccgcacctgaccccgaccgcaagcgctcctccccctcctcctccgacgccgccgacgccgcagacaactcctcccccctcgccgccgccgccgatgctccccctgctcccaagtatatacaatacactgcctcttctcttgtgttcttgcgcgcgagaggtttgattgggtggtgtttggattgattggtgaggttgtggtttgtcagggcgagggtggtggggtggccgccggtgaggtcgttcaggaagaacgcgctggcggccaagttcgtgaaggtggccgtggacggcgcgccgtacctgcgcaaggtggacctcgaggcctactccggctacgaccagctcctccgcgcgctccaggacaagttcttctcccacttcaccatccgtaagctcttcttcttcatcatctctcgatccatctgattctgttggttgttcgagcaattgacgggaggaaagttgcagggaagttcgccgacgacgagaggaagctggtggacgcggtgaacgggacggagtacgtgccgacgtacgaggacaaggacggcgactggatgctcgtcggcgacgtcccctggaagtgagcctcttctttgatttcttgccaaccttttccttttccccttgattcattcatcacttggttgtgaaattcgtgttccagtgccagatcttagtatgattcttgatggttttccatagtggataatttgttggtctggttcttggaccgaccaggttagaatgtcttggctctgattcgttcgagaaattcagagtacttcatttgttgatttggagctatacataactgtagaggctttggtactattgctaaaagtggtattttgtgctgatagagatctgaaatgaatttggtatatagatgcatgatgctttacgttttgggtaggaagcagatatggtttgctttgcttgtggttttagtctaaaaatgggtgctttttatatgttgtgtggtctcatggatatgctcttagttgttgacataatccaatgcaagttcatgaatgcatttcaaagatttggagttgcttatgtggctctggtctgtgttgatctgaagaaaggggggttagttagggatctgaacaaataatgcattactaacaacaaatcataccctgattccatagatagtgaaaccccttccctttcagtcttgaggttaggttacattggaaatgcagattggattctactagtggccaataataggaagttctgtttggttcttgttgcactacgtcttgcgttactgttgcttccttagcagattaagcaactttgatgtatcacttccaaataaataaattgatgtgcaatctctctcctcctcagagcaactagcctatgaggcctctgtacaataaaaagaagaaccccactttgttaggatagactactttggataagcttgcctttctagttttgttctccactacctggaacacactgttcattgacctatgggctgtgctatgaggcgtcgatccttcttgatccttctagctaaatttcgtttgattaatttttgagattgtttttgtcctacttattatgtttctttatcttactttttggtgaactgcaacagttctcatgaaacagtaaatggcacaaatgctctctttttatcttcagcagtttctgaccttaatggttgtgcaggatgtttgtggaaacttgccagcgccttcgtctcatgaaaagctcagaggctgtcaacttaggtacatgtttgcttagttgttttaaattcacctgcctacgcaagagctgtttttactctcttttgtacctgcgtcctcagccgtcttgttctaatcggtttgttctctcccttgcagcaccaagagccgctcaatgaggcattcccggtgcccatgaccgtgtggttggattgaaagaaagtggaagctttgccccgccgatgttcgcccacgtgtgatatgaacatgtacagttgtctcctactacttttggttccttgatgatgctgagttgagaaaaaggttgtagtttcgttactcgtctgtagtctctccatatatagataatgaagcactgaagcttgaaatatacacctacagtttgtctctttatgaataagaccatatacgcaaaaaaaccgatgttctttgctgcggctcgcgtgtcgtcaggctatatgcagttttttgtcgcaccataggcgatggacatctctggccttatactttcgtaaaaatcttatcatgttaagcgatggtcttgctttggagttcatagttctgtgctctatgatgtgcaatcagcttggtgttcatctatatataatcttttgctgctgtattctggttattgtactaagttgtaactgacgaaatgatctcttggatgttagtgtcttcgctgattgatatgagctcgtatctattgctgctgcattctggtttctgtaacgaacaaaatagtttgttggtgaggctgaaaaacgttattggaatgttcagtgttttactctgaatcatatgtgaacatatcagatgtgttagtctgaaaaaagagcaataattgttcagttgaaaaaggatgatggattcatggatgagcttaccctaccccgggccatgttcttccatggacgctttggacagaaaagaagaacagataagatcagatcatcgaacgacaggtcaccgtcgtcgttaaggacggcggcgaggtcgctgtcaaaactcgcctgctttttccacaagatgggccatggcgtgacctcaccggccggagatggtcgccggcggcggcgacggatcgacgactacggttgctcaattttctttgctattttttgtgcatgggtgagaagaaaacgacctctctgatccatgtcggcctatactgcggcggcaaccgtcgtttcttcatttgttttctgcttcgagaaagcgatgctacatggacttgtggtggtataaaattagaaattataaatctgatcttaattatttaagttgttgcgagagggcatatatacacctgcatagcacttcaagatttcgagtttaaatcttatatcttgatggatatggagaatttcaaattgagttatttgagagagtaagttaccactttaaatggctgtatatattcaattcgatgtagaggataggtaaaaaataccattgtttataaaaaataaaaaagttatgagttgttaactgcaggctccgttatttggaacttggtcctgaacattagtctctttgataaacatagtatttgacgtttaggataaaattcggacacttttacaatccaaccatcattaattccttatattttagttttttaaaaaatattatgcggagaactgttttgaaaagcactctcgtaatgtcataaacttattaatattcgtacaatccttttagtataaaattgattgttagaaatcttaaagtttgactaaatattactctaaacatcaaatttttatgactaatgctgaatcttttttattgcgtgatactcaatggtttaaaagttctgtatcttttcaccttggggcgaagaaaagtttggaggacttcatgcttactcaagctacagtttattagaggagatgattagggatttggaatgtccatggtcaaacatacccatcatttgattagagagaaaacaatgaacgaattgaccacaatttctcatcaagtggatatttcatatttgcgcggaggaaaaaacatgatctaactattttacgtggagcaccatctatgataggttaattgtttctctatctggattctatggcaacgctacataccctctgtttccctccacaaataatgtccttcaaatttaccatcagaatctactgctctctctgtttaaaaaagaaaccaatttagatgggatgtgattctacccaaaactttttatccagattcgttattttatgtagagtcatactccttccagcctaaaaaaaaactaatctagttgggggatgtgatccttaataggagaatgaatcttgactatcttaggttgagtttttttttgaaacggaggaagtacacatctatgggtgtgtttagttcacgccaaaattgaaagtttgattgaaattgaaacgatgtgacggaaaagttgaaagtttatgtgtgtaggaaagttgatgttataaaaaagttagaagtttgaagaaaaagtttggaactaaacacggcctatattattttttctaataccgagggattacaatgcagcaacgaatttaaaaacacgaattaaactacacgaaacggaaatgacacgacatttctcgaccgttacacccgatttcccaattatcccctcccaaaacggaagcaataaaaaaaaagaaagagagagaaaaaaaagccgtaacatccaacggctacgattccccggtccccatgatcggacggccgagatgatccggcgcgcaacgcgcatgcgcgttgccagtgaccaccaccccccgtcctctccaaaacgccaaaaatttttcccccactgctccccactgctttcccctcctcctccccgcgagatcccatccatggtggccgcctcccgcccccggatctggccctgacgaggccgccattgccggatatttttggccctcctgccatttcctgaggtgtcctgtcgtttcccctttttcttttttcttttttggcccatttcttgtgaggtgctttctttgggttgggttcttgatccgtcgcatttcgcgcctggcactcggcgatccgttcttgcgatcccccgcacgttgcaagcgcggatttgttgtttttattattatttttttttgttgtgatttgcggcgtcgtgttcttggtgctggctggcaatggtggtttgatttggggggggggggggggggtg

SEQ ID NO: 76140 - DNA, 578 bp, Oryza sativa
cacggcgcgcactccggcggcacgacgccgtcccagcgccggtggtggacgccgccgcggccggccatgttgctctggccggagagcacgaaaatgcgcatggcggcggggcgtgaggcgtttgggtgtgacctgcaccctgcagtggggcaggtggatcgggggggagttggaacgtcgttttgttttattgaccaaccattggttggcctggtcaaaaacttaaccggcaagtacttaagccattcttttttaccagttacattattcaatcaggcttaaattaactaccaccattattcgagattaattgaaaaaccccttagggtaaccaaattgaattggcaaccttctgtcgacaaaaaatacattctaaataggctagattttaaggtgaacaaaatagaattgttaaccttctgtcgacaaaaaatatatcctaaataggctagattttaagccatcagatatgcttcataattcccacggtgattcttctccaaattcgacgacctctcttcttctttggcattgacaatatcatctcaaactccaatcgagaacctatggattagggt

SEQ ID NO: 76141 - DNA, 2311 bp, Oryza sativa
aatcgtagattatttttggaaattgctcgagcgtaatagtatttcggtcgaaattccgagttaattataaaaatatgtttcttgatcagattagattaaaattggtagtaatttagatataattaataactaaacaattagatgaactcgtatagattattatagatcatttttggtaatctctaagagtcatcggttcgcggtagaaattcggatttaattactagggattttagccgtgtattatatttaatcatttagtcatagactaaattaaatcatataatatttctaggatttcgtccgatatttagctcgcgatagaaatctctaacctattatatggatataatgctcgggtagattaaattaaaaacttatgacagcaaaatatttatacccgcaaaatagtttaagtcaaaattgggtttgccgtagttcgcagatagtaaagttaataaaaaggaatcgactttcacattcgactttcatttggatttatttggatttttatttgaattctaaccgaattcaaatcaatttttgacgtaactatagagcccgagaaagttgcggatccaagcgaaggccaagacccgcaagactctgagcaaggcaagtcatcactattccttgaacatgttgatcccaattgcgaaattgttttgtttacaaataaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgctggggcaattacctttgggaaggtaattgagatgcggcatgtggagacatgagcgccacattgccatgatgttgatgacatgatttgtgaaaggagaaataaaattaaataactgtttttgactggggcggacggaggatttgggtggtatctggaaaaggctagtaccgtccccggtcaattaaggaccgaaccatgaagttaagcatgaaacaacccccgtacaaccgcacttctcgtatgggtatagacctagcggattagatagccgagcggaggcagtatccttgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgcgtgagagacttctctttcccgggagcgccagaactcctctcactgctagaaacatggacgcctagagtgcatgaggatttaagttcatggagtgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcggaaacgtggacgtcctcagaaaaccataacgactcaatggcgggaagctatccttgggatcacaatggatggtggacagaaccgtcattgtttaatatgaacactggtattaaaacttgatcagtctatgctagatcttaggcttgtgaaaagaattacaaaacttgctttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctttttctgcttgggagatgaagacgatggcgctcagtaggtcttagtacggtcgttgcctgtggcaatggcttgccgctgcctgaattccgctgccttatctatttctgcttttggatgtattccggaccgctcggtccgatgatttaagactacgcctgcggggttatgatgtaataattcgtattagacactcgtgtatgtgcacttggtatttcagctataaattcgtgtgt

SEQ ID NO: 76142 - DNA, 701 bp, Oryza sativa
acggtaatttttcggacttcccgaaaagcacagagtaaaacgactataacttttcacccgggagtccctttttgatgaacttggactctatgaaaagctcactcagaggattacccaactcaaccaaaaagaaggtctaaaaccactcaaatgataggttaatgcttgggtttctctcgaggtagtactatgatagctcactttgagcatcgaggcatacacaaacacctcgacgttacatccctcttaatagtacggcattcctaaactcaaatgtaaataagaagataattataccattaggaatgcctttttttcatctttctttcattgtcttgagggacgccaatgccgataccgtttcaccatatattcttcaaatgattgatgcggttacttgtagcttcaaatggtctcgcacggtccatcatgacaaagtcgtcactcgcccttcaccaccggatttggttcttcggtgccaagccccttgcttgcccttcaccgccgcatggtccatcgcgaccgagtatcgcttgcccttcaccgtcttgccataatagccacttcatatcacacatcttcaatatcttcactttgtcattcttggtattattaggtgtaattgtatcacttgagcatcaacacctttgtaatccttgggacctatttctttcattcaactcaataaaattattagtccc

SEQ ID NO: 76143 - DNA, 53877 bp, Oryza sativa
attcctgcagcccgaatgaagagctagttcgtcgaatcttctatcccccggatgctgaggaaattttgaggatccaattgccacatagccctgaagaggactcattgcttggcactatgataaggtgggtatgttcactgttttttctgcttacaaattagccctacaggcccagatcagagctgacgaagaggttgcacaatgctcaaatggcgatggtgataggaagttgtggaagaacatttggaatgtgcaagtgccgcagaaaataaggatttttgcctggagagtatcaagagattgtctagccacacaacataataaacatcgacgacagattgtacaaaagccaaactgtgagatatgtggggcagaagtggaagatgcgtttcatgctacggttgcatgcacgaaagcagctgcgctgagggcagagatgcggcagaatcggtggctaccgggggaacaggagttctctcagttaggacctgactggctgctacatcttataaaccgtgccgacgatcagacgagggcgttaatattcctgctgttatggtgagcctggtttttacgaaacaatatagtgcataatgacggccatgcttcagtcactagttctgtggtgtttcttcggagttatgctgaatcattgtttctcaaccggcaaccaagagctgacagaaaagggaaggctttgtgtcgccctgaacaggggaaggagtcaggtccaactcgggcctttccatagcaacgtgtttgttggcttatgtctgtgaatggctgggctaaaatcaatgtcgatggagctttcaatcctgaaaatggtaatggggcacttggacttgtaatcaggaattcgaggggcgaagttctgttgtcttcttggaagtttctcaggcgatgtgtgtcagcggaggaagcagagctgcttgcgtgctatgaagggctgaagctagctgctgaatggattcccatgccagttatgcttgaatatgactgtgccacagcgattgcgaggttgttgtccactactgaagagagatcaagatggtcttttctgctgcgagcagcaagatcagttatagggttaattaaggaagtgcgtttgatgcactgtaatagagagtgtaatagggtcgcacatgaacttgctcagattgctatccgttcggggcaaagcgcggtttggcgtaataatgcaccgaattgtgttatgcaatgtctgcagcatgactgtaatcctgttacgtaatcaataaagctctctattcccgcaaaaaaaaaagtagtaacaaataattggggttaatgatgagcagagcgatccatggttggatcgatcgagctacctaagctatcatctgcattacggcagctagcccgatcgatcgatctatctagttgggggcagatgatgacaagagatgctagccagctgcagactgctgctgctaatctcgtctcttctgatatcgatcacccacagaaaaggggagaaaaaactcagatcgggacagacagcccaaggaaaacaaaagacgaacacgcagagtactctggtgataatcagccacttgatcattaatttcttcgtgaccgttggcgtagccctgcctcaaatcaaatcgatatatatatattcttcgatctatctactctctctaggcttctcgaatctcgaaggacgatgatttgtactccctccatcccaatataaatgtaaagcagatataaccagcttatacaaaccaaaactacctgttcggattcgcactattagagtgcgttaagttgttgaatgtcagtgttacaatgagcaaagcaatagtccagtattacactttgttgtaatatgacgaattgagagccaatttggattgctaccctaccaaaatttactctaccaaaacactggtagggtagcaaactaaacacctatattaaaacattacctttgtcataaatttggctttgcccataaacttataccttatgggtatattttggcttcaatcaaaatcaacattttcaactctaccctaccaaagttttggcggcatgtctaagatttagcactatcaaaattttgatagggtatcaatccaaacatgcccttgtactatataattagctttggccggtcggccgacagaataattaaccttggcggtttttagattatacttggtggttttcgaccgccaaggacatgccgttttcttgtagcgtattgactctcagaatatatctaacaaaactgccgttcgtgcacatgtatttaattacgttgtaaattgacaatccattctctcttctctctaatcgtaaactaaaaacatgtgtgttaattagactatgattttaaaaaacaactcaatacttagaaaattattttcacagctccctttatttttacaaatgggctaaaagaagattcacttgtgaaaatatataggactctcacagtcaacaccgggccggcgctgtattttagacgaccaagacgcaccaacacatacgttatattaaaataaaggagcacgaacaccaacaacaccttgcttctcacattttccttaaactctccacacttccctctcctcttcgttttttctttccacagcacagaggacactgccttggctcctccttcccctcttgtagatggcggccggcctcaagagcaacgacgaaaatgacaacaaccttaggagcggcggcggccttgggagcgcgcgatggatccatcgccactggcctcggttggggcagatccccagcgtgcatgggagcgacgttgatgatgaccgcgctagccttgggagaggcatatccaacgacgggagtccagggatggcatcaacaaagtcggtggcggccattatggggatggttgcggcgatgatgacgaattgcaatggcggcgatttcgattggggattggggctatggtttctgtaactttttggattttttatatttttcgccaaaaaactttttgtagtcagggttgaaaatccgttccgtcatacggttatgatgcccgcaatagaaaatcttgacttttgcataaattgtcttaggtgggtgctccatctatctaggaaaggtggttttggtcggctgaaaaaggccggtctgtagtggggatttactgttagtttctatcagtatatttcagatacccctcaatattacaattaatactgggaaagcagaggcacttttcgcagcaaatatcaacatatacatgtgtcgacgtttgatgtcgcgattccggtatttgcatagtatgagaatcgttggtactagaatatatgcgagattgtaataaaagagatgtggacgaggatttttatacaggtttgggccccctgaattgtcaggtaataaccctactcctgttggccgaagccggtcgttactcttattcaccataatcacaccagcataatatttagggtaacctatctaactgttgtcgacttgacggtctgaagtgttgactcgtagtcgacaacagggtagccttcctcctcaaatccgtatccggcgagattaaagacagcgttatgtctctcctgagagtatccgtagacatcgtaggggactaaccatgcttatctctgaagttgatatccgacgtcttgtcttggcacatgttggcttgtatgttgatcttgtgtcttgatctattgttccgtgtcccctctctcctaggggccttgtatttatacccataggtgtccccttgtccaagtagaactaggaaaaccattatggataaatccgagtagttcttgtcgtttccatgtagaactctattcatccttcattatgcataactcctcgtatatccgaaggttgtttccgtataagacatggtatgtggtgggtcctaccgagatttagtcaactactattaggtatgtgatattcataaccctaacaacatgtgtgcactgtgcaagtgcaccagacattgacacaaaacaattcgtcgatagacaagaaaattcacacgcagagacatgcacacaccacatgctctttcttcgaaggaaagaaatacacatgactcgatctgcaggtgctgccaaggcatcacacgcaagcagagacgcaccacatacgtacatctaaggtgcttacttccaagatgcgtgaaaaggcatctctctctcaatgtggtcttcaagaaaaaaacaaaccaaggtaatatttctctcggatttttacaggtatattatgcgtgtatattaccgaattgtcgttagttcactacacgagaaagtgactgaattgtcctaagtaatataaaatatgtaggaaacgaggaaagatgagagtgtgtggctagaaattaataaactgaaacatgatatatactgtttatcatgttacatattattaaagttttaatttgagtcacccttaaaccaatctttctattttgtatcagattgttatttttttatttttgagtttcttaaaattttaaatttaaaaataaacatttccaaaattattttcaagatccgaatcttctggtcaagctaaccaagctggcatggcgaaacaatattgtcacacggtctaaatgacgtagcaacgttatttggtcacgccgatatagctagtgtggcaacattatttggccatgtcattatggctggtgtggtaggataaaagtcacacctaggtagcatgacgaaaattgttattttactgggtcaggcgagctgtcatgaccaaaaggttccgattttagaaaattaaaatatgaagggttatttatttttaaaataaaattttaaaaggttcaaaaataataataaaaaaaatattattttaccctttcttcagtttggataatccaactctcttttctactcatatctagcctccagtctagcaaagatatggcttgcatatggataggagagtttggcgaccggtttgccagaaccaatttgattgaggtcgttgatgtgtaatgaagaagttgtttgggggtggttaaactataaaagcgataaaattcaatggtccaaagtaaaaagattggtttactggtgattcaaagaaaaactataataataaaatatagcctaaatttcaatacactatttttttatgaaggaagtagcagtatggtagcatggaaatgaaacgatggactaataaaccgagccatcatcatgtctagctactactggctactgatctcaaacggattcgtccacatcttgtctatgactttcaatgcaaatgatgctcagacagattatgatattatcctaacaacttttatccttcctaagcgatcgatcgacgattaatttcacatatcgtatttaggctaagatttgtcaattgaatcatgttccattttccggtgctttgtggtagcacaaaaggaaacaaaaggacattgctcatgggaccccatgctgaatgaaggagccacacaagggataagagtgatagatccagcttataccaacatgaaacactgtgtttggcttatgtggatgaatcagtggacactatctagtgtatggagaggatccacaaatggggtacttggcaaattgagcatggtgtttgcccccctggttcaatggacttgattgcgattgatgatgattttaattaattgctaatatatactaattagacatgtttcttaatttccccttgaaaaagatgaacatgcatgacatctataatacaggttattatcatggacagtccacttttaaacttttcattgggactctagatatatattacttactctatctctaaaataccttatatttagaggatgtttagatctagggtgtaaaattttgacgtgtcacattggatattatatagggtgtcgcatggagtgtttgggcattaataaaaaaactaattatagaatccatcagtaaactgtgagacgaatttattaagcctaattaatccgtcattagcaaatggttactgtagcaccacattatcaaatcatggagcaattaggcttaaaagattcgcttcgcaaattagtcgcaatctgtgtaattagttattttttagcctatatttaatactttatgcaggtgttcaaacgttcgatgtgacagggtgtaaattttttggcagggatctaaacaggcccttagtcaatctcagatatattaataaggatgtgaaaaaatgaatacgcctttcattaactgtatgcttctcctaagctttgatgctcgactaaggctgtgttcgttaccggggttgggaacccatctcctccgcacgaaaaacggagcggtccaatagcacgtgattaattaagtattagctatttttttaaaaaaatagattaatttgattattaagcaactttttatatagaaactttttacaaaaaccgtaccgtttaacaatttgaaaagcatacctacggaaaacgagatgaaagggttcggaacaggctgaaacgaacgcaacctttaactcttcacatggccaagctctaattaatgatatttgcaacttactattggaggtggggacgacggtaatcaagggagataaaaacgaggataataaagtgggccaatcgacacacgcctaaaaataaggtcttttagggtgaagcgaatagatagtaggttgtcataagaaatttaatatgaattactagtgcatgttttaagaccataaaagttgtacgaaaatactagcaaatgacttacagtacatttgcaatcaaagtaaatattcattctgtttcaatttacttgtcgtattagataatttcacactaaactaggtggtgtggaaggggctaccctcattaattacatgctaaccatcgtacgtcttctcaaagccagcaataaaattagaaaatgctacacgtacgtccgaaatgtccgactcctgtacgactgcaacgtccgtccatggcttgatccccgcgctgtttaatcctccaactcattgagcctcacgccgttgtgcatttgctgttttgacgtttagtcgtacgtcggtgggacaagaaagtcggatgtatagcagtctctccaagttaaaatttagaaattttagcaaaaaaatctcattccaacagcctctctacttgaatggctaaactagatggatggccaaacttcacctcccactagccaaacttggccagccaaactgactggccaattgtgggccccacgcctttccccccactctatcgatctatccccgtccctctccgcattgctcgtctctgcccgtcatgccaggttgcgaggagggaagagggcgcgtcggtagggcaacacgactatgagcgtcgcctcggcctctggctcgccgttgtcacgacgacgagcgtcgcctccggcctctagcggaattttctccgccacgagatccgcacgtggctgtgcagaggaaaaacccagggaaaagggcgacgacagggcggcacaacggcaagcctcgccgtcggcctccagcgccgatttctgccgccttgccactgtcctctggagcttcggagagagaagaagggatgaagggcagcgacaccactcgtttgcgggtgagagggcacgatggcgagggatggagggcgcggtggtgagggaggagcgaggtaggccagcgaggagctgatccgcgcactgcagcccaccggctcggcgccttctccgctcgccgctcgctgctttcccctggcccacctcccatgcccgccgttgccttgcgtgcccacgagtcaccaccgctgtccgtcgtcgcctcgcgtggcccgcctcccgcgagttgtcgcaccgcatccgaggtagaggggaggaagaaccgaaaaagggagatgtatggggggaatggggtggaagaagtgtagtagaggttgacatatgggtcccatttgtcatagacttataatggagatagtagatggagaggctgttggagtaaacaacgagtttgacttgctaaattagatggagagtttgccaaatagacatttagagagtcagatttggagagactgttggagatgctctaaggagtactagtactagtattactgcattggtgaagggaaggacatctctaaaaatatttttgtatgtctcagaacgacaagtattttactaaaaaaaagctagaatgacaagttaattgaaacggagggagtaacgaatatgaattggcaaaattaaatcttgtgtgcacctacagtatattttgaactatacagtaacattttgtattaccaaatgtccatgtccaagtacctttgactaatctctcctacagatgcaaaaggaggtcaaggaaatgaagaaacttctgcatcgacgatcatgataaccggcatattttcataaagatattctaactgctttctttcacaacgatcacttcacaatttcaaccaacagtcctgtctttgatcgatggtgcttgagaaactacaaagccggtctcctcttttttgtttacctaagggatctatctatcctagctatccaaaaagctaattagctagtgtatgttgtacatgtgccatgtcctacacatgaacggttttaatttagtacccaaacaattaggtttccccagtgctgaattaaattcttgtatagcaatagcattgttcatacatgctgcacatatatatgcatctccactgagctatcagtgctggtcgtcttgtcaactaagatacactacactccatccattcccctattctcctttgtggctaccaaccagcaccctcacagcctcaccaaaggacatcacattacacccctcaacacccaccaccctcacacaacatgttgtcctaatgtttcctagtgttgacaccctaagtgtgtgcaggtgcatcagtatgtacacaaaaaatgcttccattggtgggagtttgtcccatggaccatgatttttgtaccattccgtatagatgcggccaatcccatatatatacacatgcatgcatcatgtgtgtgataagcattttcattttatcatcgagttgcatgcaccgaccggttggattacttgatcgcgttgctagatggcaatatatgcatgccatatgtgtaatggtggagccagcggtattatcgagcatggatagttaatagtattttttgacaaccagctagtttttacgggcatcgatggtaattgtagtggtaacagtagagcttgggtggacatccgacatgccaagaactgccttctgcgccattgcatatgtttatgttgacgtgtacgcgcctcctcggttgttcatactttcgattgactatgcttttgcactgtaattttaggtaggtgttaccccacatcatgtgacattcacatggtagacaagagtctcctaacttcaattcatcttgtcatatttggccagccctggcctgacaatgtccctagacaatatgtgttgggggtttggaataaatgccgacatggtgagcctccatttagaactcatttggttaatttgtgtactatttatatagcaatgtgttttagttttcttttatttgatagtaaaactacacatacttcctctattccaaaaaaaataaagaatatgatacattacagtacaacaaatttataaaaaaaacttgtacaaattcattgcattaaaataggtcgcatcatatcatattctagtcttagttttttttccttatacaaggagtatatagctgggtcgatctgactaagggggtgtttggaagagaggggcccctaactgtgccctgccatatggttctccataaatgcctgctgtagcatccatgattgaaccatgtgtaacaaaagatggagcaggctagccaatcaaacaaaggaatccaggaggatatatgctactgacatgctagctcatcacacactgctctgctatgggtacccccccaccccccaacacacacacaaaatcgacgagggttatctatagtactgcacagttgtatcattaatatgtgggactatagatctacctgctcgccgcttccacaacaggggcggtactgtagaggatccgtgtcagagaaaaaaaaactttcatattttcctctctaaattaatttgagaataaaaatgttatacagggcctgtcgtttataggttttctttttatgcatccagaaaaaccccatgtcggtcatagtatatctgtatatgttactaagtaattgactggtatttttagcggaatgtgacatgaattggattagcttgacaaggagatcgtgccggaggaaaaggacaaatgatatttcatgatagaagatgctctacatatctatcgaaattatgcatttggtggctagctagctaggtccccttacgttctaaaaggtcatttttactcgttttccttttcctttaagttgcgtttctttcttgacctgaaaattatcagcagagatagcccaatgcaggaattttgcctgattattgtgaggaatgaattatttcctatgaaatttcttcaaaaattctgaatacgtgatatatatattataaatttatataccaaatgagtcaaaataaaagaaatgaaactgttttcgttatatgtagtaccggatcaaacaggactatactacgtaccctgcatcacttatataaagttgctactccgtactaggcttcgaaccaatcatgtgtggccgaaaaccgtcaaaattaatactacctccattcaaaaaaaatattttttacctatctcacacataccaatataaaaaaaatagaatacccctactttatcaaatcctaatgcaattattcctcattttatctactcccgatacaattattcattacttttataaactatgatatgtaatggttattttaaaaatacttattttctgacaaatgaaataagccaaaaataaacttattgcggacggagggagtagctccgaaatctggtagtgagtagagcttactaggacatgtatgtgcgattcaaattgggccaagctatcttaggctaggcttgtcatgctgcatatatatgcatgacgattcaagcatgtttttgcattgcacaatatatgttggtgtgctatagctaatagtgtcatatactacctccatattttaatgtataacgccgttgactttttgatcaacgtttgaccattcgtcttatttaaaaaaattatgtaattattatttattttattatgacttgattcgtcatcaaatgttctttgagcatgatataaatattttcatatttgcacaaaaattttaaatgaaacgaatggtcaaacgttgatcgaaaagtcaacggcgtcatacattatggtgggagtatatacgtgcatgcagctaccggtgacctttcagtgattcatctagtcaccctatatacagtacacaggccggcagctagcatgcatggatgaaggagcatgcagctatagcctagccaagccaaagttgattgatcgatatgacccaatcccaaagtgtgtatgtatatcttgtttgcatttgcattgcaattttgcatggatggatatatcgatgtcatatatattgtatgatcgatctagagctatatctatatatctatcttaccctagaatcatatcctgttgtgccctgcatttgctacttgcatatcctgtttgtgctcgagaaggaacaagctatgtcgatcggtatatgtgtgtatatgtgcccatctatcagttatatccattgtacctccatgctgttgtggtcgacaatgattgacatatatcttgtgcacaatcgctcggtttgcgcgagatatacatgcactacttttacaggccatcccttttctctctcgatgtgtggatcgaattgatatatgatagtataacatatagtacctcctccgatcacaaataagtgacgttatagatgagaggcggtcagcgatacagttgtttgattattactccttccgtttcgcagctactctcttcgtctcaataaattaaacatttgtcataatactaggatacaacttttttttacagagagagtaattcatttctgacaattctcaggacaaataatagtgggagaaatggctatggtgtcccgtgtccatcattagtacagtattttctagaggctccattcaaatgcacgtggagagagtaattaatactacggtatactccctccatctacttttgatagtcatatttcatcttggtacaatgaccaaggataagtgattctacttatcatccatttaagctattcctcgtaaacaaacgatttattaatatttacatttctcgatgtctatatagccaatcttgtgtggaagaatagagagtcacgcattaaattcgagaaagtcattaagaggatatgtggttggattgaaatatgcctatcagatttggaaatatacttatcaaaagtagacggagggagtaacacttatgaaaaatgtggaaaagttataattatttgaaactatttttaaagtcaactctagcaacaacatttttaaattaagttaaactcgaagtgttcaaagagatattaatggtcaaaacttaaacgagttgactgcacgcattaatataaaatatcacttatttaataagtgaatggaaggagtacatgttattgaagtttttcaaattttctcttaactatttagataacatacaagaaagtggacgcatgtccttatataagccttaaacctcacttttgtaccataacaaataaatatatatataaccatgaattggtggcagactgatactgtgacagtgacttattatgttgcatgtcaactcaccaggtaggtttgaagtgtttgcagtaggcctctaaatgttctttgactaaaagaacaaataaagctgaagtcctacgatttttctcagaaaacatctcacattccagccgacaaggtcatgttattcctagatcctccactgcttgtgaagtggcctaggataagctttgtcatacaatctgaagggatcctaatggcagcattaagcaccgatgaaattgatgaaaaagggagctatatattgctataataatataatattagtcaatgagaattgtttatatatatgtagatatcagacaggccacgtacaccttgcattggccacattgtgttgtttgcgcattcagcatcataatccatccatccatcagtgtgtgtcgatccgttttagatagcggttttaattataattgcagtacggccactagtacagtgcattggatccccagatgctgatgatcgatcaatttaccaaccaattatgtacaccagccctccatttattaatgatagacctatctgatctccaccaatcggaggggtcttctctcaagctctatatcggatcacgttaagattcgtgttaccggcgaaacagcccttaagagcatgtacaataacaggctatagatcagctataaacacatatggatagtgtgcatgcctaagaatagatatcaagtgacaagtaattaatggggatcagatcgatgaagattgacaaagaaccattggcttgattgtgtaatgcaaaggttggcgcaacgaattcatgggtaggcaggcttatgtgtggactacaggcaaatctgtatttttcttaaaggcaacctcactataaataaaagaataaaatatctcgatggagccaaattttcgaggggatgtaataagtggagtagatgaagcaagggatgaagcaagtggggaaaggaaggggtagagcatggaggatgcgagggatattagttaggttcaataatgtatatcgacacaagttttgtactattaattagatggagaatgagttgccaaaaatcaaatagtattgtaatgaaaatttaaattaatgtttatatccaatatattgattattttttatgacaaaacacacacatatataactcataatatctatcttattaattacttcctccatttcacaatattttccgcagcttatttatactttgttagcacaaaccaagaaaaagaactacttctccctgtcaaataaatctaccccatttcacaatatttgtccacagtatattatgagtacaaaccaagcatatatatatatatatatatatatagatgtttgatccaattcgagcataatattcttacctttttacccctcttttctatagaaaggatttctctgacatggtcactaacatatattccctccgtactcgtaaaggtagtcgtttaggacaatatttgagtcaaaccttgggaatataaatcatgaataactctcaagttgttgagtttgaaaatgtaaaaattatatgaatagatttatcttgaaaaatactttcataaaagtatacatatatcacttttcaataaatatttttatagaaataagaagtcaaagttgtgttttggggaccgtgtcgctgtccaaaacgacttcctttacgagtacgaaggaagtatactcatcgtcattaggccaaatgtcagtgaccacttaaatcaaaggatcttaatcccttttctaccttacatttaatgatgtggatattgcttcttttcctaaagataatggagggattaattttattggaccagatagatatgtgcacccctgaatatagttagttgggatttgctccatcaagaaagctattcgatccgttaattagcagcagcaggtatgctgacatgatgctctcttaattaattaattaattaaggtagtggttagcaacacatatactagtacaatacgtgcttaaacgacaagcacaaaacaaaagccattagggaaagctaatgtggctatcgatggaaagggccaattcatcaagcagctaatgtgaggacgtgcaacgagacaaatcgcaaatcttttcttgtcgccgtgtgtacgctctgcgacaagcattaatgcgtctctcaacgtcacttttacagcctttggttccatgctaaaataattcgaccgttttttgtccccgatgggggcattaatactccaaaaatatcgacgtcgcgacgagcaaaaaggtcgccgatcgatcgattaatttatataattaatttaatggttattcttttcttaaaacatatgacatacgtatgcactcgtataaacgtgtacacgcacacccggtatgtatggacagaaccgaagagacgtaaatacgaacactctgtatctagaatttaattctgaatagacaaattccaccataataaaaaaaattaatcagttgactacactcacttttcaaattaattggttattattgtacttaaaaaccaaaggtatttctcaattaattatctttctttcgtattcaagtcgtgggtagaagcaagatcagatactatgatattattatcgtccactcgcacttatacagacccttttacttatatgtggatgagagaaatgaaagagagacgtcagtaacaaccatctctttctaaccataatttgtatagcacatgggagaattaaatgccaaaaaggacaccgcaatagaaacgtattgttacaattatcgatacgagttctttattagcggatatgacatatcgctcaaatatgagcgcagtcaaacttcgaaaattaaattattaataaaaaatatcaggatttaagatgtaaaaaatatattggtagattcttgacaaaagaccctctttttcatatagttatactttaagtattattgacaaatatatagttcaagaaaaaaatgataaaacattgaagactctgtcgatgttttagaacgtcatcctagctatttagaacggaaatagtatagtataagacagttattacagacaactgctatatatgtccaataactaaccagccaagatgaatgaacaataaacatatcactaattgatagagttaagagtagtgctgctgttcatatgattattatttatttatttttttcagattccattgtgctaagattccttctcttttcagctggatggctccaaccattgaggtcgtcctaaggctagagagtccataggatgcactgactagagtactctgtgcatggtgatctactagctactacactcaatattggacaaaagataccccaaaagtgccatgcaaccctgtccatttttctattattagcgggctgtactgtggtttggtgacagggcttgctgtcgcaatgcagttggttagaatttgtagttgcaaaaaaaaatgtatatatgcccctctgctgtgaagaacataattgacttgttaatgaaatcttttgcatttactatatcccaaaaagattccaagaaaaataacttgagaagaagaaagtagtagtactactgtaaattgaggtgtgatgcaaatcaaattgagttgagacaagtgtattttcatttaccaattaagttgtttttctcatgtttatttggactaatataatatttctattattattcaaaaatatgttcctatcgattcatatagctcgatctggtttttgttctgtttctattactggtatttaattcagcattttttgtcgacattttagtggctttcagagctactcttcttgtaaaaccaaaaaacaaaaaagcaaaataattaaagtgggaaaagcacactaggtgtccaaaagttttaacttgacaaagtaaaagaaaaggacagaaggaaccttagcttagctatcaggtgtggttaataaaaattaattctactgtgcccaatcattcgcctttggtttgttaatttggaggtgagatctcaatgtgggtcccagctacatgctatacactcatctcgtatcaggtcaggacaaaccaacggacaaccgtccatggcgaatttgattttctccttggacattttcacacgcggtgacttaaatttatcctcgcgaaattcaaattaaactgtttgccattaaaaaagttttccctgaattttgtacggttgtagtttattccaggggataagaacaacatgaccaacaagtgtgtagcacatcgtttgtctgacagcttgtctttcttctcctcgttgtttcagaagagttttgtgagttggatagcagcaactagcagcttgtcacctctcactcacaattaatagataatttcagggtgttatgctccctccgtcccctaatataaggatttaaacattttacttgtactgttttaccattcgtcttataaaaaacttttagaattattatttacttttttacttactttattatctaaagtattttaagcacaactttttactttttatatttacataaattttttaaataatatgagtggtcaaacagtgcaagcaaaatttcaaaatcccttatattatgggatggagagagtacatgtttaggtaaagaaaaataagatcatccatggtatctatggaaattgttgtaattagccgctgagctatcacacgatttgttgggctcctttcagcgaatatgaaccaataatggataaattgttagtgggaatactcaattaaaaggagggaaaaggcatgtgtgtataaatacaattaggctgagttcagtacccatagctcccaactcgtacctctctttttcatacgtatgcttttcaaattgctaaacggtgtattttttaaagatttttatatgaaagttgctttaaaaactcatattgatctatttttgaaaaaaaaactactaatacttaattaatcacacgttaatagaccactccgttttccgtgcagaagtgattagttatggagcttaggagggttaaacatttagtataggttttatgataaataaattgttgaaatgagcaaaattgtaggggaaaaaatagagtggccccgaaagctattcgtcaagccgattgggttaatcattttgcacattaattttggaagatgttcccatagaattcccaacatgcataaggagatgtacatctattttaaccctaacaataaaatagggatattggactgcccttgacgtaattgtttgatcatttggcgcgtttagcatataagagcacaatacgtgttagttatgcaatgtatttaccaaaacaagaaaaaggtgcaagactcccattcttttggccttttcctcaccaattccacactcctgccttgagctgtatatgacttgtaaaagatatttggtttacaactttccattccccataggagaaaggcccaacgggacttttcgccggagctccattgattgtgaaatatgggaaatgtaccggcaaatggccccctttacgttcgaaacaaaatacatctctcgtggcattctaagatacggggtatctgtgtgcgtatgactagcatgtctgaattttccccatgtaataacatatggttgtagtcagcggggccatgggcggcggtgggccacgcgttgcagcggagaaggtcaggagggcggcgctgcggcaggtagcagcaagacgttggcgacgatgtctctttgggtggcaggtgctgcggagcacgacagcgaagggtgcggcggaggatggcggcgtcctaagcgtcgacgaatagtcctcggcaagaagaaggcgaatccggtaaaggtggtttcgtaggcagtagcgaccctaggggcgatagcggcctgcgagtccgggtagaagacctcctcagcttcggtaactgcggccctaggggcggcggtggcctaagtgccggtacaaggatcttagtgaggaggaggccgatcccggcggtggcagtggccctagctaggggcggcaaaggcctcggagtcaggacgaaagaggatatcctcggtgacagctgttgaggactccaatagcggcggcaacgggctaggggtctgagaggcggaggaggattctgatgtcgatggaggtctaggaatccaatgaagcagaagctgatccttttggctcacatctggtcggctagttctgactgtatgacgatggatgagtggggtttaaccggcgtcacgtggcgtcagctcacttgaagcggatgaagatagcaccagcggaatttcgtagcgacaacgcactaggggtgatggcaattagatgacttccactcgttgaatttggccacttcaagagaggatgtggggaagcagggatgtatagaggtcgtagtgtttttttttccctttttttttggttttgtgttctctttgttgagatgtgagtctaattgttcttgtatcattttgattttgtatatccctcgtagatatagaggccggactaatgaaaatcaattatctaaaaaaaatatggttgtaatcatttcttaatatttagcataataatcaacattattttgcaaagaaaaggtaaaacctagaccattgcattattattgttactaaaataaaagaaatatagtgcagaaaaaatcatgatgaggattagacatatattcaggaactagagtggactcgaatccttatatacaaatttttatatactaccgcattattatttgtttatatttaaataagaaataagaatggttccagggcggcgccgtacgtagcctaaagagagaaaagggagaaattggtggagagcgcgtgggaagcggcgggcggcggcggggctgcacggatcccacccaatggcgacgcgccctctgctccatcgatcccgacaacgcatccagaaggcgccggcgacacctcgccgccgatcgtccgccgcccctagtcgccgccatctctcgatcatccccctgtcccttcccttccacgcacggccggccattccatcgccgcctacctccagacccaatgcatcctctctctctctctctctctctctctctctctctgtctctgtgttaattttgtaatgtattagcaaccattcatggatggatggatgatgatgatcatggcctctgtcctctgtttttactcgtggctgcagactagtgctgtcttttctcttgtttgctgttctagaatctgtgtgctgttttctaaacaatttactgtttatatttgttttgttttgtttatttttgtagttgtaatataaggttagtcttcttagtaaatatattgaaaaaagaagaagtagataacacggtttgaatcttggtaattgtactgtgctcgacaaattaggacgtaatcctatcgtttcagattataaaatgatttgactttagtcaaagtcatgttgtttcaagtttgactaattttatagacaaatataataatatttataatactaaattagttaattaaatatattttcataataaatttgtcttgagttaaaaatattactactttttctataaaattagtcaaacttaaagcagtttgattttgactaaagtcaagacgtcttataacctgaaacggatgtagtactgtatatgggaactagcatgaagatcttgctactgaaagtaaaatatcgaatgaaattcgacgtgtatgagaattatacggtaatcataattaattagaagtggctgcatgtgagaatgtttggttctaaagcagacagacgaattaaaaaaaaacaccacggcaacggaggacgctactgttcctgtgaaattcctatgtttaattacctaatctgttttatgtaatgtgataattaaaaattactctggtgcttatttcacattgtgattttactttactataacataacttaatttgtatgaatatgtgtgttattaattgggtggcagtgccactagccagccagggggtggtgatgagcatactagctagatttgtgttgtgtagctaagctggtggccttgtgtgctccacatcactccaaaccctctgtcccaatcaccacattttttcctctccaaatctattaattaatgatccatttcaattcttcatcactgatttattcaccaattaattctctctttttttttcttccactacgctccaaaacttctctccctatatatacctctcccttgtacttgtccagttcttacactcgtctcactttactactcattccactattgtaaagtcatagaaaaaatttatatagagagaaaaaattagtgttgttattgttactggctttctgccagacgagacgagcgagcgcgcgagtgtgttgctctctggtcatcgtcgtcgtcgtcgcgatgccgacgccgtcgcacttgaagaacccgctctgcttcgacttccgggcggcgaggcgggtgccggagacgcacgcgtggccggggctggacgaccacccggtggtggacggcggcggcggcggcggcgaggacgcggtgccggtggtggacgtcggggcgggcgacgcggcggcgcgggtggcgcgggcggcggagcagtggggcgcgttccttctggtcgggcacggcgtgccggcggcgctgctgtcgcgcgtcgaggagcgcgtcgcccgcgtgttctccctgccggcgtcggagaagatgcgcgccgtccgcggccccggcgagccctgcggctacggctcgccgcccatctcctccttcttctccaagctcatgtggtccgagggctacaccttctccccttcctccctccgctccgagctccgccgcctctggcccaagtccggcgacgactacctcctcttctggtatatatacatatatactctcccatgcattccatgcacatacactctacgtatatatctacctctacgtatatatctacgtattgatctacgtataatatacgcagtgacgtgatggaggagtttcacaaggagatgcggcggctagccgacgagttgctgaggttgttcttgagggcgctggggctcaccggcgaggaggtcgccggagtcgaggcggagaggaggatcggcgagaggatgacggcgacggtgcacctcaactggtacccgaggtgcccggagccgcggcgagcgctggggctcatcgcgcacacggactcgggcttcttcaccttcgtgctccagagcctcgtcccggggctgcagctgttccgtcgagggcccgaccggtgggtggcggtgccggcggtggcgggggccttcgtcgtcaacgtcggcgacctcttccacatcctcaccaacggccgcttccacagcgtctaccaccgcgccgtcgtgaaccgcgaccgcgaccgggtctcgctcggctacttcctcggcccgccgccggacgccgaggtggcgccgctgccggaggccgtgccggccggccggagccccgcctaccgcgctgtcacgtggccggagtacatggccgtccgcaagaaggccttcgccaccggcggctccgccctcaagatggtctccaccgacgccgccgccgccgccgacgaacacgacgacgtcgccgccgccgccgacgtccacgcataagctatagctactagctacctcgatctcacgcaaaaaaaaaaagaaacaattaatagagcaaaaaaaaaaagaagagaaaatggtggtacttgtgtttaaggtttcctccatgcaaaatggtttgcatgcatgcatgcaaagctagcatctgcagctgcaagaattacaagagcagagaagcagacagctagatggagataattaattaattaattaatctaattaagcatgcaataattaagattattattctgatttcagaactgaaaaaaaaagtgtggttaattaattattggttaggcttaattttatctagatgtagaaaaagaatcaagatcttcaagcaagagagaagaggatcgaagaagaaggaaaagaaaacgaaaaggacatgctgtgttgtctcttctagttgtaccctggctgctgattaagtgctttgttttgttgctgcaagcttgtcgttactgattattagttagttatgcatctaattgattaaactaatctgtttggcattttggctcgagctaagctatagccaggctggtcaatgataggaacttgtacaatttaagcaattgaacctgatcctgtactggcatgtatgtatatatgcaagtgatgagaaccactagctagtatagctagacatgtatttgtatagatgtgtgtgtgtatgtatatttatattcctacagtggaataggccatggatgtgtaagctagtgcagctacaagtctgcaactttgtaggacacatctggctttgtactgttgtgcaagcaagcatgctctcaacaagttaacaaaccagatgggccagacaatgcatgcatgatccacacggatacaatgcaagatgtagaagaagagaagaacaagcaagaaatagtacatggttatatgttcagggaagctcgaaattctgagaagcagctaagatgagtagctagctggattttgtatgaatgaatgaatctgaaaaagtaaaactaaactggattttgtatttcctgatttctagtttatttttttagattttacaactataaattcttggaattttgttaaagaattaattaggattctgtttgagggagtcgaagatttcgagagaagccatggctccgagaagctcctcgaaacagggctacactatgtgctagcttctttttttttctttttttctttttttttcttttttttatgccgggaacactatgtgctagctgtgtgtttacgaatcatgtacataatacatgtggggcaagagcctgaaagatgcagggtttgggcttttcctgcaagcacaaggccacaagggagccccttttgttctgaaagagtgaaagaaattggagatctctgcagggatccctttttactttttgcatttcagcctggacacatctatgatctactgactactaccccctcatttgcatgcatgcatgcatgaatgaatgatgcaaaaccagagaagatgccatgcatatgtgcattaggagttaggacacagggccaggcctcctcaactaacattcagattttcagaggctgcaacttgcaagcaaatctagtacaaagtactactagtgccaatgccaaatcagatgccatctctatctccatcacacacacaaaagctgagtagttagagaggcagtcagtacagacatggaggcagaggaaatttatgtgatggttgcagaggaagccaatccaggggactggaaatctgaagtttggtgaaggaagcaaagagaatgatgagtgagctagtagtagcaaagctaggtcactgagcccagtgagtgagtgagcgactgactggatgagtgaatgagcatgtgcagaagcaaattgaatgcatgaacacaagagagattttaatttctcggcatcattctcttcctcccattgagatcatttcatttcatctctctccctccatagctggcatgcagcacggcagccaagtcactgaacacagggcaatattaagccattgcaggggatgatcagttgttgcatgcaatattcactgtccgtccagtgaatcaattccaagaattaatgccaccgattttttatttttgatccgcacgcatccctgcacagcaaagaaattaaaaaaccgtcggttttcgatcaaatttggatcaatcaaacttctcccctcaagaaaacataaataaaattatataataaagagctcaccgtcttcgtcgccatcgtctatctatggatggtgacatggatgggtaggtgtagcagagcagatacggcgggctccattggggcctttctgtctacccggagcccggacaggcaccgcgacctccacagtacgccggccgggcgagccggagccccggacaccgacggcgcccgcggcattttgccattgccacctcatttttcatctcctcatctccattttttttatcatcttttttcagacaacgatttgttgttatcttcttgcagagtaggcatgccaactaggctcgccagcgagtcgcgccactgtgatatatggcctgtatttttccgggcttcattatctaacactatccgtaaaccggaatccgcgtgtagtatttgtctaggctctagaaaattcctggatccgccacgcggagagtcgcgtggctggatttatatgcatgtagttgtagttcaggtgccatggtgaaagctagaggtatggaagggagctaggttggaacacttgtaaggaggaggtgcaaccatgtgtaaggcaagatggatatgggtgaaaaaccggatatatgatgatttctttgcaggttaatcttcgctttctgatctttactgaacctcatctggaaccaaccaatccgggcctgaatatatatataaaccttttaaaaaaatccacaatatggcactcgtacaaacgtgcaattaattactccctggaaaagatcatagtctcctaccattagtagcaagtagtagtagctatcccgtttttcgcatgaaggtgtttgtgccggattgggaatttggattgctgcttggtttcatggtgtgacaccacatggaggataacgatggccggccggccgcctcgagcacacgcaactcaaccctgcctcaaagctcaaaaccagtagaagggtaggataggatgctggagatggagtgagctctactccgccaacgacagccaggcgcgacgacatggcactggctgtcgtggcggaacctagaaagattttagagcccggacaaatctaactacaagatgatataacgttagttatggtggcaaaaccgagtaaacttttagagtccggacaaatctaactacaaacgacataacgctagttgttgtggcaaaaccgagtgaacttttagagcccggataaatctaactacaaacgatcgaaacgatatgacgctggttgtcgtgacagaaccgagtaaacttttagagcccagataaatctaactgcattaagtatttgatatctattggttggctttagtataacggagccaaaaataacttttagagcccgaacgaatctaactactggctggttatgtgcatctcgcgatgcagaggctgggatttgacctctcccaagcatcgtccagcggtatttgacatctcactaaaaaccacgatgcaaatacaacggcagacagactgctagctggaatgaaacagggagagatggtttcacgttgaattattctccttttcaagctgtaaaaggatggtggttcagaaacagtaaaagaagttgctgccactttgatgccatcgtcgttgtctactgttctttgtgtgtgtgtgtgtgtgactgaccatgacagtcagcaatacatacacattgccggtgtgtaaatacggccgtaaatttcacaattaagacgggaggacaaacgaggcacattgatttcttcttaatcaccacgcgcagttaatggcgacgcagtaataataactctagatctctcctctttcttctacctttggccatgaacaagatgagctgcgaccccaaagaggaccacccaggatcagggttttctggcacgatcatatggcagatgacacacacaaccatgatttcgatcgatcacccagcacggcaaaagcgtaatggtctctgaaattatctgaattggcatatgctgagtgcatacatgatgatccactccataatgctcctctgttctgaacttctgattaatgttgatccaccaacctggtccagcgtttaattcccaggataacatcgatcctctccaaagaaacaaaaggatgtgatagactaaagcctctccttcaggaatcttacaggattttcacatgaaccagttcgattccgacaaaaatcctcgaaaactaatagtattattcaatccactccataatgcagacagcatgcatgaatggcttgatcttggtagctagcgaggtactctagctagaatccatggcatggccttttcactgcagaagggttggccgggagggacagggataatatcatcgatgtttaatcagtcaggttggggggcaccggcagctgcagctagctaggctaagcaacagtgctactgcagggggacagtggtgttgatgtgtaatgctacagctactgtatgttggttttggctccagatcaatctatcagattcagatatacaaactgtacattccaaacaagatggggatcggatatgatcatccatagatgaacagtcaggtggttagcgatggaaggaacagtgccggatgctgctagctgcagctgctgctgatagctggctggtcgagaggcatcatcaactccattgcactggggaaagctgcatcatgcatgtaatgcagatgcagatgccgttctgaacatctgaatgttgcagggctggggctgggcttgctatgctagctagtagcaaagcaatgcaatccaatgacaatgcccgatacagtattgggttatctaccctccttggaatggatgcagagacatgcagtgaatcattattgtgttcgcctctcatgcaggagtactccctgcatactcataagggtacccacaatggttatctataggctctatataagagatccatgtcagcatattttcctacttggaagagattaaatgaagagagagagcaaagctatctactaacctggagatagtctatagagaaaaacgaggcaatgtattagagagctatagatacccatgtagacatactattgagatgatttactattaatctagtctattgctgagatgtacatgttttatagataacaccttactttaccattgcgggtgctctaaagcatactcataaataaagccgtttaggacaatgtttaagtcaaaccttggaatataaatcatgaataaagttgttgagtttgaaaatataaaaattatatgaatagatttgtcttgaaaaatactttcataaaagtatacatatatcacttttcaataaatatttttatagaaaaaagaagtcaaagttatgttttggagactcgtgtcgctgtcctaaacgacttcttttacgagtatgtagggagtactgcacaatactactactccatccatcccaaattataagacactctttttaaggaaaatcaaacttgataatttttgacaacttttaactagtaagcatactaatcatatataggctaagtattatgaatgttatatcactatattcatattttaaaatattttcatgtgatactaatttcatattcgtggagagcataaaataaaataaattaataatcaaaatatataattgaagacgtataaaaaagattcttataatttgggatgtacttttcaacgagcagtgcttatcagtggcagaaagaaaacagtgtatgcatacaaatggaactgacacaaattccaaaaagatgaacttgcatcatactgtaggtcactgcatgcatgcaatgcaatggacacatactagagtggttcctacctgctgctctacttgtttctagcagggtgactgcacaataatgagtttgcaaattatagagttgcatgtaccgatctagttcatcttgaatattaagatgacaagaaaagacgagcaattcacttatatttcaatacaatactacagctgacgtgaaaactgcaattattttgtgtcagccagatgcatatcaagcctagaggtcttaaattcgaatcacgactgactacaagtttttttaaaaaaaaaaagaaaaaaaaacaatggctgactacagttggcagccttcagatggacctcataaaggaagctgtctcaaaaaggaccaaaacacaccttagaattaatcgtcctagtgttggtttgtcctagtgttggtacacacacgcaggcagatcgagccaacgacatggacacgtagcctactggctgactacacgattaattaagcacatgctaatagcgttggacaaaccaaaaacatcgaacaaaagcttcagttacccagcattgtcagcattaatatgtctaaagttgcagcagcagcagcagcagcagctactacgtgctcggatcagacaccacacgtatgtggcttgcgtgttttgaactgattgggtggttgattagcttaagcctgggtcaactagtgttaattagtcttcgtcaaacagatatatgtacgtctccatctacattatgtttgtcgatcgaacagcgtgaggcccatggcggttggaaagctgaagctggacaggcacggaatgctgggaaaaaagggttgcttcagatgacaactagcagctgggtcgcaacgatgacagcccaagcaacccgaagattttaattaccagtactactccctcggtccctccttcccaaaatatccgcatttctaatgtacaattgttttgtacttgcatatttgttttgtacttgtattaacaaaatatgcgaaattaaataagagacattgaaattggtcaaaaccgggaaattaaataagagactactgtgattagttgaaataagagcatgaaattgttatattttaaaataaattcttaacgctcgaagttgatatattttgagacagatgacacaagccaaggtttaccaaattgtttagggtggggttaccgccacgccacgccacggtttggcggttatcacggtaaccacacggtataccatgattttaaaaactgaaaaggttaccgtacggttttgtaaagcatgacgcaaggtgtgcatgtgattgcagtcactagcacgcatccaggcgagtgaccgtgacatgaacccactgctgcgacgacaacgttgatggagacagatgacatgtagacgccggcccgaacaagtgaacaactagccggtgcaattaaagccgtggctcttgcctatctcaattttaacgggtgaggggtgaccaaggtgatgtgtatcgcaaatgcgtcggtggcttgcattgagcacgtgtaatgtgaggcgtgcgaccatatccccaaactcggctaacccttggcagagaagacatcgtcaccaacgaattacgtataggcgagtgactctcattggaattaccatgatgaagaggctgtgagaattacaatgtggtgaggttgtggacaatgtgaagcggaaggttttaattgggcaagagttccaacgtcgcacgaagtctaattttacgaaaagggagtatacgcttttggtttggagaaggcatggatgcatgggtaggcaagaaggcaggcgacaagaagcagcacgagacaggaggcccaagacagagatgagctgggcccaagatgagatgagatgagatagagggggtgcgattctgacagcggcgtgtgcacggcatgaggtggctgctgccccgccgccagccgatgtgggagggcccgggccccggccggcgacagagacatggtgtgggcgtcgccggcgcaggggacagccaaccgtgccaaatggccccccggcatgtgcgcgatcgtgtcgcccagcactgcctctcgatcggccacgccgtcaaatcaaaatgggcggggacagacaagtagaacagccagccaaccagacaccagcagtgctcatctcttaggagtatcttctacaagtatgttgtatacgcatatgatatagcagaggacacaagggtataatgaaaaactcaccaggtaagaagggcaaggggcaaggagagatggcgaaggggatgcttggtgttggtgtccaggaccaatcttttaacacccagcgctctgctacaatgtgcaaaatatatatgcggcatcagggaccgtcccttgccttttgttttccatttcatatgtaaaaagttgagccagtccaaagttttcatggcagaatgttaacgctaagatgatagatcgacaaagaagaattgaatgtgccaatgcataatgccatggaacaaagtgatatcccagctgatcgatcagtctaaagtcagcacgacaggatgtgaccaacactcgctctaagtccatctgcatgcaagttcaccgactatccgccgtgcttttgatcataggtgcccataactaagactcaagtcagcgagcgaatgtatttcttgcctgtgaagtctttcagctgctaatgctttatatcctttgaaagaaatacaggtatcccatatccttgggcaagtcgacagaggcagcaaccttactatcattgaatattacccacctcccgtctttgaggacatgggcaacgtagtgcccacaatgggtagaggtgcccatatggctcacaaacgccatcaatttgtatcctgcagagcatagagcaatgttaataaaccaagaactgcaaaacacacacacatactgaagatagataatcaaccatctagaagtattgaacccaatggtttggaaacacctacagtctgagacaagtttggagcttacttttatatggtttggctaatcattcactaccatggatttctttacatatatcttaaaagaaaaaaaaattaaaaaagtaagttttcttggaaacttagatgggacatgggtcatataattgtaaatccacatccatttcttgacgataatgtgccatcgttattcagaaatgctcagggcatgtacaaagtcatctttcaaatgttgcaaactacaaattcaacattaacagttcagaatgttaatgaaattagctcatgagattggaagcttggcactagaaacagtaaaacagaaggggtagaaaaacttactgccacttccatctggtatgtgtgcatcatcatcttccatattgcttgttgaagaatcagtaggtactgagctaaaagcctcagggtggctaaaaatccagtctgttgctctctcgatatttccaccctatcacattagaagtacaaaacataagcctccgatcaaaaaggttggttgcagacaacgggaaaggaacaccctaagacagttttgaaaggtcattatatgaaaataagcaaatatcaactttctgagaggtattcaacattgcgaactgtacaagaaaatgtaaaagatcaactatcatggatgaaattaaaaacagaagattattacagaagctgccaaggcctttcgagcaacatcttcttgaaatccgaaggaaacaagagtttgaacgctagtttcatcaacagtttgttcagcagcctgtgaatctttagatattggatcgttgatatctgtatagcagaaaggtgattaaagtttgtagcggtcaagttacaaattacaagacggccaatcatcctttcatgatgacaaagaagtaatatgtaacatttctgtttgtatactgacctggatcatccatgtgtgagagaagccaattcatcgcctcctcaactcctgtgtttgatgtactaatagcagctttctggcaatgaagataattgaaccccatgcttgccagctgagatacaatgtcctcactggcaacaggatgaacaggttcagctttgttatcaccagaagctgcaagaatatgttgcagtcagcaaagtcaatcgggaaaatctgatcaagttgaaaatctaataaacaacagtctaacctccttcaggtagtagctcttcaccaggctgtatgcctttgctgcgcatgtgcgagatatcaattatatctggcacatctacgtatacatctgaggggaaattcaatgtcaagactcaagacaacaaatgaccaaatatggtgaaaagaaactgaattactgtctacatggaaacttagttactacctacgtcccaaaatataaggagtacgttggactcggttattatgaaagtggaactaaatgggagaaggctgtgattggttgagaagaggaggtaggtagagaatttgaatggtggaagattgtggctggttgagaagagaatgtaggtggagaagttgttatatttgggacaaatattgaaggctagaagttgttatattttgggatggagggagtgtatgcaccacgaaaccagctcaggttccaaaatttctcaaacaggagaagtgaaatactaagaacttagaagtaaagcctagttgttattcctgccaaattataggattacttcaaaattattgtttgttggagacagagtacatcaaacaatgcgatgtgttacatcacactacctccctttttaaatagatgaagccgttgactttttgttacacgtttgaccattataatttatttcgttgtgagttgttttatcactcaaagtacattaagcatggtttatatattatatatttgcataaaatttttgaataagacgaatgatcaaacatgtgttcaaaagtcaacggcatcatctattaaaaaatggagggaatatcattcgctggtaataaagcctcattccaatcaacttctatcaacatgaattatgggataaaaagtttactgggccagaaaatacgaagaatataggtcatcatatggataggtactgctagagtgctagttctttcaggaaatcagtccgccatacagtttggggcaactattcgaatctagagtcagcacacatgagagacaactgacacttgatagggacattacctagtttctttggcacccatcctgcttccattacaaacttgcgcatctgcaacaccaggtaatcaggaaatgttttaaagccagcagtcctgaaaaccaacaagttatataatgtgttagtaagaagccatctcctgtttccacatcattaaacagacctatactaaaactataatgaacataccattttactatttgcacacaaggacaatgttgaaacaaaacattgtgaatgatccaggagactaaataagcagaggaatcatgttcaaaaataaaaaccaaggtcatgacacctcacactgagaaattaaaaaaacaaggactggaagttccctattaagtgtctcggtaatggtcttaagatagtacgactaaattatagcagtacacccagtcacagtaatgtgttaatgttgaattgctcaggcattacatttcatctgctatattgagttgaattacagctagccaagttacatataaggcaagtttgagagattcagtcttttacaaactgaacatgccacagatatgagtttgcttgcattttgaaatatttcttattcaatcaataaggctgtaccacatttccatgtatataatagaaccaaatggcaatgaagatatgcatacttaattgctgttgtctttgaattcaatgcagtgctgtaaaattcaggcacttcctccgcgcctgaaaaacttgctaagcatgcctccagtgggactctaggcctcacaatttcctcattagacctgttttatggaagcaaagtgaaacataagtcgtgctcattagacagtgcatgagctatgaacaacttacacttcctttccatccaaatccattgcagctttcttctcatgaaatgcttctagctgctctgcatatctcacaggtgtcaaggatatatgcactaactttataatacaacagggaaaaaggttttaaagtcacctttgttagtagcttcatgtaacggtatgttcaaagaaagaatgtagtcagaacgtttgttataggagacttttccagaagggcattgaagacgctcctcaatgaagaatttgaaccctgtaaaaggattcagctcatggtttccggtgtttgcctgatcaacttggtcaataagatgaaggaagaaatcaagcgcatcctggacaaagagatgagttaaaatgactatttggaaaaaattgtacccaaaattgcagttaatgatgcaaaggaaaattcaaataagtagctcctcaaccaaaaatgtgtgattccaggtccaaagtacctgttgcctcatactggaaaattcgggatgctttgcagcaataactgtcttaaacatacgagggtgtattccttcttgtccctatcaatatggaacataaaaattaggagtattcaaaagtgtgtccaaaagtactattcaggctgtaagtatcaaaaaatgagaataggatcaaaatgagatctgctgatcacattatgtatcagaaaacttagcaggtatagtaagtatatggtactcccgaccttgggccctgttaggaacgccaaacattttcagattccataggattgaactatatcgtgagtaattccattattccagacagggtctcgattcatattgaaagtgaccagtggttaaaattgcatagaattgaaggaatagaagttaaagaatttgtgcatccaatcagtgaatattggctgagttgaaatccacaatagtattaaacttccaaacatgtgggtaggattccatgtttacaccatgtttgatagcaggaagctgtgtgtagcacatttaggaattaaagcttccttagaatttgacttgagtcacaatttatgctacagaaaaggaatattccaacttccaagttctcgcacacagttaaatgcaggcaggttttgtatatcagttgagacttgagaggacttgcccacccaaatagggaccatatttgtcagagaattaagaagctgtaatttgtgcacatatccaaaataaaacaagaaagcagtctactcgaagattgaaccattactgaaacaaacaaaattgctaaggtaagtaggtaactaccaacaacacaaagcgtaacaacaggcaaatatacaaacaaattcttacctcctgatttggcacagagtatttgccagagagcattccatgagccaactttgtcctgaaaatgtcaagtgatgagtataagagcggaaatattttttactaaaacttcttccataaaaatagattctttctagatttcttttatcataccacagtagcactgaattgaggaaaacgttcacttagaaacaaaatgcaaagccttcaatggacacttggacagcatgatatatgtttgattacagcatttgctatgagtctaacacactggaccactacagcacccaggatgaattccctccagcagctaccaagcgcgagcaaagaaacaagaaagtgctgattcaccaaaaaaaaaaagatcctagaaagaatcactttgtttgtgattgcaagtgtttaaaaaagtaattgtacccgaattacggtttcttcacatacaaccatacaggataaatggccaaaaaactgctttatgtattatccttacatttagcattagaagaaggtaacactgcatctcacaccaactacctcagaatagtgactaatccaataccaatacacgcaaaaacacagatcagctggtgtacacttacatttgcatgttcaagtccaatgttggatcagctggggcaattgcaaatgcagctttcaagctctgcttctcaaagtagctgaaatgatgcaagaaataaatgcaagagcatgtgctactaaaaaggaaaaaatgcaactctagacaagaagtgctgaagtatcaattgagaaagtagaaccaaccgtgatataaaaggatgagttgaaaacataacttgcattactgaggccatatagcaactgcaaagaaggaaacgcatgcattacataagagaaattattacaaaagaaaattcatgacgtcaaccaatgaaccaaagctacctatttccaagatttacaaggccagtataaccagggccgtataaaagttcggcatctttgccactttcttgtattctattccagtcataatttgtgttgtgatcaagctctctttcagcagtagtcatctcggtctgcacaacaaaagggtcacatcaaatagcctctaaactagacagatagacaagcatataaaggggaaaacacagtatgaacatgagatgctacagaatatattattcccatgaaaaagtactaatctgttactatcacaataaaaaaagcaagtcatattgagcagagctaaattatcgctcataaatgtcatcgaaaatgatactactcaccttttggagtgaagaaaaatcaataccaaaatgtgacaaatgctgcgctaatagtggatcttcaacgctatcatcttctgggtatgagaaaacgtctgagctgtcacagaaaagcttgtatgaataggtatatttaaatataaaacaacagtaacttcagcagcacatgcccttgataggaaggttgctttaggactttaagaatattctttgttaaaactaaaataagacgaaagcaaaatatttcaatggaaggttaaaatatcagtgtaaattacttttatagtagctaattgggctgtgtgttataaattatgaagtacgagcagtatgtatccagggaacaactctggaatttaagaacgagtcttactgattaaagtgaatattcaataataattgcaatatactccctccaatcacaaaatcattaacattttccaactttttgtgcctctgaataaagacaagtatttataacaaacatatctctaaaagctatttaagtattacctctggttttaaatatatgacaccatccacttcttttctcaaacgttgaccaacaatgtttattcaattacttagttaagtaaagtggtcatcaaatgtactttaagagtgccttatatgtttgtttatttgcacaaatatttctagagaagacaaatagtcaaacgaatttaaaaggtccaccgttttgtatatttaaaactagagggagtatagtattctaaaagtgcattccaagttgagcatcatatatatgacacttttaatttagatattacaaaggatacagtttgtgagaggttaaaaggggtttagttcaatttttcacaggcgacaacccaatgtcaccgtaagttgtattcgataatagaagaggaagcctaaatatgtaaaaggtccacgagtagcattacctgctgcttctaaatcagcagtaattgttccaagctttaccgcaagaggatatttagtctgttcgtagtgttcaatagcatgattattccccccacttccatcccaaagccgcctcccacataggatcatgccatcagttaaatttaaccagagattctcagttttatcacacttgctgcacttccatcctgtaggtggcacaatgacaccattgtctagctgcttcagatccatagcatgtgcactgacttttttcttgtcagcaacccaagaagccaattgttgttttcgatcagcactttcggcaagtataactttgtcaactgcaatcctaacctgtggagttgtagagtagtaagtaactactatgtagtaagtaagtacaatctcttatgtcaagcacagttaccttctctggcaagtcaattgatggaaaagggagagaagtaaattcaggcaagataacaatttcaaaagcctcatcgtattcgggttcttgatcagtgaaacctccctccactcctataaattgtagaaaacccggattagtaaagatggtcaacgcattcatctatttgccatcatgggaatacagaacagagaaaatacaactatatagatctaaatccaggacataggcaactattctaattacaaataactagcatacagatatcacataacaaacaattcaccaacatggccaccatatgttggtctctgtttccagattagcaaacaaagcaatgcactaccatattttttctctacagcacagtagctcaacagatcaaacagaacacaagatatatgataactaccatagtttggtaagtctctaccacaaaggggaacagataatggggatacagattttcaacagtatgaaatacgatgttgatcatagggtaaaaacaagtcgcaataggaaaacgatcacatcatccaaacacaatcacataccctaacgcgattcatgcgttcacaattttaacagtatgaaatacacgatggtgatcagtgggaaagcgctgtcactcataccgatggcgagtagcgtgggcttcttcagcgggcgatccgcctcgtcgtcgggctccggcttccggcgctgcacgatgtggaggtacacggggttcccactcttctcgtagttccacgccacgtgctccctcccgaaccccaggaacgaggtcatgtcgacgtacagcccaccctccgacctctgcacggcgaaatcggcgtcaaaaccctaaccctaggaaaccagagcgaagggggggacaaggcgtgggtgggtgggtgggtggttggttggtttaccggggtgtcgaaggagacgcagcactcgtccttgtggatgcggctgccgggctccgggatgcggaccttgtggaggtgcgagcggaggagatccatggccgcgggcggcgccgggcggcggcggaggaggaggagcgcggcggcggctagggttttgggggtggagacggcgaggcgacgaggtggggggagggtggaagaggggaggagtgattagattagagatggaagaagaggggttaagttggtattggtaggggcaggagacttgtacgggaggcgatttaaacacgggggttagtttggcttttgccggcgcatttattgtcttgtttttagattttctttcagaaaaggcacaaatactacccctctgtcccataatataaaggattttaagattttacttgcactgtttaaccactcatcttattcaaaaaattttagaactattatttatttttttgatttacattattatccaaagtactttaagcacaacttttcgttttttatatttacataaatttttttaataaaacgagtggtcaaacactacgagcaaaaactcaaaattccttatattataggacggagggagtacttctttgtttgatattatattttgtttttttctaatcaagtttcattaagtttgattaagtttataaagaaaaccaaattagtttcactaaaactaatatttaatatattatgataatatatttgttttgttttgaaaatgttgctatatttttttataaacttgatcaaactcaaaaaggattggctataaaatatcaacacggcttataatagtaaccagggataaatatgtgaaacaaaatgatacatccatctatccctaatgattttttttcccaattacaccggggacttttttttttgcaaagtctgtgttcttccccagtatacccaactcacctctcccgttctccacgcgcacgcttttcaaactgctaaacagtgtattttaaaaaaaattatataagaaagctgttttaaaaaatcatattaatcatttttaaaaaaaagttaatacttaattaatcatacaataatacgtatttttcgttttgcctgttgaggatgaagggttcacaacccctcctcccgaatgccgcctaagaacagtttggcactactactccaagattttattagctagagcgatgtaccaaacaccttcaagatcttaaataatgtagagtggaatttgccgctttcctcctgataattatacggataggcatttccgctactcaaaaccgataaaaagttcttgtaaagttggattagatgacattccacccagcctgttttagaaacggttagaacctctagattattttggattactaaaccagtattttccatctactcggacggcattttatcctcctcactttatgaacgagaaatacatttttctccaggttataaacctataaagtcaagtggtaaactaaacaaaacagaatctgagaacctgttaaacctgtgatgatggttgcaacaactaagcattgtatttacctctgatcattctgatgaagatgcatatgactcttctcaaaaattcccatgtaggtgtagctatcattgtgaaagccctacaggatgcagtgttcttccaaactgaagatcagagagaaagatgcacattccctatctgataagaagaaaaatcaatgttcagagaagtaactgaacatctctgatcaggaaccaatgatctgttcacagatttgtgttgcaatcgatcgatcaaaccgtgtcatgggtatttttggacaggctggggaatctaagagccgtgcaaagactgaacatgcaaacagggcaaatacattcgtttattgcaggccagagatgccgattcattgctttccccagacaccaagcatccgtgacgaaaccacgtttgtaaaattcagtaagaaaatttccaatttcttgctggaattgagcatacttcttacaaaaaaagtcccttgaaattcctacgagaatgccacattcatcacattcttcatattcatagcagagatgcagcagaataacttcttagaattcagaccataaacacttcagtagttcagatagactatgattaatactaaagcatagttcatgttctgtacaaaatgctactttcccagggtcagcaaaaggtatactaggatagcaatattttcatcagtcattcagtagccagctactttgtgggggatattataccatatagagtgtttataccatcatcacacaatagctcttcagagctgatggtgtgaccaaaaaatgaggaagaaaaaggcccatccttagaagagggttagagggcgcggctagcttgaaagcacatcatttccacagcttgacgaacttgtcgtggctcgtggaagcgaccaaaccggagcttgacgacgccagggctgtgatgaggctgtcatgagctgcgagcgtcatcgttctgttctccgacatgtcccacagctcaagagactgcggcattcaaacacaaaaccagaggtaagcgtactacaggcattgtaaacatgaaccgcggtgaaaacataagtggtctctatggccgaatgcttgttcttaaataggaaaagtatttcattgcagtaaatcttcaaaataattgcatgtgtatcatgaaggaatatttgaggaacttgatatatgtgtaatgatgtactgaaattcaagttgtggaatgatcctcagtgtgagtgagtagtcatgagttgatctagaaaaagtcatttttaaccagctacttaggaattaggatgatcagtgcagattagttttgaatgaatcgtgacgcatgagcataaaagagatccacgaatataaagtacttgcctggtaacaaccaatgataagcatagatgaatatgaagggtggaaagcacacgagtgaaacttgctcccggtacagctaagctcttgcacgcagcgatcatcgctcccagcattcacagaccacaccttcaccgtgtcttcactgacagatacaacatattcgccactgggatcccagcatactgaatcgacatgctttgtgtggccctgcagttcccaataaagaggacagattaaagtgattggttaccatcactcggaaactctaaagattaacatggaagtgaacactggctacagctagcacgatgcgactttgaaaatatgtaaacaaccaagcaaggacaactaaccatcaagggaaatgaacaccacaaagctaattacaaaataaatagatagatttgcagtatccaaaactcactctaaaaacgagatttgaaaagtaaatacatccttgcacatagatttgttggtcggtatatatgttactggaacctcagtgaatttagaagatcagaatgcacgtgccaactgcaaggtagaaagtctctacaaacctcaaatctcctaaggcaagcttgagtctccacatcaagtatagagacagcattctccgaagctactgcaagatatcccccatgacgtggttgaaatctcagctggcttgatcctccctacaaagggattggaaacaaataaatcaagaaacagtgtatcctacaaggcatctccttttgagaccagttgttgattatggatggagacacctaataacagcccattaactacaaaggggttatgacagtgattgaaaccaattaacaagtaggtatggaaaacatctaggatgttttcttttacgtaattttaggatgttttcaacagattgacattcatcatgcacattttctataaagagaaaagtctacaagtatacgttggagtgctttgtcaaggaaatgttaggattgttcacaataaagcagcacttccagattgacagaatgctgaataagaaaaactgagtaaccttaaatatccggacgatgtttccattgttgatactccagaatcgaatttcattatccccatcacaagaacaaatgaggtcatccttgtttgggtggaaatccagtgacataacagatgctgagtgcccagtgaacgttcgaattgaatagccttgctgcaaaagtacaatgacagcattagaatatgatgagcagtaaaacacaacagtactttgctgcccttgcagctttaacattacaagtactgacattacccaggaatctgaaagttcagaagtatcatgcttatatcccctagagaacaaacaagttccacttctacaaaatgaatccatgccatgcctatgaatctcaaaattgatgttgtagatcattcacgacatatgaccttgagatggacattgcttactgtattctttgagaatttatagcctacttaactttatgatgttgtttctacataaagggcagttcaaaaggtaaaaaaatctggctaaatatacaaatggcaatttgatatggtttcagtgctagttggcaggtttttgcaacataacacagaggcaatcaccgaggcaaatagatggtaggaaaaaagaactaaacagttatgtacttacattgtcagcatcccagaccctgacagttttatcaaatgaggaggtagcaaggcgtggaatgcttggactgaatcgtacatcagttatcaaaagagaatgttcctccaatactgacttctgttttaaagtttcagcatgccacaataccacctgcattgaaacattgcaagtatctatttcaatatcaccatgaagtcaaagatatgcctgcccacttccaagagtatcaactaggctgagcatcttaacaagcccaggcatgtgcacttaccttcttatcatgacccccagtagcaagtagctttccatctgatgagaagtggcagcatacaaccttgttcgtgcttgcttgtacagaagagacctctcggaagatgaatcctgcttaagacatataaacagaatcaaagctctacagaacacaaattcatgttagacttccctacaaaatacatcataaatctaacccactgaaccaatatatgttaccacatgacatattagataatttcccctctcacaggaccatagcctgaaccgcaccaactgctcaatttccaagctaaattcacctaagtgagttcagcttgttggtactatttacaccagccataattacattcaagactaaactggccagggtaaccactgccaatgatgttaatatgtcaaagccaaccattcaacttcaactagccataagttacaaaacagttagccttatcacacctttagtagattccatacgactgccatctcttcgatctgcatcatcatgcgacaggaacgaatccacatgatcttccaagcagccatcctccacaaaacgatccatgtcagcctgcagtgtgagttatcagatgttcagaagtcaggcatcaaacagaccatcagtgcaatgaaacatttccaaactatgttgcatgcataatatatccacgtaatagggccatagctgtttggatttagaaccagttgtaacttacaagttgatttgatggtgatcccattgtccctgctgtactggtaccgtaaacaactaaagcctttgataagctagcattgtggtgcagcgagggcattgaaattgtgtctcctgggctttgcgatgaaggagttgagggttctgaggaggggaccgcggtgtttccagtgccagaactattggctggaccagacgatgagattggctgtttgcgttttcgcccattttgattcttggaaacctgcaaaacaatatatttatgatggatacaagtcttaacaaaaggataggcacagtaacaaatcaaggtggtaatgttgaatatatgtagaaggaagtgaaacctgttcacttccacggaatgaattagacaggcttccatcaatagtaacacttccagctcccattttttcctgctggcctggaaggtgattagagattggtggttgctggctaagtaaagaatgctgaaggagctgttgctgattgctgctttgctggtgctgctgtatagctgctatcttctactacatataatgacgaggtgttaaggtcgaaaaccaaagatgtagaagttatcttgaaaaaggtagcttcagaaaacatgtgagcatgtattaatagcagctagatcattatgaaatccaaatagtatgagttcctctgttcaaaagattatattacacaaggaccaagaccgatattttcatgatttaatcactatgctatagtagaaagtaaatggtactgtgttatgcaaacttggcaacataacataacaagaacaagcatgataaatttaaatgaaattctattactgatcactgacaagaattaaacaatataatctatgtacatataagatatcaattgagaacaaaattatgcataacccggtggtttacaaggtactattacttacatccaatgtatcctcgcaaataaataaatgcatgaatatagtaaaacatacaagtgaaacttaccttcatcagcatatctgtctccatgcgctgcacaggtgagcacatattttgcaatgaagggccaacactaggaataacttccgtgtaggcatttgattgaccatccctcccaggaacaatgtttcggctactcaaaagcatccgaagccttctgctgtccatctctccaggtgaagatgtcatattttgttgtgcttgaagcagaagctgctgttgttgtggagtgagaaattgtagatggtgcaatggttggggagactgcataaaagatttctgttggagaaacccagatctaagctggtctaagccctgaaaagttataatcaaatggtaaaacatcataaaaacaaaaaaaaaaagaaggtgctgtattcaaacttgctcctaatttatagcttagaatgccagttaaggaatgatgtgaagaactcacagtaagaggccaccctttcaacgtcaaattgttccctgctgggttagcgcctgccagacaacagggtatcaaacaatggcactaagtacatgaataaacagtacagcaggtctaagaatttccagttagcagccagaaacaacaaaaattagtagagttcaaagcaaaaaaacctggtactccaattaatgatccatctgcccctgcagctctcatgtgtacagcagcatttgtgtctacctttatttcctgaaacaaatttgactcgtctagttatagacaataatgcatgagattatacatctgaaataagactacctgtgttgatgcctggagttgttggttccgggcctgaacctgttgcaaagtacctgacacgccaccagttgatccatggaaaatttgcctaaaaacaattgatcaaagcaaatcaatacacacacgctaacaggaaaacagaagctagagataattgccgttaaacagccattacagtatgaaccatcaagatagcattgattacggaaatttagtcaaacagctactacatgctggatagatttattgtgaataatatgaaagtaatataatagtttttattagcacattttagtgtacaataagaattaatggtcaaagttgcaatttgaagaccgcaaaatagttaggtaaaaacaaaggcggtaaacacaattcaagcatggtaggaaatcctattagatcacacattataggctgtatttaagactgatatggtatttattttgcgctccaaacctcccatccccaccccacactcccccccccccccaaaaaaaaaaaaaagagaagtaaatgattagcaagcattattgagcagttggtaccctgaagcctgagctgttattgcaacggacttcagcatagatgatgagtttgattccagcagttgtccaatattttctgtaaacctttgctgcagtataaagatatgcatttcatattatgagagtttagatcatgaaagcaacaatacacattgccatgaagaaactacctttgcaggtgcttcatctaaggtgtccctttgaacagaattcttcaccctctcctcgtacatctttgcagacaaagaacttgcagctgaagtgctttgtcgtgttggaggatcagcagaaaccaaaccattatgtgcacttgtcggcaaatgactgctttcactacgctgttgttgcttctgctggcggcgttgttgctgtggttgttgctgactctgctgctgctgctgctgctgtgcatgcctctgtagtaggagttgttgcatttggatctgctgtgatgactgctgggaatgagcctcttgctgctgcagctgtgatggctgctgctctcgagctttaattgactgtgtctgggttacaaaatttatgtgtaacaacatcaggaacatgaaaatagcattttgcaataagattgacgcatcatataccaagaaatggctagtttcaaatgagtaatcaccagaaaatgaacaggtattagctacggcctactacaaagggaagggaccattgccttcaaagtaattaatcatattgataataaaatgttgactttgaaattttacttgaattttaaagatgataatagctggagacaacatagtatgtattctacgagaaagtgttttgcattctgtaccttctaaaatgattaagacacatgttcttctataattgtgtgatatgatgcagcatgttttgtttggaaatatggggaaacatttgattttttttttaaaaaaaaatatccaccataacaagtttttcctacatagatgaattaggcattttcttcttttttttcaagagtgacatggaaagttcttgaatttggttttcaatgtttgtgtggaatttaaatccatttgctttaggcaaaaaactaaatccttttacagtgaacatgatctctatgactgacacaattcaagcatttacacatgtttattgtaagataagcagtaaaccactgtaccaagtgagtgcaagcaaacaacaaggacaagtaataaccaagatgcatgtgctacaagaacctcaatgtacgaagcagcaacatcagagtgcttctcgttcgtccttgcaatgaagatgtcccagaagacagaccaccactccaagaggaaaccccctggggcatcaattgctttttttgcaaaacaaaagctgacatctttcagtacaagaagattaaaatcgcattcattacaatgcagaaacatcagagactggcatgcataaatcagacaaaacaatgtggctgtagtattgttcctttgtatctgcccggtacgagtagctaataatactcgtgtctcgcacatgcacaaatgtaagtgtagtactaatcaagctaatcaaatgatcaatttgtaaccatcctattggcccaagaacaatggcagtctgaggaacaaactatctggtcctaatgcagaaagagcaaagattgcaaactacagtagtatgacaaaattcagaaattgatgcactgaccaacaggatcggaagacacgctgccttctgcttggaatgccttggcagtgctctgcaggttcctcttcaaaagataatcatggatgtacacgtccaacctgcttccaagaacagacatggataagttcagtgcggggatatataataagtaaaaaaggaaacatgggggtttgcatgcaagcacagcagcaacaggaaggaggggatcgaaagttttcatgagaaaataaaaaggtaaaatgcagattaaagtgtgaaagagcaaataaatttcgagaaatgaaaaggcagttgcaatgcaaggtaaaaggaaaaggcagttgaaaagctagcaagcaataaaccaaactagtactgtatccgagaaaaataaaaggaacaagaggaacaagaaaaaaaaaagaggcatggcttttgcaaaaggagaaaccaaaatgcagaacggaaaatgcagaaatttcagggaactcaaacagaatctcaagcgtctgcagccctctgaaatacaacaacaagggaagatgaaggacaagattcttgcaaaaatcaccagaaaaaaagacgatctaaaccgccaagaaacgaatccgaaacccctcccagaggaaaacaagaaactaatcttggggaaagataaccatgcggacaccaagagaaccaaatggaatgacaaaaaaatctcaagacaaaacggagaacatttcaccaacataaaaaaaagggaaaaaagaatgtgcgaagaacatcaaaccaatctgatcgcaataacaaactaaggaatgatgaagcaacgaagaacagaagagagataggagaaagctcacatcttctccgcttcccacgcactctgctgctgctgctgctgcgccatggccgccgccgccgccgcctcactccctctcactcctcgacctcgctcgcggtcacgcacgctaaacacaaaggcacaggagagagcgcctcaggaactgacaaaaggagagcacaaaacacaacgcgcacaagctaaaaaagaaggatttgaccgctcacattcgcctctaaaatctactactaatcgaggtgcgccaaaaaaaaaaaagaggcaaattgcttcctttttaaaatcttcggtcgcggagagatactatacttctactaccagcggcaatgcgtgtggaatggaatagaggaatcgaataaaaaagaaagagatgaacagggcagtgtgagtgaggagaggaagggcttaaacaaaaaaaaaaaactgaagatgactgtcaaaaaaggtcagtttaacaatattttctttcttgaaaacgccaaacagctgcccatttcacactgttttagtggttcaccgagtaaaaaagaaaatgagattgtgggattgtgaatttgtgatacagctgcatataatccaatccaattatccatatcaattatcgttatatgcgattaaggccgagagagagagaaagaaaataaatgtgaaatgatgctacagttctagggctaataatgagtgtgcatggattgatgagcctgcagaaaaaagcgtacttgcggctcactgtagctcctcggtcgaaactgcccctccttttgcacgatatttcgctactgccatcgtggctatattttttttctcgaggcatttgtcatgcaggtaagataagggaggtgattctgtagaacagtagagatgatgagactgtgcaccaggttttcaagagcccaattgccaagatttatctggtacttaattcattgttatgctttgttttggtaatgtaatgaacatatctcatcatctctgagcttttttttaacacatgacagatgcatgcacttatatgtacacttgtgcatagagcaccttcagagattgcaccaacatatctttaataaagaaaatcatgtagatgtctcactatcaataggtataacagacatatttcatcattgtgtaaaactttgatgtttttattaattggccatttaaggttttaaaatttgacggtacgtattttgtgacaacgtttatccaagagtgaaggtgttggttattcttactttcctatatgtgattttgaatctccctatttctactcggatttcacttcttatccccttctggtactaagtttgtaagtcagtcaaagttatattctgtgattaattgaatagcacgttgcattcagaacgctgagggagtgtttggttaggagggagggggaatgtttgaagatgatggaagtttgaggggtgaggagttttaagagcgaactctcgtcttttcaatatttgggtagaggcaggtaactgagagaaaaaaataagttagtatatcatcacttaaaattcatttctcactcaaattcatcataattctcatatctcctatcaaacgacagagattaaaaatgaaacttacaggatcaatcccttcattagcttattactctaaatttccaatctccttaccatgagttaccaaatatgtattgatgaaagttataagtccactttaagggttcctttggaacatgactcaaaatacaggaagaggaaaacttaggattgaaatgtcacgacatgaaaaatcctccaagcaatcaaactacaggaatcattcaaacacaagtgtttggatatatcgaacgggtgagagaaaattgagattacatgtttaatttgctagagagaggaggagagaacatgccttaaaaatcacaaaagaattcgaaacaacgaggttagaccccatgctagaattcctcgaagatgtggagagacttttcctatcccttgaaatccctttgaaacaatcgtatgatccaaactaaactgctcatatagtaggagaatttcttttgaattggattcctccatttttttcctcatcataaaaatcctttaattcaaataagccctaatttccccattcatccaggaccaaatgtgtagtagtagtattaaagctttattattcttttccttctttgaaactttagtaaatgtttgctgatcatctccgatgaccaacatcagcagtataatatgcttatcttagtagaataaggttatattgaaagaggattctctgcagtactgttcactgacacgtggatctataaggcataaacccttgtgcccagtgagtagcactaccctgcagaggatctccgttaggttatactcccttcatcccaaaataattgtttttttttgttagtttagcataaattaaggtttaagttaaaatactatactactcttcactaaggttgcgttccttgctgggagatcgagagagaaaacaacttgtttttcgcgcgcacgctacccaaactattaaacgacgtgtatttttataaaaaaatttatataagaaagttgttttaaaaagtcatatttatccatttttgaagtttaaaatagttaatactcaactaatcatgcactaatggctcacatcgttttgcgtatcttctcaatattctcttttctgtaaatgatatggttagaatcggagtggcaattggagggtataacaaggagaaatttaatataagaagatggataggataaatagttcctccgttcttataacctgaaacagaggtaatattttagagtacaaatattttggaaaaaaattgaatcctaaaaggatattccctccgtactcgcaaaggaagtcgtttaggacaatgtttaagtcaaaccttagaaatataaatcatgaataactcttaagttgttgagtttaaaaatgtaaaaaatatatgaatagatttgtcttgaaaaatactttcataaaagtatacatatatcatttttcaataaatatttttatagaaacaataagtcaaagttgtgttttggagactgtgttactatcttgatgagtacggagggagtacctatttggaacgaagataatatctatcagtattattttcatatacaagacttggtttattttaagattaaaagcgtaaatactactccatccatttcataatgtttgacaccgttgactttttagtacgtgtttgaccattcgtcttatttaaaaaatttaagtaattatttattcttttcacatcgtttgattcattattaaatatattttcatgtacacacatagttttacatatttcacagattcttttgaataagatgaacggttaaacatgtgctaaaaagtcaacaatgtcaaacatttgatacggagggagtattcatttgtctcaaaatatcatggaatttttttaagggacagacggagcacgtaccggtagggcagggcaggagaggacagtagggcggggcatgtgacatcgtgacaggcgacgggccacgtggcgggtggcaggggaggaacggtcaatgcgctcgccgacgacgtgtcagcgaccagtctgcccccctccctcatcagctcaccgcccagtcgcctccccctccactgcagatttaccgtcctgccccccacgccacccctcgccaccaggggcacaaccgtcattccgcggccaccaggggtgccacctgtgtctccttccctcgcctagtgggagactcgagactcttgcttctttctgttcgacatggagctagcaacctccccacccttacttaggaccgctttaaatcaaagaatttatataggaattttataggatttaaattatatagaaaattttcctatttggttatttgattcaaaggattgaagctttccaaatcctatgaaattcctatggaatggcacattgcatgtggattttggaggaaatttagcaagagctccaacctcttggaaaaattcttttgagtctatctctctcatccgattcctgcgtttttactgcgctccaatcaaacgaccattcctgtttttttatgtgttttgcaatcctttgttttacattttaattcctgtcagaatcctgtgtttttcctattcctctgttttttctaccctgtgattcaaagggtgttaacagtgaaatttggtaatcggcaaagacgtcatcggcttagaatcattatcggctgcagcatctcggaatcagccgatgggagttatcaagtcgccaatagtcggattcctgctatattcggttaaggaaatcaatctactaaagg

SEQ ID NO: 76144 - DNA, 922 bp, Oryza sativa
atcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccttaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggaaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaagttatcaacggcatatggtaaacaatatgtggctgaggaataggacccatcccacattacattgtaaaagaatgcaacatttaatagaaatgcgggatatttgtaaattgggtacaatatgatcaaacgtattgcatgacttgccttgctctcgcactgacgagacctcagcaacgtcttcgagaaaccgtggatcgacaaaacggccgaaacctacgcgacaaacaaagcacacaagcaaaacaggctataagacaactgaaacagggaacaaaaccattttta

SEQ ID NO: 76145 - DNA, 3054 bp, Oryza sativa
cttagtaagttgtggctaacaatttgatcacctcaccttaggcaaggtgtggcaacttttgttggcaagtaatggtaaagtgtggctgggaaccaaacagccccagtcatgggcccgttaagttttgtcccccccctttcggagcttttacttaaaaaacctagtagtaagcacaagtttatatatgaacacactcacgcacacacaatctctataaaacagttttttaaactagactgttatattttgagattgataaaatcatcacaatcatatcactgtcgacggtcacgtctactattgaaggaatagttagacgtaaatcatggtacaatgtaattttcattttatactagtcagtataactatatcagtccatctccactgttataatttgatccactgtgatatagtgatttaatgacttaccttttcttttattaatgttagagagtccacagtgaaacgtctaccaacaatcatgataagatcgtacttctgtcctatattacgctattcctccacctaatttctcatattaatcaatcacaatcattatttatttaatttatttatctatttttttcatctcaaatgctatctctgtttcatattataagtatttttaactttttttagtcaaattactttaaatttgacctagtttctacaaaaatatagtgatattttgcacacaaaacaagcatattattagaatatattcaatattggttttcaataaaaataatttgatgttataaatattgctaattttttctataaatttgatcaagctttaaaaaagtttgactagaaaaacagccaaaacgatttataatataaaatagagagagtaatcacaactatttctcatctcaatcttaatctctcgagaaaaataaaagtaacataggcggtagatcatattaaaatatctaccaatcaagtactatatactaatatagtactccctctgtctgggttacggataaggtataccctctacccttggatatacatcatgtatcaatatggtatatctgcgcgtatatggacgttctttgtacacgttaagaaaattcaccacggagtcatagatgtaaggattcctactcggacagaactgggtcgttactatatcgtgtagggtccgatgtctccgagttctacttagagaccaactaacctgcggtataaaagggacccccgggaggacctaaggcatcgaatcttaccgccaacacatctaccacggcctacgaagccggagcctacaggagccaagttgccggatgatctagtcgaaccaactcgactacgatctcgtcggtatcaacgagttccactattccctttgtaatctgtgttttccgtcatataatcccatatcaactggattagggctattacctattaaggggcctgaactagtataattcctatcttttgtttgcttgatgtcgtactacgtcgatcctcgtaccagcgtactccaataccctctatatccggtctacgggtatcccccgtcgacagtggcgcaccaggtagggggacttggtactcaaggttctactactatgtcatcaagcttcgttgacaacagcgtcaaccccggcttcaaccaaggagtttctacttcaacaatgttggcgtggactcaagtcggcgaaatcgtctttccggtttacaccacggtgctgatctcgactggtccatcaatggccggaagcgagaacgccgtagttataaccctggacgactccatgtcgaaggatcctcccgctgaagtggagaacagaacgtcgacaacatctgagcccgagaaggatcctagtgcggccaaatcttgtccctccgacgagaatcacgagccgacaaggacaacttccgaggcgacaaggtcctggtgccctatccacaaaaccaggaaacacaccttacaagcttgctgggtttttctcaacgtacaagctgagatccgtgcctgcaaagagcgtggaattcagcgtacttctccaacttgtgatgcctattgtcctgttcacaagacaaagaatcacgacctctcaagctgcaaggttcttctcagtgccatgaggacgtcacctcctaaagttcagcagtcacgaatctctcttagagatatggacaaggaacgaggagcgacagttatctcttagagattcgttggggtaatcgacatcgatccccatgagccgtcggttctacacttgctcgaagaccaggcctcatcgtcgacgagcacaccacgcgatgtgtttgctataggtgggaccagcacgtctgcatgcgccgacgcagaagcggagaatcaggtggcaacactggcccagcacatcagggccatcaacacaatactgagggagaccccttatgatcccgttctgaacgatgatcttgcgcagtggtcagaacgattacgggaattagtggccaacctcagcaacgtgttcgaggaggccgctgccagggtaccgctagaacaaccgccaaccggcggcgttaatggcgaactgcctgagcagcgggcgtcacctcgtcaagccacccctccccctcgcggcaccagcgatctccgtgaccatctgaatggccgccgagatgtacgacgcacgcggaacaacgaaaaccgttcccgacatcatgtctcttcgcgacgtcgcgagaatgaagagcgaggagacccgacggaaaccgagaccgtgataactgccacaaccgccacaatcatgacgatcgcgaacagcggatgccgggcgatactagtcgatgacgccgccataatgatggtgatgatggagatcggcgccgggacaacaacagtgggcgacgataggattctcgggaacccggacgtcatcctcataatcgtacacttgaaccaagtgactcatcgtcgtcgtcatcatcctcatcatcctcatcatcagatagacatccacgaaggacatacgatcgccgacaacccaccgcccccgatggcgggtgtagagctttcagccgtgctctacatgatgtccgatggcctaa

SEQ ID NO: 76146 - DNA, 2922 bp, Oryza sativa
taatgtttcacaaccgaaactcgtgaaccggtccttaattatcatgagcacgactctcaaaaccatgtgctcacaacccaccattatcaagttttagttggcaagtaattaattaaccaatcacgattgaccatcgtgaactatcattaagccaacattaaataatagtgagtcataagttatcccaatagtgtgctaatgtttctaagcatggctaagcaatcatatataatatctagatgaaccaatatatatagcccaactagtcaagttataataacccaatgtatcaaggaataaagtaatcaagaacaaaagggctataacaaacaataggttaattccatccaatgacattcgaaaataaatccaatagttgaatagaaacaatagctttaaacgggatcaacatgctcaaagggttgtttagaatctgtgtgacttgccttgctggccttggaactcttcaaattcttctcctgtaaaaacggactctccggaaacgtcggaatctaaacagaaaggagcaaaatcaccaaaacagcacataaacaagcatgaacaatacatgtggatatttttaacatgtagatctcaattttagaaaaatttagagacttgaaccaactaaatccgagctaagatgaattagttatgaattttcaaagattaaatcggattaaatcatttatttagattttaattgaattatgacgcaataatgaattatttttgaaaaggaaaagggaattattgcgtcagcggctagggttcgcggtgaaccgggtgcacggcggcggctcacgaaaacgaacggccgagatctttccatccaaaacgaacggccgagatcgaccggtccacggccggaccacgggagacgacgacgatgacgtcagcggtgacttaaaaacctttttcaatttaaattattcatgaaatgcaattccatttattaaaaatacttccttagctcaaataaatcccagaaaaatctagaaattatagaattaagcaaagtatttaatgaaattttatctggccccattttatattggaatttattatttaaaattagatcttcttttctagactttaaaataaattctattaattacaattaaacaacaatttatatatttaggatttttagggtgtgacaaacctaccccccttaaacagaatctcgtcctcgagattcggaagaactggcgaacagatgcggatgagctgacttcaattcatcttctcgttcccaagttgattcttcttccgagtgattactccattgaactttacaaaaacggataactcgatttctggttcttctctcatctatttccaagatacggattggtttctcaacataggtcagatcctcttggacttctatctgttcaagattagcttcttcggtaggtacccttaaacactttttcaattgcgacacatggaacacattatggactcctgccaaagattgaggtaactccaactgataagcaacctctcctcttctactgacaatcttataaggtcccacaaaacgcggtgccaatttcctttggtgtgaaaacgatgaactcctcgaagaggcgtgacacgaaggtacacataatctccttcgtcaaaatttagatctctacgacgattgtcggcataactcttatgacgagactgggccatacgcaatctttcttgaatgattttcaccttttcttctgcttccctcaggatatccatcccgaaaacctgacgttctcccgtttgatcccacaaaagcggagtgtggcacttccgaccatacagtgcttcgtaaggagccatctgaagactagcttgataactgttgttggacgagaattcggcgtaaggcaaatttttatcccaacttccaccgaagtttaaagcacaagatttcaacatgttttccaaaatttggtttaccctttcaggttggccggtcgtttgcggaagattaacaggaattaaggttaggttaagacccatttttttctggaagttctttaaaactttgaagtaaactgactacctcgatcagacattattttcttagggacgccgtgcaaacacacaatccttgccatatacaattccgccaaccgacttccggaataggttgtctttactgggatgaaatgagccactttggtaagtctgtcgactatcacccaaatagagtcatggcctaatgacgttctaggtagaccagtgatgaaatccataccgatttcctcccacttccattcaggaatcttcaaaggctgcagcaaacctgcgggtttctgatgttctgccttgactcgctgacaaacatcacatactgctacgtattctgcgatttcacgcttcatacttgcccaccaaaatctttccttgagatcctggtacatcttggtactacccgggtgaatggagtataaagtatcatgagcttctttcagaattgcatcttttaaatctttgttgtcggggacgcagattctctcgcccaaccatacagttccttgctcatcttccaagaaaccgatagcttttcctcttctcatattcttcttgatttcttgaatatcaggatcattaatttgggcttctctaacttgatcaattagagtgggctttgcttctaaggctgcaacgaaacctctactgacaattcccaaatttaatctttcaaattccttacataactccaatggcaactgtcgtccttccgtagcattgcaatagcctttcctgctaagagcatctgctacaacattagcctttcccgggtgataatgaattcccatgtcataatccttaattaattccaaccatttccgttgtctcatgttcagatctggctgagtaaagatgtactttaaactcttgtgatcggtgtatacctctgtacgagta

SEQ ID NO: 76147 - DNA, 1382 bp, Oryza sativa
cagtccatcataacctgcagctgtgaccgaatggtgttagctttaaggttaagtgatttacataaaccactttcaaacaaataccagcaaaacttgatcagatcattctttttcacataaggaaacataattcattgaacactcgcagcaaaaataattcattgagcaatgaactcatttgatcagtaatatctctaggaatctaagaggccatttgtgatatacagcagctacaccatgcttcacttaatcatttatatagcaagaatatatatagtaggtggacagcagtaccatgctttactcttattattgacttcagtactagactctaaggcctgttggattgcctacaagttgtagtagaactacatgtcaacagacttgtctatccttatggctgtattattaaaataacaatgtgtgcagtgtcaaaaataaatttacacagctaagccttggaaaagcattctctgattgcacatatatttaaagtgtgtaggtatagtgtgcatggcagatttaaaagtatactaaccaacaagtatttggatagacaacgtgatgcaccatgtggcgcacatcgtgcatgggagtgcacatgtaaatgaggaacaagaagaaactgaactaggtaaaattcatgttttttttagaagtttgaataaatgtacgcattcttattaacccatattaacttaccatgtcaaacattttgtagatgaccatgaagcattgcaatttgagctggaagccttggagaatgatcttcaagactacggagtgtacgccgaagctgtcaatgttgtctttgatgtagaggagttgcccgactcagatgacgatcaagaagaacatgcaaatgaaaatgtggcaagtaagtcaaaagatttgacaaacatacaaaggcgaggcatttatcaattgttgcttcagaaaagtaaagatggaaaattagaaaaacacaccacacgtttagttgctcaagagttccatgttagcatccatacagtccaacgtatttggaagagagcaaagatttgccatgaacagggaatagcagtgaatgttgattcaaggaagcatggaaactctgggcgcaagaaggtcgaaatagacttgtcagttattgcagctattccattgcatcaaaggagaaatattcggtcactagcacaagcccttggtgttcccaaaagcacattacataggtggttcaaagaagggctgatacgacgtcactctaactcgctaaagccttatttgaaggaagcaaataaaaaggaaaggctgcagtggtgtgtttctatgctagatccgcacacattgccaaacaaccccaagtttattgaaatggaaaatattatccacatagatgagaa

SEQ ID NO: 76148 - DNA, 610 bp, Oryza sativa
ttgcaggcggcccccttgccgccctgggggagggcgatttttgcctcccccctataaaccccagcccctcccctgtgaaatttcattatattcactaaaaatccaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacagtattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgc

SEQ ID NO: 76149 - DNA, 6186 bp, Oryza sativa
aactaaccaacccacaggcataccgactaggggtagacccctatttagaatcatcctaaagaatcaacgaaacccacaatacttagctatctgcagcaaaatctaaacaacatataaataaagcaagagttagtacattaaacaaattaatgtactagcaagaccacaatcaattcttaatacattgaggctctaccatgatgccttcacaaacattttcaatgtatttaaagaaaacattttgcaatatgtatagcataaagaacatggcatggtgtcaacataaataaataagaatcatttcctactaccgaaccggtagcaagaacataataccatgtatatcattctcatcatcatttcaaaagattcgaattctaaaagcatttataaaacataaacctaaacccatgacaattcactatgccgctcatgatcaattgcacgactaatttattagttttagactctgcagaatttgtacagtttgacccacatgacataaatccctctagtttgtctgccacctgtcgataccaccacactctacacattgagtgtggtctagcgattatgattaagcctttacattatctattgtttattccttgcatgagcacaatggtggagaatccgcaccaagtctagagcttaagtgtcatcagaatggttagcctaccgattctgacgccgtggcgaagcaacccttcccacgaggcactcactgttgcattggatagcattggacatatttagacgctcattctatgatgtggaacagtacaatcgtcccctcacagaaaaacatacacattggaacagtgcactcaacgtatcataatcacaatcatgggtagtttctatagatatgtcacaccctaaaaatcctaaatatataaattgttgtttaattggaattattagaatttattttaaaagtctagaaaagaagatctaattttaaataataaattccaatataaaatggggccagataaaatttcattaaatactttgcttaattctataattcctagatttttctgggatttatttgagctaaggaagtatttttaataaatggaattgcatttcatgaattatttaaattgaaaaaggtttttaaaatcctcttttggctttgggccgaaagtcggcccaaaaccttctctctctctctccctcggcccagtcggcccagtcagcccgcagccgcccgcgcgagcgccctcggccgctgacaggtgggtcccacctgtcggactcgtcttcctcctcgcgccgtcgcccggccagaaccctagccgagccgcgccgccgtctccttccaaattcgctcgcgcctttccttctccggtgaaatcaattgaggggaaatgtttcccgagatctcctctaccttttctcttttggaatcgtcggctaaatcgtttggaaatccgtggattcgagttcgattcggatcgatctctctcctccgaaccctaaactttccttcgcgtcgccggtcgccgtgggccttcgctgccgcctccttgcccctataaaaggacccccaagcccgccgctaccgccgccaccctcgacttcgcctctcgccgcccgtagcgccctagccccgtgtagcctagcgccgccgtcgtcgccgttcgtccagccgtgcgccgccgccgatcctgtcgtcgtcgtcgctcgggaaagtcaccgtcgtggtcgccgtcgcgtcgccgtcctcgtccgcccctccatcgctgctgtagaccgccggagcaccgccgttgtcgtcaagccgaaggttgccgccgcttcttcctcatcgctgtcgccgtccgttgatcttccgccgccgctttggtcaccggtgagttcgccatgccgtccgctacccgtaggtgctctccgttcgcgctgtcgtgtcgtcgttcgccggcgagcatgcacgcccgagccgccgccggtggtgacgtcaccgctaacgtcatcgtcgtcgtctcccgtggtctggccgtggaccggtcgatctcggccgttcgttttggatggaaagatctcggctgttcgttttcgtgagccgccgccgtgcacccggttcaccgtgaacactagccgctgacgcaataattcccttttccttttcaaaaataattcattattgcgtcataattcaattaaaatctaaataaatgatttaatccgatttaatctttgaaaattcatcttagctcggatttagttggttcatgcttgtttatgtgctgttttggtgattttgctccgttctgtttagattccgacgtttccggagagtccgtttttacaggagaagaatttgaagagttccaaggccagcaaggcaagtcacacagatcccaaacaaccctttgagcatgttgatcccatttaaagctattgtttctattcaactattgcatttattttcgaatgtcattgggtggaattaacctattgtttgttatagcccttttgttcttgattactttattccttgataccttgggttattataacttgactagttgggctatatatattggttcagctagatattagatatgattgcttagccatgcttagaaacattagcacactattgggataacttatgactcactattatttaatgttggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcgaggggtactatcacagctcctttccgtggtaccgtggtggtattgaggcacatggtgacatgttgtggggctgtgtcttgtgggtacagtggtacacctctggctagagtaaaactattcgaatagctgtgcccgcggttatgggcgagtctaacaatgtctttcgtaattagtttcacacttctcatcataataaaagatgctataactggtaataatttgattagctcctggtttggaatggtatattcctggtttggagatagatctgtacagccgggtatggttgttcgagatggttgggcctgagcagaatgggtgtgctttttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcgtatactcaccttgcaatcattcatcagaggaagggttcttcagtgatgctgatggtgtggaggattaggtgtagccctggtcaagctgcctgtggagtggagtcgtctgcgccgtttatcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagtgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatagcacatgcacttcataatctcttttagtggttctcattcaaaatttattccagtgttgttagtactgtacatctaatactgtactaatggctcatttaccagcaaatgttttacaacattgttttattttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataagatttgggactgcccctttgtatgcctagattcctcatgatcgtcacgaagagaagtgccgagtcaaagtcaccttgaacagtaatagtgaagatatcccatcagtgatgttcgaagctggaggaggaaactacatccatgcatgtcaggaggtggcaaggattgccataggagagctccgcgatcgctacagtgattagttggccgacactgagtatcgctaccatcctcgccaaccccagggaagtgaccgtggcagctaccttgagactgaggggattgagaatgatgctaccacaaggcatttggttgagatgctgtgggctatggatgaaacccacgcagaggttgtgctagcagctcaagatcgtgaagaccggaatcgtggtaagatttgcaggctagatgacaaggtggatcgtttggagaaggaactagccgcgttgaagggagaagcaccaccgcagatggccaggattcgtcttaccgcaaggaagagagctctatttgttcctcgctaccaattggcgccaaaggtccgtgtggtggagaaagaagttaccccagccctagcggatcctccggtcgtcaatgtaagtgatgatgaaggagaagaatcgaagcgcacccattcaaaggttgagtggggtgctactcaagatgatggagacgagccgaacgagccttcaatcaacttcgatgcccggaagacctagagtgccttgttaagccgttgtcttagattgttgtgttagtttgttcgtttaaatttggttgtgtgtgtctcacatgtgatttacatcagtggtgggatgtaagtgcatgcgtttgtttacttttgagtgttaggaagttggtgagtttagtggtgtgagagtcttcagttttgtaataatgaaactcagttaagatcagtaaaagttaagttagtagaaaaattaattctctgtcctaagtagttttccccggtttctcttcttgtgatcctgcccatgccagatggtgctcactcgcagcaacgggaatggccccaacaacaacaataacaacaacaacaatagagagaatcccacacttgcccaagtcctggctcaacaggcacagcttatgaacatgatgatgcagcaactccagaaccagcagaaccagggaaataaccatgcacctccccagaacaagttagcagaatttcttcgtgtgaggccgcccactttctctagcaccactaatcctgttgaagctggcgattggctgcatgccatagagaagaagttggatttgcttcagtgcactgattaggagaaggtctcatttgcatcacatcagctgcatggccctgcctctgagtggtgggatcacttccgccttaacagaactactgctgaacctatcacttggcttgaattcaccgctgctttccggaagacgcatataccatcgggagtggtgtctctcaagaagaaggaattcaggtcgctcacccagggatctcgcacggtcaccgagtatctgcacgagttcaaccgtctggctcgttatgctccggaagatgtgcgcactgatgaagagcgctaggagaggttcttggaaggacttaatgatgagctttcttacccactcatgactggggattatcatgatttccagaagttagtggataaggctattcgccaggaggacaagtacaaccgcatggagcagaagaaacgccggattgctcacttcaaggcacaacaggggaatagtcagaggccgcgtcttactttaggaccccagtccatgccacagggaggttctttgtctgttgttcgtccgcagcgtcagtt

SEQ ID NO: 76150 - DNA, 583 bp, Oryza sativa
ggaaggaaagggtaccacgtcaggagacacgtgtcggctcgtgatacacggggtaggcccgagcgcgggctgtttcgctacgaggcacccggttcgtgtacccacagagttgggtgcagtttcgttaacaaaatctgttattatacaggtaaacagattcacagatatgcgtcgatttagcaaatacttttttagtcgctatctctaaattgtaactgtgagaccttaataaaaaaatcacgcattctctcatatgtctatatttctttattcacttttaataattgtaatagttattatcatcgtcatcatcattattctccgagaaaaataaaatatcattgttagagtacatgaggatgacatgtgggccatcctatgaataatggcgttcgttgggtcccttgcggaagcgccggtgtagagtgggtgggtgagccgggcaacgtggcggatagtttaatttcttgagtcacgctgtcacccgttgcttccggcacacgtgtctctaccggagcggctctacgcgtccacccgcgcctcccacgagggccagctgggtagcctagtcatgtgggtgacg

SEQ ID NO: 76151 - DNA, 45370 bp, Oryza sativa
ggcggcggcgaagccgagcgcctcgccgccgccgccgccgccgccggccgccgcgggcgccgaggggaggtccagggaggaggcattcgtccagaacgtgaacatctgctgcgcggtgttcgacttctccgaccgcgggaaggacaccaccgagaaggagcggaagcggcaggtgctcatgtcgctcgtcgactgcgtcggcgccgccgaggagcccctcacggaggcgatgatcgcggcgagcgtgcgcatgttcgccgccaacctcttccgggtgttcccgcccaaggcgaggtcgggcgccgcggcgtcggagacggaggaggacgagccgttcttcgacccctcgtggtaccacctccaagtcgtgtatgaattgctcctccggttcgtgacgtcgccgatggtggacgcgaaggcggcccggaagtatgtcgacagctcgttcatctcgcggctgctggatctcttcgattccgatgaccccagagagagggacagcttgaagacagtgttgcataggatatacggcaagttcatggggaatcggccgttcattcgtaaggccgtcagcaatatcttctataggttcgtgttcgagacggatcatcacaacgggatagcggagctgttggaggtgtttggcagtgtgataagcgggtttgcgaagccattgaaggaagagcacaagttgttcctatggaaagcgttgatcccgcttcacaagccaaagacggtgggtgtgtatcttccgcagctgacgtactgcatcacacagttcatcgagaaggaaaccaagcttgcagggactgtaatcagaggcctgctgaagtactggccagttacaaacagtcagaaggagatgatgttcttgggggagttggaggaggtgctcgagttgaccgacatggctgagtttcagaaatgcatggtaccgctgttccgcaggattgcaagttgcctgaatagctctcactttcaagtaagttcctttccaaattcagaactttaatttgaattaggtatcgattaatgtttgttcatgaattgtttctcttctgtgtatcacgctctgcatttatgtttgcaactatcctgtcctaaacatctgaattgcttcatgaagtagttgcaaagctgtttatcagtggaatctaattcttattttaatccgagaatcgctttgggatctctttcctttttctctgtgctttttctagtatattagtgttacctacacggtccccttcacctttttatgacagtcattattgagaagatatctcagcagtaggtaaactttctctgtgttggctaaagtgagaccatacacacttcttgttcactcaagcacaattggtggcctctaacacttccctttggtaggcttcagaccattgttaattaagtatacaactggagctgaaagtagtttaaattatatagttctgctgtgcatcttggctcatgaaccatgacaagaatcaattaggttaggtacaattctaattcccattgtcattccatttgatttatggaacaactaatgacagtcactctccccattatggaccctaattttctattatctactgatattctatttttctggcatatgctgttagagctgataaaacctttcatcggtaagttaaacgtttttacttcttgaataagagagggcccttaggagttaggactgaaacatgaccagagctgtgatagcactgcagtctgcggtcttcatcttttaattcttgaccatgttaaaatttctcttcccgaaaaagaagttgcccaggaaactaaagatctgattttaattatgggcaggttgctgagagagccttattcttgtggaacaacgagcacttgttcgatatgatctcccaaaatcgtcaggtgatcctaccgatcatatatccagctctggagaggaacacccgttggcactggaatcagtcggtcctcaatgttaccctgaatgtcaagaaaatgttcttggacatggacgagagattgctcctggcctgccagaacaacttccaagcggaagaagagaagcgagccgcgaccgaggagcggcgaaggctgatgtgggagcagctggagcggaatgccgctgcggcatgccatccacatccagtgatcaccactactgactcaagctttccttcacccccttcatcaactcctctggtagctcccactgtgacatgacatgtggatcaaatatactccatttccacttatttgttagctagctagatgatgatgaagttgcttgcttctcctgggactatacagaaggcattttgttaccttcgtaaggcccccccatgtcaaagtctgtaattaatagttgatggtttgaggacaaaatgacacttgattttttcttctttttttgtggtgtattctcgagtaatgggcattgctttctaggcaaaatctttgattggttcatcctgagtgagtgatctgtcaaagtgtggacaacaatgatttttgtgtgagagaaatgacaagtttgcagccgttctttgtggctaagaacttctgtctatttttaacaggcacatttttagctacagtgtaataatatcagatgcacttgtatagaaacaaaaagggcttcgggaacagcttaaacaaattgatttgttatttctgttcaatggactatatctggatggattctatggagaagaaaacaagagtagctgagatttcagaagaaataaaaaacatctctttcaacatttgttgtaggttatctgcctggtcttttcaagtacttttctttgctaaaccacatgagaagcatctcttcaaaaagaggactaactgaaacattgacaaaacaagatttgttgctcaaatcaaacctaaaacaaataatagaagaaaatgatggcaaggacaagtatactccctgacgtcaaactaacacatacataatcttctggaaattatctaggcccatctctgatgcgcctacacttgaacttttttaagattggaaatggtttataatcctacacttgaatgctgtacattagcagcctaacggattgatacatctggttacaaatgtgcactacatattgtgttattcaaagcacggattcagtcgtcctgtctccttgagtatggataccacgctgctggaattcaagtaagaattccttgacaagtgtgtaccagacgctgttaaataaatatttagcacccacaattatgcttaggtggataaactgctcgaatctcgattacctgcctagtggccgcaattattggcccttaattgtgaggttaatccgtggccattttgacagcttgagtttcacaaaaaaatagcactaccggttttaattgttaacttaagaaataatatttgatcattcgtctatataagtactatttattttagtgttactttttctattatcaaatgcactttaagcataacttatattttacattttatgctaaatttttaaacaaaatgaattgtcaaacgtcattatctaaaaatcaatatcgtcatatatttaaagacataataagagtatagtttttaaaaggatttgaagaaattccagcgttccaaacagagattcatcagtggagttatctaccagtgttcatgtctactagggaaggtcgcagtttgacgtgtttccaagtgatatgttttcagttcagacctgagctgagtttccttataaaaggaagcctcaagctgggcatcatgtgacccatgctctgttagtgccttctgtctatctatcccccttgctggtttcttcctcctcttctgcgtcgtcgacttcgtctccggcggccgcggcacgggcggcgatgtacaaccctccggcggcgcaggagatgtcctactccgaccatgtcaagaagcgccatgaggacaaaggctgcctctatgcatggtgatcctcttcttctgtcatgctcttctaatctttcagagaagctgttgatgctattttatgttgcttattaatttggatgtcatctaaactaggttatattctctagattaggatgtgatctaaggtatttttcaaagtagaaattaggacatgtttgttcatcttggatgcactgttcaacatttctcaaatcatcagatagttcatctagtttcttcagacaagctgatttctgcatcatgtgagcattgaacacactcctaaagtcctactagattcagagatggatgagctgaagtagttagtggtcattttcatgtccaagaaaaccaaagatcatgtgagattttgccctgatcaagagggcttcttcaccatttgacaccttttttcctctgtttacctgtgatctctttccctttttgttgcagcctgttcaccctctgctgctgcttctgctgctacgagacctgcgagtgctgcctcgaatgcctctgctgctgctgatctccttatctcatttcagcagtcaaaataatgatgatgatatatcatatatagtcaggaataaaagatataatatgccgtttgaaatgcaggaatttatttttccgatttcaaaccatagtttgttgttgtatgtgtactggtgacaatatcatggtagatgaaactttctgaaaatttggtaggtatcagcaagatttgatctttttagttgtgctcccatctataaaatgaataaatatatttaagctgcctgccgagataaaattattaatcagaccgtaacaagcatccaactaatataacaatgggataacgtatattgtacaaatgggatgttcatgacaaagcgcacacatttctgatacaaagaaagatttctctattcaatgcgacatctgtattaagatcactagagctgaatctatccatacaaaaattggattctgtgtgaaaaattgctaaaacaacagttgcaactattgttaggaatgcccagaaagaagcaactgtcataagattttctgtctgaatttcatcagttgtattgtatgagaacctgtgatgtgttgctactgcctctaccactactctacacaactaagacctcagaagatgtatacgcacgccaatgcagtgatcagagtagtcaagaacacagaaactacattgacaccattgttgtccagtatattccgtcctgaaatcctggtgaccgtcggaccgtctactccaaccacctgcataaacaaaattcagaagcaataaaaagaaaaaatcaacttctgattcaaaggcaactagggtatatagacatctaataacatcaattgcagaaagcaccatacctttttacgaagactacagtacccactgtactggagtgttgcgcccagcaacgaatcgatcagacttccacataggccagctgctgtagctaagggtataaccagcagctgcctccagaatacatcagaagaacactgagtggttaagaatcctagtagcacaaatgtaagcccaatcgagaatccagcagccgctgctgcgagaagtccatcaatggttaccccgccattggtacccttccgtactctctggtgaagttccatgtcaaaagcaacagtgattatatgtactgatatttctctaattggtaaaagaggaaaatgcaatgtttaccttgaatgttgtgataattcgtggttccgctttgctgagaatgccgagctcagaagaccatgtatcaccattgcagcaagcataatgtccaataacaccaccaatgagggcagttacaagactagattctctcgtatccaagcacctatcgctccctcctgtgacaagtgctatcaaaactaccaagacacttgcaatgccactgtttgacaaaacttgcttcctgccaataagagtggtgtgcacctgcattagaaagattcagaagggtactttctgaaactgaaaggcatcttattcatctcaataacggtgacaacagtccttaaactttggatcccttttaaataggtgattctttttcctttgaaaaatgcctcttggataaatttgggagaaaatacaacaagacaaacttcatgaaaaatgggattgcgttccgagttgaatcttgaaaggaagtaggcatacctcaagttaataaggacaatttgaacagtttaaacagtttcaaatgttgtcaaactacatacttcatcatcaaatcgagctcatttttatttttcacaatttaaactataccgagccagcgaacatggtagctgtacacactacagaaacatcacatgaatcacttaaatctaactcaacgaaccccaactttttatcatatagcagcactatgaggccctcaattcccttgttgcacaaataaatcgcatatatgttctaccagatagctattttgcctttctagagatttaccacattcccctactctactacaatcagaaccaaaatctgaagcttccactctgaatgtaaacctgccaattataccaaaagccacagcgcaatctcaaacatgtccgaggcctctctgatctctacgatattaatttcagatttcacatcattctctatttttcttggtcaccatcggaacaagaaaagaagaagaagaagaagaacagagaccatcttcttactcaccagttgcgctgccctccttccttgaagtcgggatcaagcgcgcgcttcctcttctcgccgaccctcgtcatccgcgacgccgtgaagaagaacaccagcagcatccccgcgaacctacgatgatgattcgtctcaaaaaaatcacatcagaaacaggatttttttatcaataatattttttttaaaaaaaagagaaattagccgccctttcacctgtacccagcgacggtgtgggccaccatggccggaacgccgacgaacaccgcggtggagtcgacggacttgcgccgcaccgcgcgcgccgcgatggcgccgcccgccgccaccgccaccgccgcccggatccaaactcctccgcctcctccgccgccgtgatccattgccggcgacctccacctcaccaaaccggatcgcgcacagcagcgaagaacaccaaaaaggaatcgatcaaaccactcgcgaacggaacggatatggatctcctcctctcctcctccaactccaagccagtgcagccgacacacgctactactactactgacgcccgcaaaagatacgaagcctttttccgcctcgaggcgaaggcgcgtgctccggtgtagaaattggcggccgaccagatgcttcgggaggatcgccggcgagccggcggcggtgggctcgccggaatcgcgcaggtgaaggtgaagcggaggtaggagagaagaaataagcgtgagatctgacgaaagcttgatgcttttctctcacgcgagtcgcgagagacttgtatttgtaagcgtgttgcatcgaatcgatgggcctgatcctacccgttcatctcctgaggacgcatcacagccgtacaaacatttttcgtgcacccatccaacggtccaggtcggggcagaatcccaatcctgatggtaagatagtcttgtaattcttttttttttgagaggtgatagtcttgtaattctagattatattctgcttaaaaaaacactaataatgttcagaatttcaaaaaaaaaaataaagaagaaataaggttgcgttgggcaaatcccaatcctgatagtaagatagtctggtaattctaaatcatattcttattaaaaaaacactaataatgttctgaatttcaaaaaaggaaaaatgtaaggttgtgtttggcagggctctagatctcatatttatggtacatttgaagtttgtatattaaattatattgttttaaaattttaaatttcatctaaaataggaacaaaatgatttatccaaatgttatcaacgagatcacaggtctagatctataaatttgtggagttaggaataccaagctcaaaaaaaaaaaaaagaatccatagctatgtcaaaaaagggcctaatcatatgctgattccatgcatctgtgaacaaaaaactaaaaatctatccaggatagtgtacagtacatgttgtttctgaattgagacattagcttttagctaagcatcatctgaagggaaccagaggaaagaacatgacttggtctaccacaactgctattgccactgccattggatgtttggattgggctaaaatcttcccctgcctcgccctcgccctcgtcctcggccccttcctctcccccgtcctcgccctcgaaaatctcttctcccgcctcccgtttcttcaggaccgctgaagctgaacatgctcatccgcaaacgatctgcgtctgaactctctggcactccctgcaaaatagcacaatgccatgggaatcaacattcttggaatggcggtaatggaagttttgaaacacaaaggggttctgatcagggaagttgaaccgacataggagtcttcaagatctagttgctcctggagctgccttgccagctcctcgtctcggctggtatcgtcgatgtagctttgtgctgtggacttcaaaccagcggattttcgcttctcccattcatcgagggtaaatactggagtatcttcttgcctgcctttacccttgaatctatggccccgaccatatctgtcttcgggcgcagcctgggtcattttctgcagaagcttctgtgcagtggcttggttttgaacaggaatagcttcactgactgcaacgccaaagcaaaaggtttgtaaccaactgccaccaatatactatatatataaatattttgaatggaagccaaccctcttttggtctgccatctgaaatagattgtttgggttcaactgcagactctttgttctcatcacttgaactctcattgactggtttgccactggaactaactgacacattctgacgaccgacttccggtttcctagccttattatctgctatgacataagaaaggagtccaagtggaccacaagtcacggaaacaagcaatatgaactccatatatacacaaaaaaaggaagtaatttgtatgtcaaaaacacattcacttgctaatccaaatatattgtcagcataataaccagatgcagatcaggttttccaactaaagtcatgcaaaagtgcagttcagctccatgtttttcagaataaagagtattttttatccaaataatgttatttgtttaattttgcaggacttgacaataatctccagtcagattccaacacagggaaaatcttactagtgagtaacacaactgataatcacccatattgcacccaaaaggaacaccctcgtttagaggaaatagttctgaacatcttaattcatgcatatagatttcaccaggagaatcgaattcaaacccttggtacctttatatatataacaactgccacgcataaatgccaactttacagtggacataactaagggtaaggggtgtgtgtgtgtgtgtgtgtgtgtgagagagagagagagagagagagagagaggacagaacaattaccagaataggtttgagaacgggatgtcctactaggacgtgcttcaacatctaacttctcaaatggtggaggtccaactccatcatcattttgagacaacctcaaggatgaacgagataaccctgagaatttctggttcatctgccactcttcatacaatgattggacaactccccccatgatacttatattcttcgcacttaagcacaatatgccattatgtattggaatcttgttctcaagacaaatctacatgagtcgtaaagaaggagaaaatacatgacgatgtaaaacagtcagtaaatagcaaaagcatttaggtctgaatcacggatttcaatattgtttatttgacaaggtatatattgtgtaaataatcactaagaaaatattctactgttctgtatcaaaactatgctgcagtttgctcataagcaatgattaaggatgaaactcaatagactgtaggacagagacagacagacaaacagtgggaattaggaatgctatctcccaaccccatcctgatgatgcaatataaatacaccatctctacaggtagctcttacacaaacctcatgcagcatttactaaggaggatttcagattcaatgttatcaaggagcattcttgcattttgttttccaaacattattcatgtgggatgtgtggaatagaaacacaccattgatcaatgagctatctgagcatctctccttctatttatctagttccggtgacatgggaactcaatactgaactagttaggagcctaagatgaaattcagacaaagatgaaactatgtgcagagactctgactatgtcctctaacctaaaataaagcagaatgacaaatatcagtgcacatctagaacctagatcaagaacatggtggactaaccttagtacctggagcaatatcttcaatgataaacgggattgggaaaaactctatcgctactgcttcagaaattccatcagtcagaacaaagcgcagaaggcggtgttgctgtgggttcttaaaggacgcatcaatgatgcttctatatatatctcttactgatactacctgcaaacaagtttgcattaagcagggatcaaacagtaaaaaaaaaaatccaaaacacaaggacaacagttcagctccacaaacactagatgtaggttcaatcatgatcaggaaagacaagcccatgtttcaccattgagatagacaactagacatcattgttccacagaggacgttcagatagccaccctggaacagccaagaacatctttttcatctgctcggatacaaaacccgacccatccacaaactgagaatgatacaacgcaagccccagccacatgattgaaacgatcttaagtaaggccattccctagcatccagacacaaattctcaaccttatgtccagccaagaacaccatcgtttcacaaaggcctgacacatatccatacaagaacagccaagaacatcttttcgtcagtctactcggctacaaactctggccgcttccacaatctggatacaatccccagccacagaatcaatagcagactaagaactgttcctaaatgaggcatttctttcccttattttttttaccaggaataaaattaattagaattactgagctaatatcgaaacaaaagaggggtgtcatcggaacctgtaggacgatggggccatggaggtaggaaagccgcctccccgtggcggcggcggcggcgcggtcagggagcgacttgccgccgaagagcctcaggtccacgtcgacgagctcggtctccacggcctccggcgacggcgagggggaggcgtggagtagctcctggatgatctcgttgctggggtcacggaagcaccacccgcgggcggagagggattgaaggagcctctcctgatgaggggaggccgacgaccccggcgtttccgccgccgccgccatcgcagtcggggggcgaagtgttctccggcgaggtctgggagagtgctagggtaggagacgtgaaggcgggttttgtggtatacgccatagcagttggaaagcggacatttgtggtgcttactgcttagggctttgttgtttagactaattataagtcagcttaagaaccgaaaagtctaaatctaaacaaaatattttttctggttgaatctattaatttttgataatttcagtagtgtcgtatgaatgtttggtttgatgtcaaatttcaccaacactaataccaaattgtcttgaaatcaaattagccccaaagctcaagtggatcatcaaacctggagtatcgttcagtgtcaacgtttggcagattcaaagaaaaaaaaagaaacggcatatttgtaaataaaatataatttgtgaataaaacttttatatatgtgttcttaactattaaaaacaaatgctagaaaatcttataaattcaaattttagtttataaacataaactctaaaattaaagttataaatttaaattttagtccataagcatagcgaaatgatgaatgtgaactcggaaggctgaacacagggacatgcagccgcgggcaacaagccaacaagtgctcctgcagcagggtgtgaaaaaccgccggtaaccgcgcggttaccgcggttaccgcccgtaccgcgggggtacggttacccgtaccgcgcggtacggtttaataaaattcatccaaattcaaaaatttaaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgtgcggtaaccgcgccaaaccgcgcagtttgcccgaatttttgaattcaaatttcgatttgtaaatttgtcgcggttttgcgcggttaccgcggttaccgccggtaaccgccgtaccgccgggtggcggtaaccgggcccccggcggtttttgaaaccctgtcctgcagtcctgctcatctgccttcactcctcctcatcgtctttttttttttttttaactccttatcgtcgtagagccctagattcgcacgaggctgaggtcccgcagcgcgagcgatccaaagatatccgaggtgacgccgtgtcatccctagttagccgagccaatttttgtttatagctgtggattacaaaatcctcttctcatctgaaacgttctcatctactatactatcttcaggttcaggttcggcctcgcttttgagcagaaagcccaaaaggtttcagcttgggaagagcaaaatgcggtgagaccagaataatagatggactgtttctactcactccgtttttctcaatgtaaattattctagcatttttaatatttatattgatgttatgaatgtggaaaatattagaataacttacaatatgaaatgaagggagtagtaaacttcatttacaaatcccattttaagacgaaatatttattttatttattttttgacaacgaatttaattcggtcaccacgaataccgcatcaatattgtgctctctgtcagatcatcagacgcaatattgtgctctctgtcctggaatctctcggccatcagttattcagttggcaggttggcagtaattttgacgaaattcgttgaagaatgatagcggtggggttaaaaacgaaatcttttcgtcctctcaccataataaagtttctctttttatttgttggtcaagccctttttgatctttttttttctgtctcatgcttatcctccaacttcgcggcgcaccctccgcaaacgtaagccaaaaagatcaggaaaagagacagaaaaatcggaataaaagagtgatagatagatagatagatactccgtagatactagatcagcagcgatttttttttcagtttttgttttttcatttcttcctctgtcttgtttagatgttggggttggtgagcccttggggggaatcagttggtgactgactcgagaagttcagaggttgttgtctccgaattctttaaccccaacctctcctcttctcttctcttctctcctcttcttccttatactgcttcttgggctcgccgctgcgctgttctttggtcttcttggatctctgaccctaacatcgtatccaacttctccagttcttgttcttggaggggtgaggaagaggaggaggaggaggtgagatgggtagcttcgggaggctggcgaggagggccgtggagacggaagcgccggtcatggtcaaggtgatggagaagaagctccctgcctcgtcgaaatcgcatctttcccttctgatttctttggtcttgattgatgagttctatctctcttgtgccttgtgctcttttttcagatgcaggaattgcttcgagggaacaaggatgtgatgtcgcttgcgcaggtatcggatcgcaatttctttcggttatctgtccaatgattgtgtgtgtgtgtgtgtgttttcatgagagtaccaatgagtttgtgttgttgttggtacttggtcacaggcattttgatgtttgcatttgattgggaagagtgttcgaaatggattagtgaaatgatcatttgtattgttcctttactgtttgggtcaattgtctcagtaaactgttcacgttgtaaggtgaatcaggagagtttagtacatctgataacatattgtgctttgtataacacaactatttatcaagcatggaatttggaaactaaaatggttgtattcctgcttagttcctgaaaatggcgtttaactgcttatgctagccaaataagatatccaaatatatatattagtggcagtggtgtgtgtgctggcctcctattactgccaacagaacatgtgatatttactggaaattatttgctttcttttaaactaatgtaaatcttggatgcagggagttgtttattggcagcctcctgaggcagctatgaataagattaaagaaattgtatgggaaccatcaatcagtaaatatggctctgatgatggtcttcctgaactccgagaagcacttctcgagaaggtaatttttcaattgggatttgttagataatggtttccatggcccatgttatcaagccttcccagttatcacaaagcaattaccatgtgagacaaatgcacttggttgcctactgctaagcctttatcatgtgagacaaaggaacctgtgtgcctactactaagcctttgtcatgtgagaaattgattctggaattttttttacctcgatactgagagagtgagagtaaggccattcccaacccaaaacattagacatagtttccataaactccacatcatcaagaaataagtactagacactactcttccaatgcaaacactactatttcatacttaaatttaatgctacttatctcacataatgtcttggatgttgtgtagaaaccatgtctcatgcaagacatagtttcctcctctttcctcatttattcacttgccacatcagttttcatcctatgtgacagcttatttaatgctatggacactatcctagtcattgggttgggaatagcctaatatcaggaatcacatgctatccttacaaaattttatcaacgagaaagtttcagaaagtatctctcagcttctgtgggggcttgggggggagggaagctaagggcccctttgaatcgtaggattgagaaaacatagtaatagaaaaaacgtaggattttgataggaatgtaagtgtaaaatagaggattacaaaacgcaggaaaaacacaggaatgaccgtttgattgaaccgcaggaaaaacgcaggatttggatgagagagatagactcaaagaaaagttactaagaggttgaagctcttgcttaatttcctccaaaatttctataggattgttcattccataggaattttaaaggattggataggattcaatcctttgattcaaaggacttcataggaaattttcctataggattgaaatcctccaaaattcctatgtttttcctccaaatcaaaggggccctaagctctgttgagagctataatagttcaatgctaccatgtaacagtgcagtagcacagttctgagacattgcccttggtactaccgatgccccctcatgtagagatgggtgttatattcactgatttctcttactgcgataatattttattgaaaaactaataatatgaatggtaattattataaacatgttcgttgccttccctctattttcttcctgaaatttttagcatacattttgcagctgcgcagagagaataagctaaccaagtcgtcaattatggttacctctggtgcaaatcaggtaatgcacatgctttccagtttccacctgatttattacagctttgtcatcttattccggttttcctctgtgtattttgccttgtttagctagactataggatgccaatttgtttttcttcttcagttctatgagatgctttcttacttttctgtatgactgcttcacctaaaccttgtttaccaactaggttagccaaataaaagtcaaataaagtgatgtcttctatcaaattttggcaggcctttgtaaatgtggtcctcaccctttgtgatgctggggatgcagttgtcatgtttgcaccatattacttcaattcctacatgtcattccagatgacaggagttactgacatattagttggtgcaagcaatcctgagactcttcatcctgatgtcggtaagatagttcttccctttttctttttgttggagaaattggttagatgtctattatcaacagtcaattataaactagttgccactttttttccgcttctgagatcttccactttgtaagttgataagttctatcacttgatacattttctctcagttcaattgagagctatatggtttttgatcattcgatttggttcacttaaggactgtaaaagaatagttcattctggtagtacaatttatatttgtttaataaaatgcagattggttggagaaggttctgcaagaaaacaaccctatccctaaacttgttagtgttgtaaatcctggaaacccctctggagctttcattccgaagccgatgctcgaagtaacctgtctctctcattcacagttcacgcacacttgcattcgaggtgactttaattatttcttaatattgcaccattgttccagagaatttcagaactgtgcagaaatgctggtgcatggcttgtagttgacaatacctatgagtaagttagtactcaattactgattattgctcaactgcaacgtcattttggtgcttcttttctttctgttgttgataaagctcctcagtcccttcagaaattgatattacttaaagcaattgtaaagacgaggcactacgaaagaatgaactacacatggacatgatcaccttaagtagtagtttaaaaggacagttcaccataagcagttgagcaactgtgcttgacttcttgaagttgagtcctggatgacgccctctctgatagattaaataaataggacttcaagaatgtggtatctctttcaaaaagtatctgcaaaccacccgccagtaagggtttgtcaaatgtagttatcttcacatgctcagcttattcaagtagggaaaatcttccatttcttctcaacactagaattggacacatggaacaactcgttttcttttgaaggtcccatttcagttcctcaatttcagtgatgcccaaaataaaccctccagtcacttacaggcagagtggaagactcactgacaagagcctaaattgaatcacggattagactcttccctcaagaaaagtcttactttcagcagcctagcatccgctgtgcggcattgggaagaatatatctgttgttagttctgatcaaatcagaaatatttgatctcttgctaatctacccttgctctatatttcagatcatgtttaccttttcttgtctggctctgtagttgagtaatggaaattgatattagtttttgccatttccttaccctgatgttgatgttaaaaggatgctatgggtccttttcgaatataagcttgatggacttcccaatgttaatacaccaccgaatttgacatgtgtaaatcttgtatatgataaaagtataatttggaaactttcaattatcatcacattgatttttagataatctgtattcaaaatgtttgcacgaatactgaaattcaagaaaacattttctcggaagaattcttttccataaaaggtgactgaccttttactttctgtaaaataattctacatatggggctattttggattctgtataactttgatgttgaacttgcttgcaaaattggtgggtggtctccaggtactttatgtatgatggaatggagcactattgcttagagggtaatcacattgtcaacctcttctcattctcgaaggcttacggaatgatgggctggcgtgtaggatacgtaagtttgcctctctctctctctctctctctctctctctctctctttctttcatcctctgcttaggcttgaaaatgctgatgtaagagtcaatattgagttctttcagtttcatgaatttcccgcatccacttgaatcttttaccagggcattcccttaaattatcaccatagcaatgcagtataagtaacttagtggctgcacaatctgtgttgatcagtgagtcttacaagaactgatgagctgactgctgcagattgcccacccaaacgaagctgacggtcttcatgcacagctgctcaaagtgcaagataacatacctatctgtgcttccatcatcgggcagcgcctggcgctctacgcattagaggctggtccagaatggatcagagaaagggtgagagatctagtgaaaaaccgtgaattgctcatggaagcgatgtctccgcttggcaaggactctgtcaagggtggtgagggtgccatttacctctgggcaaaactacccgagaaatgctcagatgattttgaagttgtcagatggcttgcaaacaagcatggtgtggctgtgatccccgggagcgccagtggaggtcccggatatatccgggtttctttcggagggttgaaagaatcggatacaaggcttgctgctgagaggttaaggcgcggcttgcaagaacttgtgactgagggaatggtacagtgacagcccaatggatgcaagaaatacatgacatacaaatcacaaaagtgaaaattttcagttacataataattctgggattagttcaagagaagaaaagagccaaaatttcaagattacaacatggttgttagaaaatgctgaagcttttatttcagagaacttttgtcacattggatttcctagtggaaatttgatttggtgggttgagtagagggaaaaaaaaagactcatccaccctgtggaataccattgtcattaaaggggtattcatgtttagtacttactgttgcttgataacctctttccctacaatcaggacagcagctgtacacaagtaagatataataagatataatagcaacaataagtgttcatgatgtgcttttatttcagcttttttatttatttcttcggttcggatcacttctcgaagctcaaaaactgaaaaaaatatgtttcttgaacttgttagcacttcaatttctgaagaaatgtgctcgtgcagaatcagacattgcattttttttatataatggtttatattaaaccggcatttacatccaaagtgaatgtatagccaaaatcagacattgcatacaaccatgattttagttcttcaagcactatcacctccagttcctgtaaaactccaattgctgccaaaccagtgattgtaaatttagagttgttttcgtggattattgatttgattataggaataaattaaatattttaagaaataagctttactaatagcttacattacaacgagtgatttaagcaatagagtagaacaatccgtttaaataattttatgaataagctaaaaagaacacgcgcttcggatcttggaatagtttttcagtcactgcatgttgtgttttttttgctgtccacatacttctcatctcttttctcctccaacctgtgtccttttcatcgtacagtgatcgatccatcatcacagcagcgacatgtgattggctcacattaaaacgccgttctctgaaaaaagcaaatatgtttcctccttttcctcctctttttatgtaaagagatccatgaaaatgatgtgcactagcggtgcatcaaatgcctctcttttttttctttgcaaacgtgattgagtgagagagagtacatgagagaaaatgacagcaatcttcaggctgaaagaaacatagtatcagcagcatataaatagcttgatacgatgcaccagaaaagcaggttagaagtaatccatctactccgaaatataaagatttctaggttgcttagcaaatactcctttccaatgttaggtctaaagatttctttttactcacttcagtagttcagattttattttttttgaatctaaattcttgtattcccttttcaagtttgtgattggctttggattcattgaaatgatgggaatcataggaataagtacatggatgtttatattgtggtataaatttaagtcctaaaaatccttatatttttggaatggagaaagtagtactattcagcaggggttgataagaaaagcaataagcaacaatgatcacaagatcagcatcagcatcagggactcagaatgtgtgattgccaacaacaaatgccaactggaggagctatcagagactgacagttcaagaaatctgatgctaattttgtgttggagactttgagaggatgtgtacacacatctcattgccagatgaccaataatgcattgaaagagagagtgcttatacgggagtaaatgattgcagaagaaagcaggtggaggcagcactgcacttgtccctgcatgctgcacaattgaaatgcaattcaatgcagagttgcagtactgccatcaaagtccctggattaaggggtagtactgctctttacctgctaatctaacctgctactatcatgtactagcagtgaaattgctcacatttttttttgtatatattttactagcaggtgcatatatagcatttcagtaccacttgttctgaagatgcaggtagcaagttcagtcaaccactactggtaccaatcatcaagcccaaccaacctcacctagggtgcattccgaagtgtcgatggatgctgctgaaactgagtttaagacacaattattcgaaggtatacacgaacgaattgaatattacaaagttgatcaatatccttattttaaaagagttttccaagaatgccaatagtcggcgtcgtttaaggccccatttgaacttgctgaagatggacattaagtacgggcacgtaaaaaaaaagttattagcgtatgattaattgagcttgaaaattggatttatatgatatcttagaacaacatctatataaaacgttttcgcacaaaatacgccgtttaacagttaccggatcatattataatccaaattaatgtgtccttaaactattgcccagaaatgcaggctaacctgcagggggtgacacagtaactactgtatatcgtcccttgccgccttgcgtcagagtcattcttcaggactaaaataggatgaacagtatatgattagtaccaagaaatggtcacatgcattgctgccccaatgcaactcaaagccaagaaactatagtaataagattgagacagagagagaagtccaggcaaggcaattgcaaacgaacaaataattgaaggacaagagtatattagccaagtactacttgggggctcactgcaagctacagtactacgtactgctacagtatgcattgggttttgttgatctgggcacatttagggcgccattgatgcctggctctcaccttttttacaaagaaatcaattgaatctcgctttgcattgcagcatgccaacgagcaagctaccgagggtgtgtttagttcacgccaaaaatgaaagtttgattaaaattggaatgatgtaacggaaaaattggaagtttgtgtgtgtagtaaagttttgatgtgatggaaaagttggaagtttgaagaaaaagtttggaaaacttggcctgaattgagttgaatcgcttctcttctccaaaggtcaagaagaggtgttggccatgtgtgagcatcgcagcggccatagttgaatcaatgcattgcgttcgtatatataatggtcccaaatgcaagctacagctgcaatggccatggccatggagtagagagggagagagagagatgcgtctactaacttgctttgctgatgatcatcgacgatttgacgaagcagagacgacgaacggacagtattctgtccgtcaaaaaaaaatgatgaatctagacacacgtgtgttagtgtgtgtccatattcattcctagagtttaattttttttggacagaggagtatgtacgacaacctactgcagcagtagcaccacacaccgacgaagacaacgtatgccctcgatcggtggaatggaatggagggatatcgctcttaaaataaacaaacatattaaaaaatgtaacttattctattaccttgaatctaaaatctgaacatatatgtcctttcaaaaaaaatctgaacatatatcacattttttttgttatgttgggatagagagagtatgtcatgtatttctactactttctctatcatatattaagttaatgtagtataagacatgtgatttccattaaaaaaaagtataagacgtgtgatggttgttggtgcgacgaggaaaaccgcgcatctggagcctggaggtagtggctgcagaaggggaaatcggcgaagtggtagctagcggcagccggcaggcaggagcagcggacggacagacgcacgaatgcatgattgcactcacttctaagaaagaaataaaaaaaattgtggagtttcagagttcagggtttacgatggatcaagctgttacctgtttttttttaaaaaaacattttaactcttttaaaaaatttattttttaaatggatttttttaaaaaacttatttcagaaatagaccctccttaatatcgaggtccaatgtctcagcgccaataacattagtgctaatattatctcttcctggtagataagtagttgatgctaaggaggttggtgcctcctatttataaaaagaattctaaaggcttaggctgactttggtacgcatggttctcaactcactcctctctttttccgcgtgtacacttttcaaactgctaaacgttattacgttttttttaaaaaaaaattctatacgaaagttgcttaaaaaatcatattgatccatttttgaaaaaaaacaattagttaatacttaattaatcacgcgctaatgtaccgctctgttttctgtgtggagggaatgaattcccaaccaggagaatcgaacgtagctttaagggtctttgatgtcgatgatctatttataggaacaaatatttacattatgactattcttttaaaaaaatattttataaataattcctctgcaccaacctttttatgttttggcagctaaagactagcttgtttggcaacttgagagaaggggattgggagtttacatgagagaattgacggcccgtttggttggagggagtttttaggagggattgggagtatggagtgatgaggctattaagtgttttgtttggttgggagacataggaattttggtgggatggggatgaggaattgaggaaggaactcccaccttttcaatacctgcgtaggagcaggtaattgggagggaattcctcctttactttgtctaagcaaatctcaaccatccgtttttattaatgatctaatctccaactaaactccctatcaatttccatcacctctaccaaacaagatggctgggattaaaaatcaaattcccattttaatctcatcatcaattccctcgtgtaaactcccaattccctccctcgagttaccaaacaagccgtgatggtgagattaagatgggaatttgatttttcatcccagtctcttgtttggtagaggtggtggaaattgatagggagtttagtttgagattagatcattaatgaaaacggatggctgagatttgtttaggcgaagtaaatgaggaattcccttccaattaccaccccctacccaggtattgaaaaggagggagttcattcctcaattccccatctccattccaccaaaattctcatgtctcccaaataaacaaaacagttaatagtctcatccatctaaactctcaatccctcctgaaaactcccccaaccaaacgggccagggtgtttgacagcgagagaagagtctaaaacaagttatttttcaagagtttatttataaaataagttttttaaaaaaaatcaaacataaaaaatccagacgctgttaccttttttttttgataacacgtggttctgtgctagctgtgataccgctggatagggatcacctcttctcgaacggcctgtggaaattgcaaacatgcatgcatctctcatattccatggtaaaattgtactagtgtaaaatttggcaagatcatttccaatttgtactgcgtattggcctcatctgaatgcaaggagacatgcatacatacgtatgtgcacattttatacattttcagtatatattttcagcgcaataatggagtaccatgtatatatacgtatgtgcacattttatagggcgcttattaaagaccacccagtcgtataatggaatggcttctgctcacagcaaccaacacggcgtggctcctgtatacatccatacgaccatacactactttatactggtacaccagtatacggtacatatgctgcaactgcaagcaggatagagtatcaattatactcatgcagcacttcccactattccaggctgtaattagttatactagtagtaattataatcatcaatggatgaaacgagtaatactaattataagtgttttgattttcttttaaatcagccttctttagtttggatcaaatttatagaaaaaaagactaaatttatagataaatacagtaatactttcaactaaaaaattataatgttagatttaataaaattaatttattactttaaatattactatatttttctataaatttaataaattttaagaatttgattttgaaaaacctaaagcaatttatagtatgagacgaagggatgaccaatgagtgctctctccgtttcaaaattcttggtgttttggtaaatgactcggtcttcaaaataaatatttgaccttacttttctattataatatatacaataaataaatgcatatttacttttattttttatttttattatagaactttgaaagacagattcatatgtgttattctagaattataaaagtttgactataatcttagttcaaaaattacagcagttaaactagcaggaggagtaccagattagtgacacagtgttgacagtggcgaattgattggcgcgagcaaatgcggttggggactgcattcaatgcgctcatccgagcttcagcttcagctttcactctagcccaataactgtctttgatcaactgggtagtagaagacgccgccgtgtggggcccataatccagatcgaccggtggccggccggcgacaaattagccgcggcgacaactcctccggccggctccggcaaggccgtgcggccaggccccacccccagctagcctgtcagagtttgtcaccgcgtgcatgcgtacacaacactccactgtagagtacgtaggagggactacttcttggactaggagtttctggtatttacaagtcttgtaaggcagtaaggtggtgtttgattctcctgaagatgaagactaagttatttacgtaaacgggatagtataatgtgtgattaattaagttttaattattacaaacttgaaaaacggattgatttgatattttagaacaacttccatatagaaagttttcgcacgaaacacaccgttcagcagattgaaaagcgtgccacgagtattcaaaatttaatccaaaagttgttggagaaaagaacagggcctaaatagttttagatttttaaaatttacagacatataatttagaaaataaattaaaagtacgaaactgaaaagactatttccctattggtttcatgaactgtttctcacaattttcagccctcattacatgtcctccgttgaatgttattacttgctttgtttctttctgtccatcatctttttagggccgtgtttagattcaaatttttttctttaaattttaaactttttcgtcacatcaaatgtttagacacatatatggagcattaaatgtggacaaaaaaaaaccaattacacagtttgcatgtaaatcacgagacgaatattttgagcctaattacgtcataatttgactatgtggtgctacagtaaatatttgctaatgatagattaattaggcttaatagattcgtctcacagtttacagacggaatctgtaatttattttattattagtctacatttaatacttcaaatgtgtgtccgtatacttaaatttttttttgacacacggactaaacacagccctggatctgatttccgagagttcatcatctgcatttgccaacctgttttggcttcttcacgtgaatcgtgccggcgtgccaacctgtttctactgctctcattgatccagctctagaaaaataatttcccaaacatataatcaacggcaagaaaataatcactcgtgttttgaagcagttgtggatcaggaaaaaataatagagagggtaaactggacaaagctaagacccttgcgcgccatcccatggtaggttcgcccctattttgaagcacgggactctatccaatttcactgtaaatcaaaacatcttctaccaaggcatcctaaaaacacaaataatttatacgcattcatatgaaatctaaactaccaaccatacagaaatcgtggagccttgcgttcaaaaatggctaaaaagaaaatcaccgtgttatggcatggtgaaacgaagaataaactttttttaaagtaaatttcacaaaactacaaatactttaattaaattatcacagaactacagatttaccaataaatttaatataaaactataggtttaaggctaagtatcataaaactacaaatttaataaaaaaaattatcataaaattatagattttgcggtttaaatccttagcactaatgttatgttggacttataagtgttcaagttttgtgattaaattatcattaaatatgtagtttgtgatacttttgttactaaatctatatttttatgatattccaccttaattaatctgtagttttatggtaaatttagtattaaatatatagttttatgatacatcacattaagagtaacgatagttttgcgaaatttactaaactttttttctgtgagatagaaggaagcacaacgattgggccacgtggaggcaggagaggaggggcccatgtcgaggtagcagcaaaggtggcccagaagagccaaaccgaacggtctaaactcaaaaggcgtcgtctccctccatcctccacctacgcttaattctaaatttctaattccccacagaattagggcacaaaaatcaaatcaaatcaaaccaagagcagaggcgacgcgaggagagagaaggcgagctcgtctcgtctcgtctcgcgccattaatgcgagggggagtcggtggatggatggatccagccagcctcaattgccactgcggccatggccagcttcacagtacaacctccataaatcccccaccacctccgctcctccgctgcaaccaccaccaccaccacctgctgctgcggggaggaggaggaggcggagatgtgggcggcggaggcggcgttcgcgaggtcggggtcgtggagggaggaggaggacgagcaggaggcgctgcggtgggcggcgctgcagcggctgccgacggtggcgcgcgcgaggaggggcctgctcaggtcgcccgcgccgggggaggaccgggtccagggcgacgacgcgctctgcgaggtcgacgtcgcgggcctctcccccggcgaccgcaccgccctcgtcgatcgcctcctcgccgactccggcgacgttgaggacttcttccgccgcatccgctcccgcttcgacgcgtcagtaccacactgctctctctctctctccccctgcctctctgctcgcgtggaagcttctagaagcgcaacactcgacactgacatgtggggcccaactggtacgcacgcacaccgggggaagcttctagaagcgctttgctcgccgcgttcttctgtgggcgaagtactcggtttccaaaaacgcagggaagctttgcggccgggagcggctgacacatgggccccacatgccagtcttgcgttttgttcgcttgctagttcagatcctactctaaagctatcgttctgatgaaatgcctagatcatgcggggaaggctacatttggaacgcagtgattttacaaaaaaatttgctgtaattttacgaaacaatttcagctacggcttgtaggatctgtaaatcgctcgtctcctctggttggtttggattttggtgtagaattttgtttgtatgcttgtagtgttggtaaacttgctcatgggctgatctgaagcatctgtgctgctctccatttttttttatttttgttggttgcagagtgcagatagagttccccaagatcgaagtgaggtacgaggatctgacagtggacgcatacgtgcatgtcgggagcagggcgctgccaaccatcccaaacttcatttgcaacatgacagaggttggaccaatccaccactggaatttcccctcctttgtctcagctctgcagcaatgatctactagctgttttgaacagtagcatgatttttaaccacattagtttttttttttactctgggtaaaattgctgtgtaaaaagctgtaaatagtgggttcacaaatgagctctagatgtgcttatttgctgtttttatttttctgaaaggcatttctgaggcatttgaggatctatcgagggggaagagtgaagttgccgatattggataatgttagtgggatcattcgtccatcaaggtacaccacgtgcagaacattttttgtttcctgctggatcaaattgtacgaccttgtaaaatttgacacttggttcttgctgcagaatgacactgctattgggccctccaagttcaggaaagacaaccttgcttttagcccttgccggacggcttggccctggactaaaggtgtgccttatcacatcaatccgtcttcttttcttcgattctcgccgctcaaagatgatgagcaaatctcttctatatgtatacaatcaaccaactctgcatctatcacctgctgacaagagtactagtgtctcaaatagcatgaaaatggttttctggtcaaacgctcatccttctcatttcagaaatactatcgaaaaataaatactacttcagtgctataggcctgtgcttattctgatcagtgcaagaagccttttaaccatgcggcattattcaggactatacatttttactgactaccaacacccaatggattgcaggtgtctggaaatatcacttacaacggccatcatctgaatgaatttgtgccccagagaacatctgcttatgtcagtcagcaagactggcatgcctcagagatgacggtcagagaaaccttagagtttgctgggcgctgtcagggtgttggaataaagtatggtaggtcatttcaccacaatgtccttggtgttgttccttacctccttggtagtttgcgctttgacgttaatcaatatgtagatatgctcgttgaactcttgaggagagaaaagaatgaaggtataaaacccgatgaggaccttgatgtgttcatgaaggtagatcacatccagctttatttggacacacactacctgttttgttggtgattgtctcatgacactgtttgtacttaatttttcaggcattggctcttgaggggaagcagacaagccttgtcgcagaatatataatgaaggtatatggtgtatccctttcagctgctattattatctactttggagtctcaagtgtttgcttctttgagtgaactgcacaaatattttcgagcaaatttcacgatgcataacgaaaacccccatgttttgggggcaaaatgtttcaaggaaccccagatttttataaaatattcatttgcataataatatatggtatttttagttatattcacatatataatgggcacaaaatgtacattcttcttcctcactctcgctctccatgattgcacaaactcaacacaaacacagtgctcactgttaatgacagattaaccagttacataaacacaaaatggtttatactttcgataattgacatgtgttggaagtgcggctaatatgtatatatcacatactattttttacaattattatgcatggggttccttgagacaaattgcaatacatggggtttgggttacgcatgtcctataaaacctagggttttgtgaaatttactcaatattttcatcaagctgtttaaccaaatggctcacttaattcccatccattcaagacaattttcaattttccctacaatgttattttggcttatcatttttacagcatcaacatgatctacctttgaatcatttggttctggcaagatttctgaattgctaatttttatctagccaagattttagggctggacatttgtgcggacacaattgttggtgatgaaatgatcaaaggaatctctgggggacaaaagaagcgcctgacaacaggttgttgcatgataatttaatctccttcatattattggtgctgatggttgaagaaattgggcaattgcaagttgtatggattgcatgcttattctggtttgcagctgtgctcatatatgttgctcttgcaggtgagctgttagttggttctgctcgtgtgctgttcatggatgagatatctactggacttgacagtgcaaccacatatcagattatcaagtatttaaggcattctactcatgctcttgacggcactacaatcatatccttgttgcaaccagctccagaaacttacgaactatttgacgatgtcatcctcatatctgaagggcaaattgtatatcagggaccacgtgaatatgctgttgatttttttgccggtatgggattcagatgtcctgaaagaaaaaacgtcgctgacttcttgcaagaagtatgcagttgtaatctgtgtttgtgatattatgttaactggactgttcttgcatatagttatttacattttctgtgttgcaggttttgtccaagaaagaccagcaacaatattggtgccactatgattatccttaccagtatgtctctgtatcaaaatttgctgaagcctttaaaacatttgttattggcaagaggctgcacgatgagttagcagttccatacaatagacatcgcaatcatcccgcagctctttcaacatcaaattatggtgtaaggaggcttgagcttctaaagtccaactttcaatggcagcatctgctgatgaaaaggaattcgttcatctatgtcttcaaattcattcaggtattttcaatttcgagatgcatccagcagagtagcagtttgatgtctcaaataaatactgtcacaaggaaatgtaacattgtctaccagttaaaatataaagcacacgtataataaagtcgctaaaccttgctaagaataaaaaaaactaagactgtaaatgccctgttaactcattttacaatttcactgctttaaaagtttagcacactgcaatgatcaatgtgcagttgtcacaaatgcttgcaatttttccctacttggcacacgagagttatcttagcgtgcataaaatgttatagcctagtaagttttccctacgtggtgcgtgaaaatcatcctagtgtgtttatgttattgtgacatcatgctcagaatcttggtcacaactcacaagtttggtcaacatgtacttttacatcttggtgtttttactggattgctgtaaacttgactggatggcatataatccgtcaagtcacaaaaggatctcgttgtggagtttccatagtcaaaaagatagatcttggctatatcatttttcacatgtccaaaaccttcattttaaactatgattggtcaagattaacttgtgttgacttcaaatttcctaatggcactcttctgttttcagttaaacttcacctaagttttattttcaatcatttgagggttttttttaacataatctttatgttgcagcttttacttgttgccctcatcacaatgacagtgtttttccgatcaacaatgcaccgtgactcagttgatgatgggattatttatcttggagccctctattttgcaatagtgatgattctatttaatggctttactgaagtctcactcttggtcacgaagcttccaattctttacaagcacagggatttgcacttctaccctccatgggcttacacacttccgtcttggctcttgagcattccaacctcgcttattgaatcaggaatgtgggtactagtaacatattatgtggtcggctatgatccccaatttacaaggtaattgttaagttctgttcatttgctctctggtccgatgttcagagatttttttccctatctgaagattgatcttaatttatcatctgcagatgtcttggacaatttctcttgctcttttttctacaccaaacatctttggctcttttccgggtcatggcatctttgggtcggaacatgatagtcgctaacacctttggatcgtttgctttgttggttgttatgatccttggaggattcattataaccaaaggttaagcttcttgagtcgactcagtattagcacttgagacttgagagcatctttcaagatcttacatctgacatgctgctacctgttcttgaatatctaacagagagcataccagcctggtggatttggggttattggatatctcctatgatgtatgcacaaaatgctatttccgtaaatgaattccttggccattcttggagccaggtaatacctgatttaaaccccttcttgaggttggtagcaaaggcacattgtggcagcaatctgttagcttagtttggtgtatgaaaaatacttgcataatatggaacatcgtaattgcttaaaattatattaaatttctttgtatgaacctaacgagatatttttttattcagaaaaacttttattagccttatataggaatatttgcttctatactaactgtagctttgaaaaatggcagcaatttgcaaaccagaacatcacattaggggaggcaatactcactggatatggattattcaaggagaaatactggttctggattggggttggagcattgtttggttatgcaattgttttgaacttcttattcacattgttcttgactcttctcaaccgtaagtttgtgctaacttcatggacccagacaacttagaactgcaatcaaaatagtttctcattctcacaactggtgctccttcacagctattgggaatatacaagctgttgtgtccaaagatgatattcagcatagggctcctaggaggaagaatggcaaattagccctagagctaagatcttacctgcactcagcttcattgaatggtaatgctagataatgaatccctgtacttacatcacaattcatttttacccttttactaagtcttcatattaactgtgttccagggcataatctcaaggaccagaagggcatggtgttaccatttcaacccctttctatgtgctttaagaacatcaactactacgttgatgtaccagcggtatgtcagggggaggccggtttatatggctgaaatttcttttaaaaatctatgtatattgattcataatcaagttttgcctagcaggaattgaaaagtcaaggtatagtagaagaccgcctacagttgcttattgatgtcactggagcatttaggccagggatactaacagcacttgttggagtaagtggagctggcaaaaccaccctcatggatgttttagctggccggaaaactggaggactaatagaaggaagcatcactatatctgggtatcctaaaaaccaagagactttcactaggatctctggttattgtgaacaaaatgatgtgcattcaccttgcttgactgtaattgagtcattgctgtactctgcatgcctccgattgccttctcatgttgatgtgaacactcgaagggtaaagtcttggctgggctgcagtgctatgtttattgtacaagacatcactatttttgtcattctgatccctgatggttcatttcataggtttttgttgaagaggtgatggaacttgttgagctaaatgcattaagtggtgctcttgttggcctaccaggagtgaatggtctgtcaactgaacaacgcaagaggttgacgatagctgtggagcttgtggcaaatccttcaatcgtgttcatggatgaacctacatcaggattggatgctaggtcagcagctattgtgatgagaaccgtacggaatattgttaatacaggacggacaattgtgtgcaccatccatcagccaagcatcgacatattcgagtcatttgatgaggttaatttctttacaaaacctagtagtcaatttatgcatgcatgacaagcaatagttcaaaagtcattattttgagctatccttttcgtgacatattaacaagttgagcacagattttgatattttttcgaagcaacagtacagattttaataatcgttcataatttgatgttaatcagttttcttatcaatgatggatgtgaacagaaactagtcccttttacacttgatctgttgaactttcattgtgctacttagggaaaccgcgaaattttcttatacaagtatgtactaacatttaaccagcaccctttcctaactcattcatatgctggtcagcttttgttcatgaagcgtggggggcaacttatatatgctggtcccttgggctcgaaatcacgcaatctggtcgagttttttgaggtacaatctgcacaatgtgtttcctcagtgatgatagcttatacaagtttctctgtccttacactttgcgttcgcgaaaaaactgtccttacactttcaagtttgtaaacaggcaattccaggagttcctaaaatcagggatggctataatcctgctgcatggatgttggaagtcacaagtactcaaatggagcaaattcttggagtggattttgctgaatactaccggcagtcaaaattatttcagtaaacacaacgacccttttcacctctataaatcttggtctctttttccttaaacatgtttatgttatggcattccaggcagacccaagaaatggttgatatcctgagcagaccaagaagagaatcaaaagaacttacttttgccaccaagtattcccaaccattctttgctcaatatgctgcttgcttatggaagcagaacctgtcgtactggagaaatcctcaatacactgcggtccgattcttctacaccgtcatcatttccttgatgttcgggacaatctgctggaaatttgggtctcgaaggtatgtccactgatgattctgtctccacttttcttcctgtacttggctggccttatagcgaacatgtggctttgtttgacagggagacccaacatgacatattcaatgccatgggtgccatgtacgcagcagtactcttcataggaatcactaacgccacctctgttcaacctgtgatttccatcgaaagatttgtctcgtacagagagagggcagctgggatgtactcggcactgccttttgcattctccctggtaattttccctgtcaaaaactcctgtcatctcatcatgttttgatgctcgtagtagtaccataataaggctaacaatcgaactgttcttcggcatgcaggttacagtggagttcccttacattcttgtgcagtcacttatctacggcacgattttctacagcttgggctcgttcgagtggacagcagtgaagttcttgtggtacctgttcttcatgtacttcaccttgctgtacttcactttctatggcatgatgacaacggcgatcactcccaaccacactgttgcgcctattattgctgctccattctacacgctgtggaatctcttctgtgggttcatgatcccaagaaaggtacggaaggaacaggaaccccatgcataatttgcacctaacgtcctctaattgtactggacccatgatctgttttccccataatccatattccagtgcacattatccatatctttattttttttgtcacattagcatatatagctatggaaatagtgtttccaatccataaggccacttccagtgcacattatccatatctttatttttttttgtcacattaacatatatagctatggaaatagtgtttccaatgcatattatttattactggggccaaaaatgaattatctcccttcgcaaatttcatcagaaattcttagaggagatatctattttcctggtttgaatatatatgcaatgtctcatccgagacactcttttttctttataattccttagcacatcatctaaaatgctgctatgttgcatagtagtttttagtttctattaacattgtactataatggagcatgagtgccctgatataccagtgcccctaataatttcaccaaacccaccagtaactttttttgtcctacagtgaccacttgtcatgtactagaaccactttagcaattgggaagcaataatggtttgtttaaattaggacgtgattaaagtggctaatgattaatgggcttaaacataatgcagaggattcctgcgtggtggaggtggtattactgggccaacccggtgtcatggaccctgtacggcctgctaacctcccagttcggcgacctggatcagccgctgctgctcgccgacggcatcaccaccaccaccgccgtcgacttcctccgggaccacttcggcttccgccacgacttcctcggcgtcgtcgccggcatggtcgccggcttctgcgtgctcttcgccgtcgtcttcgccctggccatcaagtacctcaacttccagagaagatgagacgacgacgagcgagaagcgagctatagggagcacgacgtacaccaccattaattctctggccagctatagcgctcaaatgtgtactgcaactactatgcatgcatcaatccatttcgtttcttcagaactgcacgcgtctcttctctctgtcgtcacgatgaattcctcccggtcacgggagatgctggagctagcagagatcagagaccagcagaaaaaaggagacaagtgtatagctaagctacctgttgcaagcctgtttggcagatctccaacaactagatctaactcggagctaaagtgaagctgtggaacagccgaaacctcgcctcattctaatttttttcagattattttagcctgtttgagctgaaactgtttggttggatagagttggagcgggagctctatcaaacaggcaagtgctccttgattggcttgatcgttatactgcgtacgtagtggctggtgcggcagcagtgcaatattcggcgagcattttgcagcagccacggtgagccaatgggaggtcgacacctgcaagccttttgactgctgcaaccggcgtccctccatgggggtactcttttggaagtagcagcagcagcagcagctagctatagcagattctgcgtcccctggcctctgctgctgctgcctccgaggactgcaaaacaacaacctagctagagcagcaactactactaacaagaaagaaagaaaaaaaaaagaaaaggaaaaggaaaggtatgaggagtactgtactgagtactaaccatttggtgatcgatcgatggtgcgtggcgatgagagatggagaagaaacgggattgattgatggattgaagatctaacaccttcaaaaggggggcagtaggagcatcttctacctgcatcgcaggtacgcaacaacacatgcatggatcgatccactcgtcccagctttttattactaccatctttccttcctttttttttccctttagagcaagataataatagagcacactttctattattagctcatcttaaagccaacatatataatagattagctataagattgactataattttcttctcatctctctatctctcacttatatatttaatgcatttgtcttagagctagtgataagctagctcttgcatgagagccaacattcttaatttttcgctacctctctcctccatctaagcttatagtaggcttatagctcactattatacttgctcttagtgagtgtttggcaaatgggaaagggaaatgatttcccacccatctttaaatactaaccattcattctccctcttccatttaatcctaaccctttattcattttccaatcccaatcccaccccctattttccattatccaaacacatccttatatcttctacttctcgagaggaatatatatgcagctactagctatagctagacattcgtgtccggacgtataggaaggtattcccagcatcattcatccgtgccgtgtgcagcatactgttttcttaagcccaaaccaccaatagcgtttcacgatgatcgatcaatttttttatatattgatgacagtttgtaataaagaaagaagcaacgaatcgatcaaattttacatatgttaatggcagttcgtaaatggtaatggtcgagctgtctccaccagtgtgtatacatatacatacgtacagtggtggaggcagcttgatctgctgctaatgtatatacaaatatatttggtttgttctctctatatacatacgtatatcttgcgtactcctttcgtttcaaaaaaacacctaattctaagtgtgtatccagattcacatctataatagagttatatgtgtccagatttacactggattaaattttttagattaatttttttagatggagggagtacagaagtgagattgagagagcgatcagccagtggagtgagtagctatagctgagcttgagtgtagcttagctaggggtgacgcgactgttgctgggacacgtggcgtgccttggttggatccatgggctgtgcatgcgtgcgtgtcggaaggcgacatgatcaatcgcctgcatgcgccctgactcttctgacgtacggctatggtttaagccaagctataaccagaaaccggccggtcaatgtacgtaacggtcatgggtcaatatgtgcagctaagctagctatctcaatcgatcgtcgagttattcatatcgtttgtagtacttttcttcgttgctatctagaataaaatttaatccatattaaaataacaaatctagataaaaataaatatatctttattcgttgttgtaggataaatcaaatcctcagtaatattttagaacaaaaataataatagtaggatggtatatcatggtttggccccgttggttagattcctaaattaatttattttgaagcggaagaaatagtagctcaataattgcaatggtcgattcataccattcctagctacctatgtatacacgttgattctgatcgattgggcgacgatggattacacatgcagctagtgtgtgtcgtatatacttatagtatactatatgtactatcttcgttttcaatagatgatgttattgactttaatatattgtttgatcactcattttattgaaaaaaaatataaagatattattttttatgacttgttttcgttattaaagaagtacttttgcatgtatgcatcaattttaaaatctgacaagtggtacaccaaatttaaggatatcatctatttaaaaaaggagagggtatatacgtatatgcaacttggggtgggctgaggaagatcaacatcgagaccgaaaagaccgtagttttttctgtttatgtttatgtttagcgtttgaccgtccgctttatttgaaattcttttatgattagtatttttattattattagataataaaacataaataatactttatgtgtgactaattgttttctaaattttttcataaattttttaaataagacgtacggtcaaatgttagacacaaaaacctactacacatgagacggaggtagtgctacgtactttttctttttaaacaacatatacttatatatgaacgtacttgctcagttattggacgtatctggcaggcaggatgcaggtatacatatactatactactagtagtaacaaataattaacacatcgaagttgtctcatcacgtcaaatatatgaagaggggggtcgtcacgccaggcgatgctagagtccacgggagttgaatttgtctgtccgattcctggagctttccagattgaatcgggtgttgtttaacctgcagtctaggccgggtcaatctaggtctctggtgcaatcctttatacaagaacttagggtttggtcttgacctcggtgtagatcgattcgctttggtgtctgctgcgtcgtctgcagtcggggaagtccagcatatagatcaaattggttcttggcaatatggcatcccatgaagatccgcgcgatcgtcatcgtgatgaaggtggtgcaacaaccgatgaggaaccgattgaagatctgggcggggcttcggaggaggaagacgatgaagatgcaattgtggtagactttgatgaggctaaaaagcatattgatacacagtatgtggccattgggaagttcttctcaaggaggactttcagcgcaaagggactgtttgaagccatgcaaaaggcatggggcttgagacaaggcatggagtacaaacgcctgcatgataaccgatttctactggaattccaatctgcaggggatttcaggtttgcgactggaggcggtccttggatctatcaaggggatgctttcctgatcacggagtatgatggcaagtctagaccttcggatgtgaaactgaactcgctaccagtttgggtgagaatttacgatctacccctgtctatgatgactgaaacaatgggtaaattgattggtgcaaggctgggtgaggttcgtaaggtggcggtggatgatcagggaagagcatgggatgattttatgagagttcgggcggagcaccctgtggataaaccactgacgtgttggctgaaactgaaagacaaggagtcatcttcggtggttcagaggtatgatgtcaagtatgagaggatccctcggttttgcttttactgtggccacattggtcacatggagagggaatgtgatttaccctcggataagcaaacggtgaggtttggccttaatctcagggcgtcaccttataagcagtttgaacatcgtagctgggctctgcctggtaaagttgacaacaacgcgaagagaaatctatggttcccaggtgagaaccagtccaagccagctcctgcgggaagccaaaataaagatggcccatcaggcaaggaagataggaagaagaactcgccagaggaaaatgctccagtaaaggaaaattttgctaaccgggatgagatagaggcagagatccctacggtgcaggaagagttgaagggtttaaatgctaggaacccaggaaaatccagggaggatggtgaggtcaggaagctagctgaacagtgggagcatatggggaaaactcaagaagatcagcctaccttccacgcagcttcacagcaagctaaggagggacaaataaggagtgagactgcaggggagacttgggtgtctagcaaagattcaatcaatcagtacgaacagcttgatgaaggtgctgggaatggccgtgaggaggtggacgaacatgttccacccctatcaacgatccatgaagatatctctcttataaaccagcttagagatgaggaacttggtgagggacataaggaaaatatcgatgatggggtaaaacctgtgctaggaaagaggagtatggataaatctctccttggcccaggatatgatggaccttcgtttgatgttctagttggaggtgatagtaagaggagtaagagtttgtctctatagacagcaaagtcgatccacctgacgggcattccaaaggaagcccgtcaggagcaatgaatattttaagctagaactgccgaggatcagggaggcctcggacagttcaagatcttgtttgcctagtgcaaacacacaagcccaagctggtttttttgtctgaaacacatcaaaatatagaaagagtgtgtggcttaaaatagagattggggctgcggaattgtgtagcagtgcctggagaaggaacggggaggggggggatggactagccctcttttgggatgacacagtacaagtggatcttctatcctacaacttcagatatattgatgtgctcattaaggacgaaagctgccctgtgcaatggcgatgcacctttgtgtatggtgagcccaaagctagcgaaaggcataacatgtggactcttcttcgtcgcatcaaatcaaattctactgctccatggtgcttagtgggcgactttaatgaagctatgtggcagtttgagcatttttctgaccacaagagaagggagaagcagattatggatttccgggaagtcttgtcgcactgcgatgtgtttgatttaggtttcacgggtgccccctggacttttgataacaagcaaaaaggaaggaataatgtgcgagttcgactggatcgtgcagtagcaagccagagttggtcttctctctttcctgctgcagaagtgattcaccttactgtgtccagttctgatcacagtcctattcttctccaagcctcccgagtggatcgcatcaagaaaggggatcggtgtctgcggtatgaaattatgtgggagagggatgagcatctgacagatgagattaaatctgcttggcaactacagggacatatatcagacttaggctcagtggcaagccgcttaaagtctgtgatgggagcactgcagacttggagccgtgataaatttggttaagttagcaaagatattaaagaaacaaggaatcgattggcagagcttcagatggcaggcaggtgtgctagtgatcaagactatctcgatatatccaggaagctggatactcttgtatagggaggaaatgcaatggctgcagagatcaagaatctcttggttgaaggaaggtgaccgaaacacatccttttttcataggaaagcggcttggcgccacaagaaaaacaagattaataggctgcagagaagtgatggaacctggtgtgataagagggaggagatggaagatatgacatcaaatttcttcaaagagctttacactaatgacccttctgtcgagccagaaccattacttgatttggtacagcccagagtcacgtcggagatgaataagctgctttgtaaagaattctctgatgacgaaatttcaaatgctttgttccagatgggtccgttaaaagcgccggggccagatggttttccggcaaggttctttcagaagaattgggatgtattgaaacgggacattattgcggctgttaagctgttctttgaacagagaagaatgccacaaggtgtaaatgacactgccattgtgttaattccgaaaaagaaagagccaaaggatttgaaagattacagaccaataagcctttgtaatgtgatttacaaggtgattgctaagtgtttggtgaataggatgcggccgttacttcaggatgttatcgtgccagcgcaaagcgccttcattcccggccagatgttcactgacaatgctctcatagcttttgagtgcttccatgccatcaatcggtgtaaatcggttgagtctcaattctgtgcttacaagttggaccttacaaaggcgtatgatagggtggattggagatacctagagggagctcttcttaaggttggtttttgttctcaatgggttcagctattgatgacatgtgttacctctgttagctatgctgttcgcttcaacggatctatgcttgaatccttcaaaccgaccagaggcctccgacagggtgatcccctgtcgccctatttgttcctctttgtggcagacggtttatcaacggcgctgagtgaagctgaaagatcaggacggttacaacctctaaaagtctgcaggagagcccctggaatttcccatctcttgtttgcagatgatagcctgttgttctttaaatcaaatatggaacagactaatgtggttaagagtgctcttactttgtatgagcaaagcacaggccaactcctgagcccggccaaatgttctttgatgtttggaaagcattgtggggatgctctgcagtctgacatcagatcccttttgcaagttcaacacacttcctttgaagataaatatcttggtctgcctacaccgatgggtagactgaaggcaggaagacaccaatctttgaaggagagatttgagaaaagattaacggattggaatgagaaatacctctctatgggagggaaggaagttttaattaaatcagtcctacaggccattccgacctatgtgatgagtgtgtttaagcttccagcagggctctgtgaggaatatatgcagctgatccggaaattttggtggggagaagaccgttagaaaaggaaagtccattggatctcgtggcagcaactgattaaacccaaaggacaagggggaattggtttcagggacttaaagctttttaaccaggctctgctagcttggcaagcatggcggctgatccagtttcccaacagtttgtgtgctcaaattttaaaggcaaaatattaccccaatggggacttgtgtgatactactttccttgtggactcttcagaaacttggaagggggtggtccacgggttagagctgctgaaacaaggtctaatttggtggattggatcaggaagcaaagttagaatctggagggataactggataccgagagagcataccctaagggttttgggaaagactgttagattgagaatcaaatgggtctcggatcttatggttccacatcagcaaatttggaatgaagagctagttcgtcgaatcttctatcccccggatgctgaggaaattttgaggatccaattgccacatagccctgaagaggacttcattgcttggcactatgataaggtgggtatgttcactgttttttctgcttacaaattagccctacaggcccagatcagagctgacgaagaggttgcacaatgctcaaatggcgatggtgataggaagttgtggaagaacatttggaatgtgcaagtgccgcagaaaataaggatttttgcctggagagtatcaagagattgtctagccacacaacataataaacatcgacgacagattgtacaaaagccaaactgtgagatatgtggggcaaaagtggaagatgcgtttcatgcta

SEQ ID NO: 76152 - DNA, 522 bp, Oryza sativa
cgaagaaattctagcagtttggactgaggaggtggagaaccaaactgcaggttctgctgctgcagctgtgcttgctgctgcacctgttgcaacacctgatggtactgttgctgcatctgttgcatcatcattgtcatcatctgagtctgattgtccaacacctgagcaattgttgggttctcgggcggtggggacggactgttgtcagatgcactgttggcacgtgctccattgatcggcttttcgctgccactggcgttgttcgagtcgcgtgaaccattccttgtctccatctgaaggggataggtagaaatatgagaaaaggaagaaaaacagggggctcagaaactaatctttcttatgaatttaagtgcaattatcttaatcttgattaaaacactgaaaaagaggcacgcaactcctaattgaggcagtcataccactgacacatgatatcgaccgccgactagcccacaagcatcaaacctaaacacgaaaactagcaagcaaacagactaagaa

SEQ ID NO: 76153 - DNA, 588 bp, Oryza sativa
ttgacttggccgcatattgcccctggccaccgtctaggtcatggttggtgccattgacaaaacacgctttggtgagcattgcatcctcaccacaaattgctatccttgccgtctctggtgatctggtcaaatctagcacttttatagcccatgttgacactcgcactggtttatgaaaaataaatgaaaataaaattatatcgtgcatattatgaaaagtataaaattggtactctttttaaataaactgattgatgcgacatgagtaaaatgatccaatgttccttgaagatgtatcttgtatgcagatgatatagagggctatgaactagtaaaatacacccccttcccgatgttcagtgtcgtattatccgagtctttttgttctttgggcttatatggccctcctctcgttaccataagtcggtgtggcttaatgtattgtgtaacaattattcttttcttctaatatattgacgtgtcatttttttacgtgttctaacaacaaatagtaaaatacagatatatacttttagccttattaaagtagtgtaaactacgggtaccgagctcgaattcgccctatag

SEQ ID NO: 76154 - DNA, 515 bp, Oryza sativa
acgtcttacaaacatcataaagtcttacataaatacagcggaaaattaaaagataactggagctaagccttgacttggaccgcagcgggatcaccactccacaggcatcatcgacggcacggacgaagcctactcctcggagaagccaccatttgacgcatactcaaactctggggtttggggaaaatagagcaagactgagtactacccactgtactcagcaagtcataccggaataggggtatgatgcagggaattatcaagggatagctatagaggttcgtttgcataaagcgagcatttataaacagtagttgaaagtagtaaaacaattataataattaatcaatattaatcatccactgtccaacgctataccacgttgcaacaggcccaaccacccacctatactattcaattccattagactagactagggtgaaactaatcacggtgaatctggttgaccgcccataaccgcgggcatggctattcaaatagttttactctgataa

SEQ ID NO: 76155 - DNA, 986 bp, Oryza sativa
tatccatattttctagcgagcagttcagtacataaagaaccaacaaatgctatattaactatctattatatacttaaaaattcattaaactccctacagatcctcttaaactgtcacatggttttctacaaacactcatgagatgccatgtagtgctcaaataaattaaaagttcctagaaattatgataaaaaaatcaaaccattgattttcctttaaataggtagatccaataattataactgctacatctcacaaaaataaatccggtacccccacctccacccctaccgtatgtgagcatgcatgtacgtacgtacctccaccgtcctactcatctctgggatccaattctcatatcctatttttaagataacttttcctattttctacctagcacataatatatagaaaaataataatagctaaatgatcatgactctcaagttacatgtacttttctcagtttatttgactttttgtgttatttataattaaattcaagacccatattgcacatatttactatatataagttagataatactgctatctaactacaaatatttgagcaaaatagcacttcgaaaatgatgaatgaattcaaatgtgtgggtctaaagtccaagttcaatcatcaccaaagaagcttggaaccagaatgcacactctgggcctgaacccgatgaaggcggagctataagacattattagcaaggtggacactgacggcagcggcatcatcgacttctacaagttcctggacctaatagcgcactaaatgattagatgaaggacaaggactaagaggaggggaccagagggagacgttccatgtcttcgacaaggactagaaaacagcttcatctttgccaccgagccccaccacgtcatgtctaatgtatcaagagaggctcactgatgaggaggtcaacaatgatccgcaaggctaatggtgacaggtggatcaccacaaggagtttgta

SEQ ID NO: 76156 - DNA, 1815 bp, Oryza sativa
aaatcaatcatatgttttatgaataataaggatccgataagctatggcacctcaatctttttttaatttattcctgttttttatacgttccaaaaggaaatagttatacattatgcccagcgaattagacaaaaaaaaaacaatcgaattgcaaaaaccactgttcgagattcgagaaagacatagccaaccctaaaagatatatactggagtagtcgtgtgtgttttagcacatttacacgtggtcgatttcctagttaatttttttctctgtcttttgttaggaggaggaaaaaaatcgatatagctaagtagcgtcgacttgggttgactttgatgaacctgaccatacagatgtttggtgcatttgcatcattgcatgtatccaaggagaccatggatacacatgcctggtgcagatcgatacaaagatttgggctgaattctaaggaataattaattatttgttactcttataaataatgataaaggatttaccattgaacccatatgtcatagacgcatcttaaagtgacaaaaagttaaatgtttcgaattctaaacataagttcgcctatttttttatttatcgtgagcacacgtgtttcgtgtttaaaaattttctttaaaaacaataaataaatctaattttaagtttataatattttatatttaaatatacacatttcgttctccgtgcctcaagtttcgaacaaagctactaggaatttgtcctcttgattcgattggcaatgtagttctaggaatttgctgctcgcctgctcggggccacagagggttacgggctgggctgggctatgtctgggagcatagcagacaaggctgcaggaaccaagcagcacagcatcaacagcaggttggcaggcagcccatacacagcctggcaaattaagtcgcaattccgtcctctcgacctgtttccgagagcacccaaaattccatccctaaaatttatttttttaatcctaaacataattttagatgtgaaaatattaatctctccaaaagatattttaaaattaacttaaaaaagacccacccattagtatcaacagaaacacaaaaagaaatcgctccaccataccttccctacgcacgatctcttctcacgtgtcatcctcttcctttgctgtgcaaaaattgtgaacgagtgcctcctcacttatgaagaacgagaaagaaggagaaggggattccaattttgagacacatatgaggaaacgattggagcaaggttttttttttaagaaaaaaagcccaaatttttggattgggcttcaattagggtttgattgaggccgttcatattaaatttgagttgtttcatacaagatttgttcttaaaaaaaacatgctcactcaagacactaataagtgatgttttagacgtcattaacacataattgggaaaaaatatgtggtagaaactatatatatattgaaaacctgaaaactaccattagataaaaatagacatatgagatttgtccatgtcatcacgagtaaaaattttactcgtagatttactctcatgatgatatggacgaatcttagacatccatttttcttagtttttcactacatattttttccccatataatttgaaccattaactatatcttatagatctgaatagtttcataaacaaaccataatattacaaaagctttggttacaacatttttggtcatgttattttcatatgcctaagacccatgttaaaaatataattacagtcaaagttatctcctattaacggtatggagtttaaatgatgtatttatttgtaactg

SEQ ID NO: 76157 - DNA, 4869 bp, Oryza sativa
  unsure (1)..(4869): unsure at all n locations
agttgagctttatttatattggttcaactaaatattagatataattgcttagccctgcttagaaaccttagcacatttatgggataacttatgattcactattatttcatgatggtttattgatagttcacgatggtcaatcgtgattagttaattaattaatgtgccaactaaaacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatggttcgttgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttattttccgctgcttagatctctattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaaagagctccaatggtctagatgtggacatgatactcttagtaggatgagaacatgcaacttatttgccggcttgacaagcactacaaagcttatctttctcaaacttcacatctttcaagtccacaactagatcacgttttgaaagtttgctcaattgattcatgccaacatgggctagcctcctatgccaaagccaacccaatgaagtttttgcaactaaacaagttttcaaatttgcttcactagaattgaaatcaaccaaataaagatttccatatctaaaacctttgaacacacaagacttgtcaagaaggttagaaacaataacttcttgcgggaagaaagcacatgacaagccaagatcacaaatttgagcaaccgaaagcaaattgaaatttagagatttaacaagagagacattatcaattgacaaatcattggagatagcaattttacctaacccaattacctttcctttgctattgtctccaaatgtcactttctcttgttcattccctcctacttcaaatgtggtgaacatagccctatcaccggtcatgtgttgagtgcatccactatcaagcacctaatggctcccaccggtgcagtagttcacctacaaaagaagatcaagctcttttaggtacccaaacttgtttgggtcattggaggttacagaccaaagctttgggcacccaaatggcattctttttaccaccgagtataggggaacccacatatctatcaacaatgctaccatcatgagccttcctaagcatataatgagaatcaaacatgcatgtcttaggaggcttaccaccggggcaatcattcaccaaatgcccaacctcacgacacttggagcaatacttaccattactcttgacaaaacgagtggcacggtgagaaggtttcttacccttctttggaatgaatccaagtccctccttgttaaggatgcaccgttgctcactcaaaatcttgtcaagagtgttcttacccttgaagcacctctccaagctcttattgagcttagccacttgctccttaagctcattgtttttaacaacaagtgaggcatcacaaatagaaacacaagagttagagctagagctagacatatccacaagatcatcacaagaggtagaaatgctagatgatgcaacatgagcaatatggcaagtagcactatcatcaagcaaatcacaagatatgccaacatcaatgagagcttcatgttgagtagtggaaaggaggttgtcatgagcttccttaagcttctcatgagaaatggtgagtctctcatgagaagtctttagctcctcatacaagacctccaaagaagcatgatccttctttagggccttgaacttgacaatctccttctcattataagcatggagctcctcaaacatactcacaagctcatcataggaaacattatcacaatcatcatcactctcactatcattaaaagatgttaccttagatgagtcctttgccatgagacaaagtggaccgaagagtgatggagcctccttgatggcaacaacgaccatcttcttcttcttggagcttgcatcatcaccaccttcttcctcggacccggatgatgcgaagctctcctcatttgagtcccattccccgatgaaagcctcaatcttcttgccttccttcttgagcttcttcatgagcttgtagcctccactcttcttcttggatgacttgtctccatcatcatccttggaagggcattggaagcaaagtgttgaagcaaagtgtcccttctcaccacactcaaaacacctcaagttggagagagtcttgttgggtcttctatttcttctcctattggagttggagcctcttcctctctcctttctccttcccaagagatcattgaactatctagcaagaagggcaatctcttcctccaagtcctcattggcttattcaccttgcccttgccctagtcttcaacttcggcttggagggcaatgccctttttagaaggtgaggcttcctccatctccttcttcttcaacttgtacatgtcattggtgttgatcttccccaagaggcttgccggtgtcatccttgacatgtcggagttgatgagcatggtgataaggggtctcatacttctccggtagagccctaagcatcttttgggcaacctcaagatcggtgtagtttgccccaagccccttgagatcattcacaatgacattgagcctcccatacatgtcattcacactctcatgaggcaacatggagaatgtctcatattggatcttgaggaaatgaagcttggcatccttgtactcacttgtgccctcatggatctccgccaacttgttccaaatctcatatgtggtctcaaggtttctcactctatcaaactcctcttggctcaaagagttgaacaaagcattcatggcttgggtattgagttggaggttgcggtgatcaatctccgtcaagggcgtgccggtgatagcaaagcctacatccacaatactccaaatatggaagctcatagctttgaggtgagtagacattttaattttccaaatagaatagtttgtgccattaaacatgagagccttccctacatggttcacctcgttcgacatcttctctctaggcggtgaagcccaatcaagagagaccaagctctgataccacttgtaggatcgagatgtcgactagagggggggtgaataggcgatttaaaactaaaacaccactaatcaaaactaacctaagttgctaagcttggtgaaggtcaactctaactaagcaactaagttatgttttgcaaacctaaggtgatagtggttcaattatatctctaggaaagtaaatcacactcctatgtcaatgtttagcaatccttaggtgatatgatctcaagtatgtctctagaaatgtaaattgcacaaatataaatgtgacaatcaaatgagacaaggagacaagagatttttcaccgaggtttggaaactcgccagtttcctactccctgttgaggcgagcccaactccaccgctcaaccacgaagccaccgcacgcccccttcgtcaaggggtgggtaaggcgggagccggcccacggaaaggactacccaagcctcaatcactagggtagttcttccttcactccaaaggtggtgaactccaaaccactcacaaaccggcgccgggcctcctccacaatcttttcggagaggtcaccgggcaactcctccacaacccgtctaggaggtggcaacctccaatagtaacaagccaatgacccgcgtggagatgatcaatcaagtgccacactacctctacaaatgaaagcaatgcacttgactcttggctaatcaaccttctaacacactagatggatgaacacaaaactcaagtaggtgtgaaaaaggtgcaaaggatgtatgcaattgaattgggtgccaaaaaagtccccttgctgctggtgggggagtatttatactcccaccccccaaaactagccattgngggcgaaatcccaaatcattgtgctctgtcggtctgaccggaggtatgtggccggtcagaccgtgctactctgcaacggctagaaaactagccattgaa

SEQ ID NO: 76158 - DNA, 6361 bp, Oryza sativa
ccaaggggtctgaaccagtataatccttgtcttttgtttgcgtgatgtcgtattacgtagatccttgttccaacgtaccccaataccctctatatctgatttacgggtatctcccgtcgacataaacacttaaaacattttgtataccaaataaataccacaacatgtcttataacttgtaaaagtcgaaataaattcatgctatctgatctaaaaattattgactaaacttttttgaattcaggataatgtactattttctgcagtaacccaaaatgttacagaacttaggcctaaattacataatgatacaacgaaaattccttaaccataaatcatgttaagtctgtacctatccactgtaaagaaatcattcattttagaccatgctgattttttttgcatatattggtgtttgtttgctatcagtgaggaaattgaagaattaaatttgaaaatatactattgatttgttttttctcaaaaatattcgggatgtaaaagttttgacagaaatataccgccggtctcgcgtaaccattgcgtgagaatgacgtgggcatgacaacgcacacggtttcgcgcgacaaaagcgtgagaccgcgcgtactaaagcacgagaccgaacggtctcgcggtaccagctagcgattctgaatggctggccagattcaaaatgtttaattaccctgactagtaatatgcccatactaaacgctacggggtaattctattggtctttaatatttttttaaaaaagattcaggttagcaaaaaatatatttatatgatctgtgcatttgaactttaatattttataaagaaatgggtggaagtacaaaatagtacacatccacgacatttgaagaaacattagttatatctctgaaggcaaagcgccctccattggaggaagtattttgatccatatgtaaatgacaaattataaccaaacgtgagttgaaaccaatttacaatgcgattttatatttcaaagttttaaaatatcatacatcaatttgatttctcagtagcagcatgaaagcataatacaactccactaatttataacctcgatacacgccaaacatgaccatttcaacaccatctttaagtgttgggattaattgcaaataagaaatacacaagttatatgggctccaaactgggtacatcccgtcaatcaattggtatgttatgtacaaccaaccgttcaaatcttgccaaactcttttgttgagcagaagtataacttctggcagagcaatgaagatactctaacgaatcaaaacgctctcgcatcacctgaaaaggatagtcaaaggaattctgctcaaggccaagaagatcatcaactaatactgaagcaattcttgtattgaagatcatcaactaatcttatgacattagttatcgcccatcaacaaaagaaataaacgccaagtacttaatggcagtacctatctcatgacatcaatatagcaaaacaaatttacagataaattcccagtgcgatttgatgtgtggcaataaaatataggccatgactcaggttactgacagatcaaaggcccctagcataattgaacatgatacacaatatacctgaaccatggaatctaatcacatatgcatgacactgttcactgacataccacctctcagctttcttacacgggccgtgatatataccgcttgatttatttttttcttctaaatacatttatatcatttcccttctacatacatgtgtcaaatgtataaaatcaaagatggttgtttcttgtgaggatgtatattgtacctgtttggaatcggcctatgacactcctaataatttgttcgtcaaagcagaagtataaatcttgctctgtagatcgctctatagttaaagaagaaaacagtgattttagactaccagtcgcttgtcaatctgctaaaatataataatgaattaacctataggttcaatcaaccctcgcattttggcagtctgaagcaatgggctaaaaagtaatatttataagcacacttcttatgtcactaacatataataatgaattaacctataggttcaatcaaccctcgcattttggtagtctgaagcaatgggctaaaaagtaatatttataaacacacttcttatgtctctgagacaaattaacatagataaagattcatatcacaaaccaagccatggttccaggcaagaacagggagagtaaaaaaaattatggatttttactgccgaccgagtgagaaggtacaggaaccccacctgagagaagaggtcggtgacggtgatgatggcagcagcggtgacaccattggtcagcacaagccgcctcggcactgaccctgaacccaccattcgctcgctctatgacgatggcgacgcttgcttgaacgacggttgtgtgtggcgaaggtactatacagtcttaaatgaagcttcatccatgccttgttactatctcgttatcagtttatcacctgctaactactccctcttgtaaaaaatatgtgttcaaaaaagatatatgcctagagcatcagatatacagtctacggatgcggagaagtgtggatgttggatttattagctcggttcataagacaacaaggaagaaaggattcactttatgtctggtgagtttgatttatctatttggtgatgacgtcagttatctggccatggattagatcaagtcaaatttaagacagaagatgaagttgaacatggtcttcgggagtctatgatgtgacagctaggaagaaatccaatttcgcttggcaagacgactgtggtgatatgagagaaggtggagcactgttgcaggtggagtcaagaggaagaacttgcagggatagcgggagtctcttgttacggtgagcctggtgaaggttcgtcggggcagctcggcgtgagcggcgaaaaaggatcaactcaagtcctggtacacgaaggttcgcgcatggaacaaatttaggttggcatggcatattcgccaaggtggagtttgttagagtttgtgtcgaatatgtgtacgtagtcggttacagtttaggacttgcagttgtaataggtattaggattagagtaagagtcgaactctatcctaggatctctcataaatagaggggcgtgcctgttgtaatcacatggcgacttagcatagcgagaggaagcggctgccggcggcgaccggccgtgagtcgttgtaactctgatacgctgtatatgctggatcggggaggagcgcccgtaatcagtgccccggagatgtaagcctcggctgaactccattatcaaatatcgtgcctcggtgtcgtcatcattttggatctcctatggcgttttcttccgtgtttagctaccgatgttgatttcggggctggttttataacatgcataatagagtgtaaagtacatattgtaacttagcatttgcataataggagtgtaaagtacatcagtacatatttacctaatagtatgatacattaccaatgtgcagttagtgccattaaacaaggcctttttttttttgctttttacattctagataaatagccgctaaacaattatgtaagaggtgtttagctgagatcaatggtgattattagctgcaagattaatcaaatcatcaaacttaggaaacatatatctgacagcaatttgaaactttccatgttcctagtcaatatataatgtatacacagagtcaagtgcaaaagatgagacttacaattaaggttcttgtattgatcagttgaaaactcaagattatacgtatcaataatcaaaagttggattgtactgcactgatatgaaaggttaagttgcatgagcataaggattaaaatattgcagatgcaaaagccatcaaattttagtgagcctgagtacacagtaatgattgttcattgtgagcatgacttcatcgtagcagattacttacagcttacctagaaaatgattagacaaatatagagagtggaatttgccacacatatacctctgatgaactcagcatagcagctctgagtcctttttgttcagattaaaggaaggaatccacaaagaagaactgcaatgtcaaacaacccgacggaacagatcccaaagtaagaatgcacgatttcttaataaaggaaatatctgatcaaagcccaaaacgtgactcatgttatatacactctgtcatcaatttaaataaaaaaaattatccttcgcattggtacaatggtacccctaggatgtgttaaaaaatttcacatgccaagattacgaaggtaacatcagaagtgaatcgtagaagggagaaacctgggcaattgcctccttgctgattgccgtggtcattagcattccataaattttcctaaaagatgcaaagggggataacatcagacaccgaaattaggtcatccgtatgaaattcacgagtccgacgcatcaaaaaaattaccaaatcgcaatcgtcagtcgcagatcgttccgcggtggccgtggataggagcgcgacctgcgggatccagcgcgagatgctccaaggcgaggaggcagggcatcgcggcatcgatctggcgagggcacagggtgaggcggcggcgacgaccggttgaggtagcgcggttagggttgaggggaccggggggatggatggcgatggggcggctgacgaaggggacaatggcgacgcggtggagagcgatgggcggcggacggcgttgttttcttcgagagggatgggatgttttttctgcgagagaggataggagcggggaggggaggggatgcgctgttttcggcgagagagggatgggagggagccgtcggatcttaagtcataagtaggatttggagcgttggatgtgtgatatgataaatgatgaatgagtaaagattaattaattactaattaatcacgaatcagataattaattattaattattattaattaattcctaattaagtaattagtccctaactgagcgccggcgctctcgctcattccttgtgcgagaccgtccgcttttgtcccatgataccgcgtagtctcgcaacgttattgtgcgagacccgtccacgtcgtcacgcccacgttattctcgcgcaacggttacgcgagaccgacggtatatttctgtcaaaacttttacatcccgaatatttttaagaaaaaaagcaaatcaacagtatatttttaaatttaattcggaaattgaatatattactgatccaagtaaggatcttaattaaggcatgtgcccctcttcctttgaacatattgaaacccatgtttttggaaacgtgttgttttatgaaacttgcacgtgtaattctaactatctattacttttaaattgggaaaatagtagctatatcctatttgctgcataaacaccctcaaatctttgataccctgctatttgtaatcataggaatattcagagcactttccttgtgctcaaatgagtatatttatgcttttataaatacctaatgcttacccagcttaaaataaacttaccatggttatggatcacttatatatgctatttgaaccattttaaacattatggacagaggtgattttcagtgtatttgtgagctaaaatgagagaaaatgtgaattttagagagagtgttagttacatatggtgctagtgacatatctatagagagagtgtttgcttgggtcaattaagaaccgaactctatgccattaactattgtttaccgtgcaaccacatgtgctagttatgagataaccttagctaactaagttattaattgttcattcgggaggccattgtggtagaggtagtggctacgagtatactgtgggatatcttgtcacgctcggaatttttatccaaaattccaaacgcttacatgtgtgtgaaccctcgtccaggaatcagccgagacacacaataacaaattgataatagagtacaattattactctaattaataagcgaataaaatgtcattacagaggtagatagttcctctcaatcaataaagatctaagcagcggaaaaaaataagataaacggcgcagacgactccactccgcaggcagcttgaccagggctacacctaatcctccacaccatcagcatcactgaagaactcttcctctgatgaatgattgcaaggtgagtatacgacatactcagcaagccacgcagcaaatatgcaagtgcacaaggataccaaagaatggcataatatatggctcatttgcaaaagcagcatttagcaaacatttgagaattataaaacagtagagtaattaatcatccattttaatcaactctaaacagcacccccatgctgctcaggcc

SEQ ID NO: 76159 - DNA, 1625 bp, Oryza sativa
ataccagccgatgccgatagggttttgagcaatcgattatatatccaatgtggataatgatataaagacaatcgactgatgataatgtaataaaacaataatatgatctagttgaaaccaatcaactaacaataatatgataaaataagtgatctgatggttaaagtatacatcagcgggaggtctattgtcatagaatacacaagattagataattaatgaagcatttgttgcaattggctaaaaccaacttgtattcaatttttataagccgattcaacgtccaaataactcatcagctgaaatcccgatgaaacccttattataatcaaagacaggttagcctttatgatttaagcacgactaaggatgatgcatcacaaagtatgctaagaagcaaaaagtctaaaaatcaagtcttcgacaaattttcaggatggtggataccttagctaatctaatcagataatttagctgatactagcataaaccctaaaatgaatatcagccgatatgatcaaattaaggtgctaagctatattaactaagatatatgacaaataggtaggcaaatatataaaccgaaccagagcgatccaagagattgaagcgatgcagctttgaagcacaccaatgtaaccgatacaattgccaatgccggcggtacgtaggacttaccccttcgccggagatcgaaagtcaatgcagccccgtgttaggtgccatgttctgccggatgataaataaaacctcgggaaagagggtggcgatacaccaagagtaattgtatagatctctgtgatagtttacaatgacctcgggtgtacatatttatacccatggatagatactagtccttattggacaagaaagaaactttcataatcataaaaggaaaatataaaatccttatcggacactaaacacacttttctagagagataaaaggaaactaacaaactcttcctaattaatagataaactgccaagccacatcctccttgaactcagtcacttctgaataaacttcctttaatagtttaatttccttaaccaaatctactaaggatccgattattggtgacttgataattctcatcagccgattcgaagatgttgaagccaatattgattctaagctgatgatgacttcggagcttacaaaattttggcgttaacaccgcggcaacatcacagaggagcaggagcagctcaaggagcagcggcggctagggggcgaggacaatgacaatgccatggcataggaggcatggttgacgttgacaggcgctagcactcctcccgctccctcacttgacgaggtggaaggctgtgacatcctggcgcaattaggatgaggcccgtgtggcccatgtgagctgtgtgcgcaagtttcgtaccaccttgctagcactggtggaaccaacttataaggcatcttccctccaaccatgtcacttccgagttaacccttttatacgaagcgaggatgaaattgtaagtggagaggtatctgtaagtgggccagcccgtcggatagactggctacacggttctggagggagggctgttacaaatggtatcagagccgaccctcgcggttgcatgtacgggtcagtgtgtgc

SEQ ID NO: 76160 - DNA, 14154 bp, Oryza sativa
gggagcacccgtccacgtcctgctcgtcgacgtccacgtctggctgggccaggagaacttccatcgcggcggcgtcaccgcagctcgccgtgaacatcatcggcgagaacacgttccggtcgctcgaccgagggatcgtcccggaccgaatcacgccaagaacggcgcgctcgaagccggccttccagcccccggaacaagcgacggaagccgcggactcgccggccgagttcaacagcgcgacgtccgctccggcggacacgaggatcctcaggcaatcctcgcgcttgtggcgcgcggcgagtatggccgcaacgtcgccgccctccgccctcgcgttcacgtcgcatcccttgcctatcagcatctccaggatctccggctggccgaggcgcgcggccatgtgaacaggcctggacctggagctcctggacgtcttcacggccacctcgtggtccacgccggacgccagcagcgtctgcaccgcgccggcgctgccgcagaggacggcgtggtggaggagattccggccgagatgggtggcgcccgacgagtacccgttctggaggagcatgcggaggatggcgccggtggactcgtagtactccacggcgcaccagaccgcgtcgtaggggtccgcgaggccggcgccgacgcgcagctcctcgccggtggccgtgtcccatgaccacgctcccagcctcaccttggtgtccctctttactccggcctggacatgagatcaaaagatggtgttagtatagctccggctgctgaagagcaagtgcgtgtgctgccagcccgccaccagtggagtggtgcatacctgaagtagctgacgaacgacggcgatttgccggctgacgatcgcggcgaagagtgccgtgcagtcgacattggcatgcagagaaggcttcagagagcgcaggagcacccgagaagtagcatttgggtcagctccacactgcgaaaagatcagacgatattagctgcagcaatttagtcgtgtactaattcaagcaagaacgccggcacaattgtactctaaacgaattgcaaatgtgaaacatatgaagggagaagggcacaggtgtacaagttaaagaacccagatgcaaatgtaaaacatgtgaatgccacaggtgtaccgtgtacgaactacgaagtgcaaaagtagtatgtttgaaggacccaagtgcaaatggaaaaaaaattgaagggcacggatgcaaaaaaatttgggtaagatccgccgaagcgggtagccttaaccgcaatgtgctagaggaaagtccgaagactgttcccgtccctgtcaggggagatgccaaccgtctctcctttctacgaacacgctagatgggttaccgcttcgtcttataaaccagtgcaaacgagcaagaataagcgaggtgggactaaaccacaacacggctatctgcttctccctatgggccacggcccatgtgactaggcacactgggctcgacagcatctggactctgcaaaacagtacaacaccacccgcaacgctcgctatcggggatcaaatcgtcctgcacatctttaatcgcgcaatctcatggaacgagaacgatgtctctacagatgcatgaaggctatgaagccatggagcaaagtacacacttaccttgatgagcgagtccaccacgtccacgaagccgcgggcggcggccgacacgagcgcgtgcacagcgacgcgagggcggacgaggtcggagcccatgaagatgacggcgagggcggcctgcccctgcagcgccgcctccacgacggcctcctcgcacgccggctgcgacgccccggcgcgcaccagcaacgccgccacctccgcgcgcccctcccgcgccgcggccgtcgccgggtacccacggaacaccttgccgttcacgtccgcccccttcgcctgcaggagcgatgcacatttgcgccaaacattagactgtgctaaagaatgtacttctggttgctctagacacaagtttctgcttgtaatgatatgaacatagccaaaacgataatgttagcacaagttgatcaaacaattttctcagattttggacagtaactcagcaaacaagaactgatatgcctagtacagtttctccttttaccgcatgctctctctttcacctacattgctccacacaccgcgggataaggggtaccatcaggatggaccaacacagtagcacagaacagggcacaacaacagccatcgggacttggaaacatagctggccgagtaacaaatgtcgctgttactactatgtctggtcaggtcggtgatgtggagacttggtaaccaatggactggctagccagtctgtgcaagtcctgtggcaatggcactgtgccatgattcatatagcaagagacagaaggggcctcctactggaagaaggaatctggtcaaaattctgcagggtgatgctatccatcgatatatgaaatcttgatgtgtggtttcaccgcaatgtcagctcagcctcgctgaatacagtagttggccacagctaactgaaaattatctaaactggaaccatttatctctttcaacatcatatataagaatatttaactacccatccttgaacatttgctcttagagaaaatgaagttcacggaaagacaaatggagcaagaaatgaacaatgcaggctcagaaataaaagatgctagtcctttggtccttgctactcctacattctgattctgatgatcccaccatcaggacacatcatacaaattgtaaactcctgcttaaccaacccttggcattttatcaagatccatcggacaacaagacaagagacgcattcaattccacatccaggattctcatcacacaataaattcgtcgcaccaccacgagtacagtgctgtgcatgctgctatttaccactctgaaaactctgaaccgaggtgatgttctcaaacagcacttacgtggcacactggcatccccatgccaccatcaatattccaccgggggccatcaggccatgagcacacgcggggctgagcagcggccggcatacgcagatgcccgatcggcgaagcccccacgggccgtacgcgagaggcgctgtgcgttgcatgggcgccaggtgcgtgcagcagcaagggaggatacagctggccgcgcggccggccggtggcaggggaagcagatggctacagggcaaagaagaacacgacaccgtccacacatacggggtgcgcgaggagagcgagcgaaggagcagccatccatccgtacccgcgtcggcccagccgatcgatcaggcgccggtgtgggggcacacatcgatgcgtcgcacctgggcggcgacgtgcgcgttgctgtcagttaatagggaggcccttggcgctgcctgccgtggaggaggccgcggccagatcggggctatactccggtgaggagttgggtttttcatttctaaggcgtgatcaaatacagctggtgcggcttggacgtattggaagcggcggacatcggatccggttacttggctgtgtacccaggtgcagaacatgtgaactcactgatgatgttgcgcatggccagagcccgggagacatgacatgagctgagctgccgagcgacgctggcctttggatggccacctgacctcggactctcggagtcagttcagtctatggactgtgggtagacagggagatattccagtgtagaggatggaagaccccggcgcaaaatgcagaaaagaggatggaagaccccgcaaaatgcagaacaaagagtgcattgagaggtgattattgatgagcagttcatggctgattccacagtctgtggcctgtgggagtcagggtgacgttccaagaagaagaggaggccccgcaaaatgaagatcagagagtgcatggagcaatgattagtgatggacagctagcatgacatgcatgcatgcatttcatgctcaccaaacgggttcttcaatccttttttcctctgtgaaaaaaaaagatcctccacattttcacctcctatgcgttttgggataaaagccacggctatggtggctgccgtccttggcaatggcatttattgatcttttgcagaggccatggaacgcgccggtacagtcgtacagaggccctcatggccgtggcccgtgcgagctcatctgcctgcaaggcaaaaaaaaaaacaagaagaagaagtacacgcatggccgtgcccggctgctcccctacgccccgtcgcagcgcaaaccactcccctagtcccttgccactcccattcaattcaatgctgccccatgacatcggcggatcacccggtccgcgcaccacacctctccactcgtcagccatcatccaccaacactacttctccgatggtcagaaagtacccctagccgtccgatcgcggtgacgcgatcaggatcacaagagtgacgggcatgtgggaccccgagggggttgaatgagtcgtgagtgtgattagggtgacagggcccaatgcaaagtaccataggatccagcaccaaagcgtaactacactctcaagattaccgggagtaagtactcctgcatcaacaggagagatcaaacgaggggagaccggaagagcagagccaagcagatcacgtgatcccacccccgaccaagctcacgaggggaatatattggtttctaccaaagcgttgagctggtacttaagtacttaagcccggtacactatggaggagtacttaacaccagtgccctctgatgcttacacagattcattacattatcaattttgctaaaggaatgattcattatattatcagcagcagtaaacaaagaggctttggtcaggtaaagtcaaacccatctacccctgtcccccaagcaccagtcctctcgagctaaaaacactctcactcacgcagtgtatataattaggcttaccttctagtcgcagcatgcatgatgctggaagcagcagggagaagttactggaaatcagaatctttagcagggtacttgcgcacagtatcgtatccttgcttataggaaatgcgtttgatggtatatttgcttataggaaatgcttggaaaccacattcgccaataggaaatgcgcgcacagcatcgtatccttgcttataggaaatgcattttgatggtacatttgcttataggaaatgcttggaaaccacatttgctaataggagatgcttttgatggtactggtactaaaatacaggcatactataccgtatgtatgcgtgtacaccttgatcaatgcgtacacgtatttctagacaataaagagtgcccaggaagcttccctgcctatttgcttgtcccaattccagatttttatcatcggtatatagaacaaatatgtccgtacgcattaaaaacgaactgcaaatctgcaatgcaaagcatggtcccattgcagatttgcagccatgcggggctggtacttggtaacttaccttctagaaactaatagtagtataactgtaaaaatacaagttcataaaaatattttgctaatgcctataaaaaaaaactttgctaaagaagcacataattcggtctaaaactttggaaaatatctcatgatgagtaactttttccgttatggtttcccaccaaaaaaatgaaaagaagttccaatatcatagagagcgacaataaaagttagcgaagtttggaagtatacttattttttctttccaacaagtcctacttctactcataatttgggcttattaaaaatggcgataaaactttttaaaaaaggatgatatttgtctagcgcgtgcatttatacagtacattaaaatcatcatgggcacatagaaaaacaatactactacctgagcaaccatgaaaaaaaaaagagatcattagactgaacagtgggcaacttttatctagcacctattgggtgtggagatggcacttggcagtgcccgctaggcccatttgaaatgtcgtccaaggtttccaccaactcgaatgcttcaggagaaatgaaactagtgttaagtgaatttcgagaagcatgagtgttcagtgcttccttccgagaactaaattgatggtaaatgtgctcgagctctgcaaattttatgccatttcgccaccgacaccagacgctaattttatggggggaatgcgacgtattcagttcgaatgcacaaaaacgagaatggctaagcattcaaaccgcaccaaacgagagcattcaacatgcgacgaacagagcatagtaatgcggcgaagttgtagaacagagcaggaaacaggggagggcactcacaagcagcgcacggacgagcgcggcgtccccgttgccggcggcgaggaagagcggcgacacgtcggcgcggatctcctcgtgcgccgcccgcagctcagcggcggcgccgtcccgcagcgcggcctccgccacccgccgcgccttgagccacaccaccccggcgtagttcacgtccgcgcggccggacgcgagcagctccccggcctccctcgcgtccccgcgcgccaccgcctccaccagccgctgcgacgcggcctccgcctccgcctcgtcccgcagctgccggtggtggtcctccgccaccggccacacctgccgcccgccggcgatcgccgccgccggccgcagcagcactgccatccctaggagagcttctcgaagggcaacaacctctcctcctcctccactctctctcccccctattcgctccgcgatctccctgtgcggctgcgactctgagctttttccttgggaaacttgaagcggcaaggcgcgacgggacggagcaatatataggtggggactcggtcgctctcggcgagcaacaacaacaggaagccggcacggtagagttaccgcgtgggtgaaactgaaaggtgcaaatacggggggcccacctgtaagcggggatgtgctgctgctccggtggggtaagagcaagttcaatagtacagccaactactatcttcaattcaactatagccagtctaatagctcatttatacaatagttacatactacactattaatacatagtcccatctatcatacacacactgtgtcttggagtccgtgctacagctggctatatatttgtagcttgttgcccttctctctattcatttatctctttaaaatatgtttgcagctggcttatagcctgctattgtacctgctctaaaagggggtgcgtgcatacgtggaggggtgcgtgggcccctcccctagtatggtgggccgggcgtgatggcgttggcgtgatatccatcactctctcctcacctcacggctcggcgcctccccggctcagcggctctcggttgaatccaccatgcgcgccgggcgccgcgaccacaccactcgcacacggcctagcaaatcacggcgcgacgcagcgcaaccacgcgaaaacgtgaggcggcgggcgggccgcccgcccgctccgcaccgcgcgcggcgcacgagcgattcgcgtcgcggggacgaggagatgcagtacattactatacgtggcttggcagtcgcggtcgacgtggcgcccgataaaaaaagccggtgccggcgctgccgccggcgcaaggctaggggaaggggcctcacaatattgtctgtcgatcgctctttccccgcactccgcgctgctttgctcccgctggcatggcgcgagtgccgccgccttcgctgggatttcagaaaagaaaacaaacacacttgtcgccacaaaagctgccgcgtgtctgtcctcctcccgtcacgccggttttacagttttacaatgtatactccctccgccccataatactccctccttctctaaatgtttgaggccgttgacttttctaaatatgtttgactattcgttttattcaaaaaattttgtgaaatatgtaaaactatatgtatatctaaaagtatatttaataatgaatcaaatgatagaaaagaattaataattacttaaattttttgaataagacgaatggtcaaacatgtttaaaaaagtcaacggcgtcaaacatttagggatggagggagtataagggattttgactttttttcttgcactttttgaccattcgtcttattcaaaaaattttggaattattatttattttatttatgacttactttattatccaaagtactttaaacataacttttcgttttttatatttgcacacatttttttaataagacgagtagtcaaacagtgcaagtaaaaagtcaaaatctcttatattataggacggagagagtataatagtaggctataaataggctaaatgttgagatggaggagagagaagaagaagcaggctataaatttacagtcggcttaaacacaagaaccaataaactttgagagtgacaagtggaccttgtattagttataaagagctactattatttggataagctaagagaaaactataaaaaaccttatagccagcaggtcggctgtattattagacttgctctactatgctcaggtaaaaattacccgtttttttgacaaattgacccttttggaaaacttatttcgaaactaacccctgccaaaaacttcaaccaaaaataggccgtcgcctcagcgccaaacacattggcgctgacgttggctgtgtcagcgccaacgggactggcgctgacattgtgccaccgtggcggccgggccgatccccagctgatgtggcagctacctcagcgccaaccggactggcgctgaggtgggacttggccgcaacccccaaggcccagaccagcaagccttctggatggcttgcgggctgggacctcagcgccagccataatggcgctgaccgtgggacactcagcgccagcccacctggcgctgaggtgggacttggccgcaacccccaaggcccagaccagcaagcttgctggatggcttgcgggctgggacctcagcgccagccataatggcgctgaccgtgggacactcagcgccagcccacttaacggcacattctcctctgcatgtacttcctcccttactgggtcattctcttccctgacctccacatccgccatatcatttactccctcgcccccctccacgtcttcctcaatcaattcttcctttctactacacctctccgacagttcgtgacagctaatgggtgattctatgagtggactttcattaaggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccgcccatattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggctgccacggtggcacaatgtcagcgccagtcccgttggcgctgacacggccaacctcagcgccaatgcgcttggcgctgagccgacggcctagttttggttgaagtgtttggcaggggttagtttcgaattaagtttttaaaaagggtcaatttatcaaaaaaagggaaaaattactccctagtagatatacatacggacagttacacagtcgtactactagtagcacccactcattcactcgtctcgctcaccttttaccccacctatactaccagtagtaccagcacgtatttctcgctcgtttactccggccactacaggctctctggagcccggctgatttaccacccagatcgatctctggagagcctggagcgtagtatgggtttcgcctgccgatgcgtcagattgatcgctaccagagccgatcccgtatgagtgaatgcaggctgctgctgctgctctacgtgctttcccgtggctgtaacgcgggccgggggagtactacgtgccggagccgaacggtcgccctctgttttttgcaatccttaccaccgggctgcctgccctgccctgctgcgctatctgcatccggcctggccgtgcaggtggtccatccagagtccaggagatcgatcgagggagcgagaaggagtcaagccggtgccgaggaagctaggaacgggtcgcctctgcagcggatggagttggcaggagaaaggatatggtgatgttgtcgtagcggcggtacgtgtaagtatgtacgtactcccacatctcgtgatcatgcctgcgttcgctgctcccctctctggttgctcctttggctgttttctccatggagacagtttgctttagttggtgttctggtctaacgaagataaacttcatgttaggacatgaaaaaaaaataagaaagtcatttacacacgattaactaagttttaaaataacttttatatttgaaagctttcacaaaacacaccgtttactagtttaaaaaaatatactaacagaaacagagataaaatacatttcttaattaaaaaaaccactttactctctctcgtcgtgtactcctgctgacatttttctttcttcttcggtctctttgttcttgacagttgacaccaacttcgtttgctactctgaatttagagcgttttgctcatcagcaaagttgaaataatgcacaccaacacggtgcctgcatttctcaggtggaagtgtaacccgggccggttaattacaggtcgagtagtaaaatggcacccagttgccatgtgtgctgatctagctatacattactcctacgtgtctggctctacgtacgtacagctaggccattttgcctttgtcgtttccgatgggaaactacacgacctacttgcagttgtcaacttgtcaagtactccatacacgcacttgccggtgttcgacggcatggcgacggcaagggtgtatcgaggcgccccaaaaaaacaagcctcggagagctcgccctttgcccgatcgaaccaaatacttgtatagctgcattttatactgtactgatctctattatactcgtgcattgatgcgtagtaagctggagtgttaatgtagcatcaagtgccggccacttgtttagtaggagtaactaaattagtactccgtagtactctacgtggttagagatcacaatctgaggaggaacgtgcatgcaaatagtgtgagagctaggagacaagcgctggctgcgccgtaccggtaacccatctggtcgatccgtgcatggcgcaacttctttctttcttttttttttttttaccctttcgctttctctctgcttcttttccggtgaagattttctcggcctctcttcctgaccaagatcaacacatacaagtgtgctataccaacgagaggaaaaagaaaagaggaaacgaaaagaaaaggggaaaaaaataaagggagaaaggctgtcgagtgtctaggcaattcatcacgtatttcgatctggttggttgctctgtttccttggttttgtgtgaaatggaagagatgataggtcgccactcagcaatgcacacacactatggtagtagtactagtaactgccgagtacggagagtcagtagaaagtgaaaaaaggagtgcagattatgtgatggaacagaagggtgattttgtgcaggtttttttgcagcgtggcagaaactggcacgagtcaactcttgctaggggaaggatcataatcgtctgcttgcttgtgtccggagtcacgcagcattcaacgatcgattactgggtctccaattggaaggccgtgatttacgagaattgttcaagtgcttgcacggataaataaaaatagtattaacaatgtagtgatgaatggttagagcaaaaaagaaatgcataataggtgtggccaatgcatggattgcgtgctttagctactcaaatttttctgttaagtcaagtggtattcatgtgtattaggccaaaatccttagctagctagctcatgggtggatcgaatcatcatgagcatgactgcatccatgcattttgacatgttgcagcggctatcaggtagcatttacagtttgttaatctgccacgaccgcatagttgcattaggtgcacgatcgatagatacggtccgaatcttcgaggaagcaacgttgaaagggcaggcttaaggctgactgagaaatcggtccaattgttgggaaaatccagtgttttaagctgcaggtacttggcgtatcgttattatttatttattggatcctttccagccaagcataccaaatgctagcatgactatacttttctttcttctccatttttttaataaaaaaacatcataccctaacaatctcacattttctttcaagataccttgtactactgttgtatgaaatacatggagtatggtttttcaactggatgaaaatattggcagcgcatatatattggattgcaagcaggcaggattgataggactacacgtgcgaccaagagatgcatatgcacatttcagcgcactgtctagacaggagcaagaggggataacagtgagaaacctgtacaaggagtcgaggatgcttcagtccaaaaacaaccaaaccatgcatataccaacaaattgctcgcagatacatataacaagaactgctagtcctcgagcacatacccaattattatgtgtgcaacaaacagttcaaaggccttatctccttgtcattggcaagatggctaggtagctactactctctaggcaatagagcatcgatcctagctgccgttttctagggttttagctggggtgttgtgcattttttgggaggctacattacttgtagccatgtgccacaaggagcttggggctgaggatattcatgcacataatcacacatagtacatttttgggatatataggacggtgatgatgtgttcactaaccaattcaagtcatgtgtagcttgatattataactgataggcattgcttgtcctctccaactagccatgttcgaaatggttagccaccaagctcaactcctgtcgagacccgtttgttgctaggcaggcgctagcctctgagacctaagctgttcttggtcattgccattgagctaatcaaaatttgcctggattaaataaaaacataggcttcgtacgcaagattacttttaagtacttctatgatgcttcgtgcttttgcttacaatatgtatcacaacagagaaggaaccatttggcacttgaccaaaacccaggccgaggacggcattgggtgagaatgagtatgaataagcttataaaagcagcatgtttatctttgtaa

SEQ ID NO: 76161 - DNA, 17562 bp, Oryza sativa
ccctctctactatatcccaatctctccctccctctctctcttctcaccagcacggcggcggcgtgcgaggacgggagcaggcatagcttgctcgggcgctgccggcggcgcaagcggcgggcggccggcagcgggaggtggagttctcccgggcaaccagtggtggaggcggagcggaaggtgctcttcgacctcctccttatcgaccgacgacgcggtcgccgcgggtgggccggcgacgccaattcctctcctcggacgtccatgtccagaccacgccgccacgctcctactcgtcgtcgtaccgtaaaggcgacggctttgtgccggcgctcggcggccaatcgatctgttgtatgtacttcaaggctttggaggtggcgcggcgtggctcgacggcgcgccgccgtcgacgacaacgcgaggcgcgcgggtggaggcgggtggtggcgttcccgctcccctgcaccgcgccagcgctcaccatgtcggcgtagaggcggtcggcgatgacctggttggcggcgtcggaggtgtggtaggcgtcccagaacacgaacgccgtgcggtcgtcgcagagctgcgccgtcggcaggcacagcccgcccaccgtcgtgtccacgtcacaacacgacgtgtgcgatgttggattaagtcttgtgcttagcattttattttctgttagcttgcatgtgagtcacggtggtgaggtcaagtcagtacatggcaaagtgcaagaagacaagaagttcttcagtcctgaactcctgatcaaaagcaaggatgtgatttcctgccgcgaggaataggagtggagtcttgcatggcatctaaacgttgtgcatgctgcgagaagtggcgtaagactcgcttaccatggctgttagttaagcatgtgattagtttacttgcatgataactaacttgagcccgtacttctgcgggtgctcgatgagctccatgacgatggagtagcagtcggtgagggacatgctcgcgctggggagcttcgcgttgagccgctcgaggaggttcttggcggcggcgttgaactgtaccgcgtacgcgttcatgtcgtcctggcacccgcactcggtggcggtgacagcgaccgaggacgccgtggaggagggcgtcggcggcggcgacgcaggtgcaagcgtgtgtggccggcggccgcctccgtcccgccgccctccaccgccggcagcgcccgggcaagctctgcctgctcccgccctagctcgcacgactgccgctgtactggtaagaagagagagagagggagagattgggatagagtagagagagatagaggggtggagaacttataggtggggcccactatttttttaaaaaagaaatgctgactgaactgccacatggacccaaaaccactccggattgagtcggggggttatttatccggtttcaatagttaagggtgtaaaatatctggttttcgagttcgggggcgtaattcggtcgacctctatagttttggaggggggcaattcataatatgaacaatacagggaaaggatggggagcagccgaacaggtggtgctgttgtggctctaggaagtaggaacactggattgcatccagactgttgcacaagctgctctccgctctgacaatagacgtaaatatcattctcttctcttcactttgcatttcatcagaagaacatttgtatggatccaaatattcttactgaccaaaaactatgcacaatgaaagtgatgcatgatatgcacactgtgatttgccaaaccacaacctatgtgacagcaaaaaggtagaaggccctttccctcttcagtgaaattgcataattcttccatgtcaaaaaaaaattgcataattcaaccacttggaatgtataattgatttcgacatataaatattacctgtcactgccgaaatttgtgttgcagggcttcctgcattatcatttatccatccatcgaagtaaacagaggagaaatagattacagcgagtgtggcggtgcaggattttgctagagatctgcaggacactcaaaagcatcaacgtcgctcaactggcaactacaaatctaaaaggcaccattaagttgaacaacaaaatcgaaattaggactaatggggaatcataattgtcacttttagcggaattaggtctcaccagcagaatagaacccgtgcgcggctgggaggataccggcgccacaccctaggcatatggttgcggagtagctaaacctgccgaaggccgaaccagcaagacttgtggaggcagcggcgccggtggaaaggctggaacacagctgcgctgattgtggtggcgagaagtgatccttcatagtagccttgttgagtttttatagtcaatacatatcctccatctccatgacggttcgttgtggaatcaactcattgttcgagttttcaacgaccatcatgcctccctttttaggcactacttgaacagggctaacccattcactatatggcacgggatagataatcccggtatgtatgagttttaagacttcttttttgacgacctccctcatggcattacttagcctcctcctgaggttccctagatggtgtgcaagacaggtctaagggaatgcgatgagtgcaaagggttggactgatgcattttaagtcttggagggaatagccaaaaacaacatgatgcttttctaaaatagcaataagtcgggccgtctccctctcagagagtgtcacttataatgactagagactccgcatcgccatttagaaagtcataacgtaggcctgaacgtaagggctttagctcaattggggttcctgacggctgatccctttttgacagatcaatcgcttctccatattcatcctccccttcattgaattcttcaatggattcattgagtgtagactctaggggcatgaatggagaaaacgaccatcactttctcaattagctcgggaacaggaagaagctccatcaaagaattgattgatggtagcacagggacagaggtggcgattcttcctattttcaggttgagtacaccgatttcggacacatcaaagagtttctctatgggatggccaataagtatgtcgaaatcagatatgtcgaacacatggaaatctaagatggcctcaatgccgttatgccgcatatgcactccagagataatccctaaaccttcggtcgtagagtttgtggaaatttagaaggttttgatggttggttccaacggtctatcccctaagcaatcaaatgcaaaggttgtggatataatattagcaccaacagagggattatagcaagcacgaaccaaatttcctctagtgagacacgtaacggttgaggagaggcaaccgatcagaattgcttcagaagagagctctccttccctcgaccatttattactcatgatgttgatcaatctcttcaccatctctttaagcatagctttattgagaggttcatcagaattgaccttggttggtggtctcttcttgcaggaataattcgaggtgtttccataatcttcgaaaagatcctcctcgaactgaaattgtatttccggagaatgaatttcttcttcctccggttcttgcgactaggatgaggattcaacagaggttcctcatggatacgggacaacttcgcttgagctgaaagaattgttctctcatatcagatctaagagttatcttccttcggcggttgtcttgtgtgcgaacgatcttccggcggaaatatcgagatcttcagcagacgccttgtctaacccataccgaaaatattgtaacaacacatggtcgtgtaaagacaagtctgtgccatactgagttaacaatgaaaacctggtccaggttgcaccgagagattccttctcgttctgtcagaaagaaaggatgtctaatcgaagattaatcacacggattaatggaaagaaagtaaggcagaacttacacttaagcccctcccattcaccgtggaatttcttgactgaaagaatgtaccattgcttcgcttcatctctaaaagaaaaaggaaacaactttcactttaaagtttgtaggcatgaacgcactagctcaaagtcccgaagacagaggtatgggttttcactaataccaccatagaaggtttgctctcaaaccatggctataaaggcatgactgatttcgtagccatccgaaaggattggttttgaagaacagtacggctcacaaagatcaacccgaggagctgaaaggttttgaattgtgggttgctccatcaaggaaatgaatgaaagaagatgaaataaaaataaagatacaagaataacctagattcggataaattagcaaccgtccacagcaatggcgccataaatgcttgttggtatttcttacgaccatacataaatctgcaagcgcacggaataccgcggtaacactttaccttcgagtgaccagaaaaggatatcgaacttagggaacatgtgtatgctacctaaggagactatccaaggacaacaattattggtaggctacctaggctagagaggattttctatgcgttttaattatctaaactaagtaaaggtaatttttgttttgggcaccgacccctgttggtctgccaacgtgtttaaacacatgcataaagtattaaatataggctataaaataactaattgcacaaattgtgactaatttacgagatgaatcttttaagcctaattgctccatgatttgacaatgtggtgctacgttaagcatttgctaatgacgaattaattaggcttaataaatttatctcgcggtttatggatggattctgtaattagtttttttattagtacccgaacaccatatataatatccgatgtgacacgcccgaaactttatacctgtatatcaagcaccccctcggccatggaagtttttcaagatgtggcggtcaagatcgttctggttggagaggtgacgataccaccacgagcactcgctggcacccacccaccacacaacaccactcaccaccccacgcacgcgccttcactccgattactcaccgccggaacggcgaatggcaggtgagccgccaccaatggcggcacctcagccggcgcgtttaccctccctcaccggagctttcttttcatttcttcttttttttttttgtctgcagccccgcggcggccggcggcggcgaaggcgaggaatggaggaggggcggggaggacgagccggtggatggcggctgacgggagcaagcggtggggggagacgttcttcctgctctacacgcccttctggctcacgctctgcctcggcgtcgtcgtccccttcaagctctacgaggtagccacccatccatccatccgttctttccttctcttctcgctcgatacgtctgaatcttgggcgagtttggggacgccttgttggatcttccgcatccggttctttgaggggagatcggatctcggcgatttcaaaatggatattaggtcgggtgataaaaataatatatattttttgttgctatgtgcagaggttcacggagctggagtacctagttgttgggttggtgtccacagtgcctgccttcgtcatcccgctcttcctcgtaggcaaggtacttttggctccatctctcctcaaaatacatcgactctgaattgggatctaactgatgtgatcgtataattaactgttggttctttagaggtagggtaattagaggcttgctttattttcttttagttaaaagaacaatgttgggagagtagtgttttgctatattgttcatagaaatgactgattgacagtttgacacatattgtgggcaagacagaaaccagaattattagctatacgcacgtcgaccataaatggtcaaagtactttctgactttctggtgcttgacagttgacatagcagcagtgatccaatgacgtatacacatgagcctgtttgatgtattaatcgcaagaacaccaaaatttggagggtaaactattaaatactcctgggacagccacaggctggtaagttttagatggagggagagagtagtgggagctgagtgtaagagctgagaggatattggaaaggactgggatcatgtgcggtcctagttgtgattgtcttctcatggcttaaattggggctactgcttattttgtggtcacaactatgactgcacccaaatcaagtacgggagagacataatactagtttttgttgctttcccaactgaggaaggaatacctgttgtctggctaagtagtttagtgacaaatgagggaaattggctacatggcacctcaatttgatggtgttttctctgagacatgaaaattcctagctttgctaaaaacacaatattttctggttaagagctacttcctccatcccaaaatgtaagcattttagaggttggcacgtgtattaagagagtaggtgggaatgattgaaggaaggtcgtgattggtggagaagataaattaggtgaaggagaatggttgtgattggttgagaggaggtatgtggagaaatagcttcattttgggacaaggtacggtgctagaaatagctatattttgggagggaggtagtagatggcacctgggaggtggggacattaaaatattctcatgtacttctgtaccagcaccagaccatttctaccatgatcctctcatactgttctttggcttacaaagtgtattcttttgttaaacttcgtccatgaaattgtatttcttatcttgaattcagtaaccatgacttagaagctaattttgctaatgttttaatttttcaggcagatagtgttagaagtttgaaagatcggtattgggttaaggtaagtgttttatacgatcttctgaaagacaaactgagttctaaaagaaaatgtagcgaaagaaggccaaagctgtatcttttcaataaatttgatcctgtaacgtgttttcgctacagcttataaactttactttattgagtaaacactttcattttctcaggcaaaatttactgtggaaagaatagctgatacattgaaatatcatcaatttggttacatttgatcttggtgaaataacactattaactaccttatatggttgttttactacgctactgtacaaaaacatttactactgttgtaaattatttactgctacagttatacttaattttgtacacctgctaatacaattaaatacaacagtacttctcagttgtgtatgggcaaattggtagcaaaaatcatattctctttactttatctctttgaacagttttgctaaatctcacatctttctgttgcaggctaatatttggattataattttcagctatgttggtaattacttttggacgcattacttcttcacagttcttggtgcatcatacactttcccatcatggaggatgaacaacgtaagactgtcctcatgttattgttgaccaaatgggatgcatgcaaacgataatctgcacaactgctagcattgcaatatgcgctgatgttttcaaacacggattcaacagtatttctgttcttttttttttcttgcaactcttccatgcaactgtcatggacattcagccaggggggcgagcccacccaacaccctctcggtactgtagcgcggtactgtatcagtctgttaggtggtattagattgagtcctttcttaggggttaagtcgtcccatctaaggatggattgtatccctttaccattaagtaataaatcagattagtttaatccaatacctctcaatgcccttcccaacctaaatctacctctcacccctagtagccgctgctgcccggctatcctcccagcggtgtttatcccataatggccttgggtcgtgaaaacaaattttaaaaagtaacttctatacaaacaccggccactgtaatgcattggactatgatctgaaagtttacctaatggcacttaggctgtgttcttttggaggggttgggaacccctcctctccacatgcaaaacggagcgatagattaacgcattattaattaagtattaagtataaaaaacttgaaaaatggattaatatgattttttaaagcaactttcctatagaaactttttgcaaaacaccaccgtttagcagtttgaaaagcgtgcgcacggaaaacgagggagatgggttgagaactcagggcaaagaacacagcctaaggctgtgtttgggaggaggggttaggaaaaaatggattaatatgatttttcaaaacaactttcatatagaaattttttacataaatcaccgtttagcggtttgaaaagcatgcgcgcggaaaacgagagaggtgggttgggaaaatggggggaagaaatgcatatgctcacaaaaatgaaatgcatatgctccttttaatggctgaaccatatggctcacttgaacattgcctacaacaaaatttccttttgttgaagctcggtcagtgttactgttgacttttatctgtcataaccttctagaattttattaatttattatgttagggacttctgtatgtaaaagagggctgccattatctatcaatgcgaacaagatataaatcaattaatcctctctatctttcctatgctcctgtttctttcatatatgttcctctatcatgtgcccagtcatttccttctacctctcaaacattctgctaataatctcaaaaaacttgtaccatactgttgtttctcctctcagctatttgcttgtatcctctgttatttgtcgcagaagtacagaacaagaatatgggaaagtcctgtctccactctccactgccgttttgatttggagatgatttgaccatgcattttgatagataatggaagaaaattttgacttgacatttgcttgctttcttatctttcgttagtttccatttagtgttgcaacttgcaagtaatgatggggtctgagaatttcacatgtactagtgctctttaagaatgttttagttaccttcagattaaagattgtttttattattttttttaaatgctatgcttaagaacacttcatacattccctcctgttctcctatattaaaatctgaggtcactacaagccaaaatagattctattctgcaactgtttcgtgaaggatattgctcatagtgtaaatatggaaaagtggccaatagttcaagtccattcacttttactagtgattgctgtgtactacattacttgcaagttgaactaacaaatgtgttcttgtttctttgttcttattgcttgttaaatttctttcatgtttcaggtaccccatacaacatttctcctgacccacgcttgctttcttttctatcacatgacatcaaatatgagccttcgcaaattacatcattctacagctcatttgccccagtttcttcgatggtcatttgaagctgcatgggttttagcactctcatacttcatagcttacctggaaaccttagccattgcaaatgtatgttctctcttgcatagagtattaataatacacagatttcttctgcctagtgctatttaattatcatgttctttcaatttccatttagtggtacggacgtagggttcagtaaatctgtgttctgttttatgaaatgaactactctgttggatccaatttactacattacgtatagcttgctgtgaattgcacaacagaaaatctgtggtaatgccttccagtcaggtcagataccattagacagaccctctgggtacactacttttgaacactgggagaaggttttctacaatctgtaattgtgattgttttctacaaatctgttgttgtgaatattggaccaattattcttgagatgatactagcaaacttatgtgctcactcttgctgttctagggtcaatatttaatgcgtactatattttcttttggtcaaagtggccaagttacataggatggagaagtgttttacaatgtcctattatgataacatatgatagtgaagttgttcccaccttttttactttgtttttcacaatactattatttccctttgtgcctgatgttttctgtgacctttgcagtttccgtattatgaattcatcgacagggatataatgtacaaagtaggctcactgttttatgcaatatacttcatcgtcagcttcccaatgttttcaaggtgaaattagtcagaattatcgttatagttatttactcctatttcaatgttggctattcatctgtttggtttgaaatatgtttgtttccctgtttctgttatgcagttaaacatcaagttgtctagctgtaatggttaatagctttgtcaaattccttactccaataccatctatttacaccaactgggtacatggccactaagtgaataaaattctagaataatgcattagcacacttgtcccttgaaacaaatcatctatcaagagcatagctacagccatgcacccatatccatactgtaatcaccatgaatagacctgcacagcatgaattctgctgctgttatgacactggatagttctgaatatgtccgtagctttgtataactacatgtgattttccattcaggatcgatgaaaatgaagagaagtggagcctttccagagtggccgtcgacgccttgggtgcagctatgcttgtaacaataatcctcgacctgtggcgcatattcttggggccaattgtacccatccctgaatcaagacgctgcggtcaaccggggcttgcatggttccaggtgcagaacgagagcgtctaacccagcaatgccgcgaattcgacagcaaaccatcatcagctacgcctaccattctccagccagtcctcccctctactggaagttctagtgtggcgtcagcatgtgcgcctcttgctgtcagcttgatttgtttcttgtatgcgatgtcccatgggtaacaactagtaaggatgctgatatggttttcttgatctagaatactaggatttatgagccgacagccggacagatactccaataagctataacaataaagattctttgatgtgatcagaagttgagttgtgttggatttgctatgttcgttgcgccctgttttagggagtttccagtagctgtacatactcccaaaattcatcctaactagtgtttgaagtcacattcgtgtgactatgaccatcctactataaatggtgcaagaaaatctatcaataatattatattattcaacgatatatgagaaaaggaatataaaatatttcatatatagaaatattttttgcgcgtttgctacacagatgagagtgttttgtcgtgccctttttttttctttatgttgatcatcataattacaaacttgaaaaataaaattattcttagaacacaaacttgaaaattcagcttttctcttgcagctctagaggattaaggaattgaagaacggaatcgatagatagatagatctatctgcagcttttccttgaaatctctatatacggtttcggggatggaaatgaggcagatgattgggccacgtggcttattgagaatttaggttagctcatttgaaaatcagccacgtgtccctatgcaatctctgattctgctatgattatgctacatcattaatcgtgcattttaccgtgcaatctacagtgaactttcagataaatatattttagttaggtagaaaaaaatctgagctaaactataaaacaccagcatgcagttgtagattatagaggcttctggaaaatcttttttccttcatcatcaaaataaaaaaaaaggcaagagattccagaggttacaaaagaaaattggatctgtccctttgcaaccaaagaaattccttctccttcgattatgaaaaataagaaaataataaggatcaaagagggaaaagtagaaagaaaaatgccgtaagctacttcacctactcggcacaatagccatcttctgcttcctggtggttgttactctgtagccacgtggacgagccatttgagctcgtctcaacgccgtatcccacagtcacataagagctcaatcgtcgctgcagtaggatatcatatactcatagctccattcggaccttttacgacagataaatcgaagctctagccattgccactgaatagagttgattggtaaccgacagactggagagcatcagcgcatgcggttgctggagtcgacaccaggggacagtgagccctgctggagagaaacgagaagtcaatagcatagcgagggatggaagagaagagaatgccaaaaatatctcaagacagagagcgaacgagagaaataggatggagagagagagacgagcggagggtacggtgaaacctgatatgccgatgaagaggaccagatttaccgcgggagagagagtcaaccttcttgataactttgcatttacacccctagaaatactaattattatatgatctactgaataaaaatattcacaaaagtaccactagattgatcatttcaacaatcaaatgttttacgataatagaccttgggaggcttggatttctaagactggtgatgaccggagcctgtacagcctggttgtctaacgcctgtaaattggggagccagcattgtacgttgggatatcagttttatttacctcgcacagagcccatcccaaattggagtaattttgaatttgttaaatattttctgtaatgtggtaaatttcttaaatcttataaattctaaaatcttatgtatcttccaataatagttttatatttgcaattttgtaaattaaaacggaagttgaataaggtgaaaagtattaggccacgtttggttgtttgccagctagacaaactagattgctaaagttgccgatcttgctttaccaagctgtttaggctccgttctatacagagtctaggatgaagattaagtgcgcatgtgaaacgagataaatcattagcttatgattaattaagttttaatcatttaaaacttaaaaaatagatctatttgatattttaaagcaacttatatataaattgtttcgtacgaaatacatcgtttagcaattcgaaaaacgtgctaatggaaaacaagttaaaatctgcatcttaattattagttgtttagttttttgactggcagttcctgcaaagaaacgtttgtggttaaaggaaatccaatttggctctccaccacgatagctttttctcacccgtttgagctatcttgtctcaaaagttataattactttatggttccgaacggtgggcctcgccaggtcaggctaggcttaagctagccttagatccaaacatacccttagtgtttcttttttttttttttgccatacaacaattttgcaaactctaaatattataccaccaacatttcattcatccttgatcgctatttgtttaaaagaaaatataaatattaataccaacatttcattcatccttgatcgctatttgtttaaaagaaaatataaatattaaagaacatgatgtaccatcgaaatactttgcacgataaatatatcaatacttatcaaaacatcattaaaaatgattacttctcaaatagaaaatctcactggctaaaaaaataagtaaaagctaacgaataaagcttcggtccttttgaatttatatcttttgttttaaatataaactaaataattctatagaaaacccaataatatttatatgctatagaggagcaatgaatatcaatcttctgggcgcgtccattttctagtaggtagcgaattcagggtgctttggcatgatattgcgctcagatcgctgcaaaaggtcatcaatcttctgctgcactgtccagtacaatccatagtcttcggcaagggccttggctggaggagagtctccatctcctgtagtcatggtgggagtagcagcggaggaggtaggggttgtttccatgggaaaggcagcggcggcaccacgggaaagcacaagccctaatggatcacctctctttgcaattaaaaagtagaggcagaggatgaagtcggacaatgtgcaactatttaaaagtaaattttgtaaaaccgagttattgtagttcaagttacaacatcatcaggtatgaaaaaaaaatggtgtgtaaactttatatttgcatataaattttaaaaaatatactatatcacatttggaccatgaacacatgttaacagaccaagccctaaaaaaaaaggaaaagaggaaacggactaaacccatgaagaaaaagggccacgtgtttatttagctgaaaatagaaattattaccacatagaccgaaagagatccaaccaccttagccgaaagaggaatgggtagatctgaccacgcggattgggtcacgcacgaccgtgcacccattagaattttcggttcccttcccatgcgaacttctcgggatcgcctgccatctgcccccacacaatcgctcccctcccacatgaacttccagggataagcagaatgtgcgccctgcgcacaggaaattctagggattagcggaatgggaaccttgtcatcctgattgaggttctagattggagatatcctgttagagatatagttttgtatctcttgccgtttttctctaattccctcccgattttgtttttataagttgattgtaaagataacgaagtaccatgtcgatatgtactcgtggtccgtaattaatcgagttgtcgcgttgactcaattacgctttcatgctatctgatgttttcctagcttccgcctaaaaccctagccgcgcattgcccctctctctctctctctctctctgcgtgtcacctctccctcaccacacacatgtccagcctccccttctcctccaccgaggccattgataccacgtcttctatcgtcgccgatgcagttcacgcacgccttacaatctactgttgatttcgacgttaagtccaccttagcgacccacgctgccgactctgcggcaactatcctatttcttgccagttttccctgattctctcatggttctatttctataagtcgattatagagataatgaagtgttctgcctatctgtactcgtggtccacacttaatcgaattatcacattgactcagttacgctttcatggtatcaaatgtttttcctagcttctgcctaaaaccctagccgtccgccgcttctctccaccatgtgccatatccaacctctccctctccctctccccccacaaatgtcgttgacacctcatcttagggcatatacaaaggtagaatctaatatgagctctctatattaattaatgtcactagagattatcctcgtataatagtagagacaataagatttctaaaccattaatgcactaaataatttttttttgttatacttctttccttttctccaccctcatgcaacaaattttccgttaataaatgctaagagtagactctgaaccgttgtcatgcgtagcaacgatgtttctcctttcttccctctctttcttccacgtcaccaaatttacttgcatgacaatgaagagagcccgttattaaacaccagtatttgcatgcccttatgttgtcacccatgcagttcgcgcggccttccaatctaccgtcgattccaaggccgagtctacctcagcgacccacggcaccgactctgtggctaccacggtgtgtaccgcgaccaacggtgagggcctctcctatggcgcgccatcttcttacgtctcgccgccgccactcagcttcggccccaatgatctaaattttttttgagaaaaactatgggacggtgtaccgtctcaacggtatagtttataatttatacttaccaatcactcaccgattctttttctctctgaaagcgtgtcgtgtgttgtcctttcacattaaggctgctgactagtgacgactgacgagagttctcttttctcctagagtacaaaacagctatgaaatactctagtacagcactatttctacacctctttaggtccatatgggtctaacacctccttcaactagcaaagttagaattaagcactagagctagtagcatgagcctaaacaaagcatgttagcggcacgtgagcaagtttggttgtacggcatggtccatctttttatttgattgttgaatagaagtatataacccataaatatcagaattagtggtatcacatctgaagtctcgtgccatcacaccctatatttggtatcagatccgctactaagatgtatcaacccggtatctaggtattggatccggtactcaggtatcaaacccaacctaggtatcgaatccgttacttataggtatcagacccaatacctacgtattagacttagtattcataggtatcatactcggtacctgggtatccgacccagtacatacaggtatcggaactgatactcataggtattagatcagacacccgatacccgggtatccaatccaatactcataggtatcatacgcgataccggattcggtactcataggtatcaaacctgacctaggtatcaaatccaatactcataggtatcagacccgatacttaggtatcagacttggtattcataagtatcatactcggtacctgggtatccgacccgttacgcacaggtactggaataaatactcataggtatcagataagatacccgatacccaggtatccgatcggtactcataggtatcagacgcgatacctagttatcggatccagtacttataggtatcagagccgatagctcggcatcagatcttgtatttataggtttcatacttggtacctaggtatttgacccagtacatggatatcagatatgataatctagcatctatgtatcacatactagagtttctaagatgtggtataaccaagagcccaacatgacatatctaattagaatccattgtatccatatataatctaggtaattatttgtctggtctaatccgtgcatggcataggacacatgcaaatagatgcaaccaatcttaaacacatagctaggctactgtaacaccctgaaaattcggccaataaaaacaaaaccctaaaaataaggattttcaaaaactttttcaataaattgcatcatgccaactttattcgcctatttcattggattttgaattcggagtttgttgatcgcaaataaagaataaataattaggaataaaccctaaaaatcaagttggctaaataaataattaaaatataaattaaaataaagattaggtgaggttagaaataaataaaatattatcacgaccatattagcaataattaaattttagtacgatggaataagaattaaccctaattaaaaattcaaataaattatataaataaaatacgagtagtattaatttagggtgaatttttagttagaataacacaaatatggagtaaacttcatttatgcaaaaattagaatctatagggctatatttaaatagaaaatgggctaaaatcgggataaataggaaaagtcactgtacattacggcataggtgttcgatgtggtaccctagccct

SEQ ID NO: 76162 - DNA, 2389 bp, Oryza sativa
tcagctcaattcgagcccagcgatgcttcaaagacaaaaaaaaaacaaaaaatctaacaaaaaagagactagtacaaataagaggaacaagttcatacataagagaatcaaacattcacatcagagaatcaacaagtttgaggaggaggaggagccccagacggtccaccgtggcaacgtcatagaggagcaggagcagctcaatgagcagcggcggcatgggggcgaggacggcgatggcgccgtggcgcaggagacgtggttgacgttgaccgacgccagcattcctcccgctcccctacccgatgaggtcgacggcgccgcagggtgcccctgcgtcggaccaaccttgtcggtgccacgcttctccttccaagagcacggcggcagtggtagagaagcgaggatggcaatgtctccgtggtgcgggaggcgtgattgacagtgacaagcgccggcactccccccgctcccccacccaatgaggatgatgacgtcacgaggtgcccctacgctggctcggccccatcagtgccgcgctaccccttctgactccgttagccctgaaggcagaggggaggtggtggcatggtgagtcacggctggttatttggggaggagacaagatgagaagggaggagaggtaagggaggtggtggcttggggaagaggaaggaaagggagaggagcacgaattggatgagaaaggataagaaggaagcataaagagaataagaaggaagcgaagagaccgaggagataaggatgagaggacgggagataggtgttggttgtattgaaaaccgacacttctacctcgtatgaaagtgccattttttaataggaatcgacacctatttgaatagcaatgtcctagcttttgccgctggcacccccgcgggagcccgtgtgggtgagaaaagcattataaatgtcagttttagctattctaacacctatatatagtgttgtctcctttttttagcagtgaacatttgcttcggtgcatatcaatagccggaggcgaagaagtggtgaaggaaatccaccaaggattgtgtggagcccatcaggcagcaaggaccgtagcatccgaagagtttcggcaagtgtatattggtcaaccgtactcaaagtatgcattgaccagatcaaaaggtgcgaaagctgtcagcgacatggctgaagccagtcagcccctcagtatgaattatggcccattgcacctgtctagtcgtttgcaaggtgggggcatgacatcattggcccgttccctatggcgcgaaatggctaccggttcgccattgttgctattgagtacttctctcggtggttagaagctgaaccactccatactatcacttcggcagcagtccagaaattcttgcgaaaaaccattgtctgtcggtttagtgtgctgaaagagttcatcaccgacaatggcaagtagttcaactctaatgaattcagagagatgtgcgaggggctaaatttggagatcaggttcgcctcggttgtgttggtatttcttacgatcacagatgaaatccacaagcgcatagatataccgctgtagcacttcccctatagagtattccaagtttggtcagatctttctccggttcatcctaacacgatacttcaggcactggcaaccacactaaagcaaccactataaataaatggactatagtgaacaatgatcccgtatgctatttaggaactaaccaagagataactctcactagacaaatctaaattactaaggaagaatattatattgaattcagagtaataaacagaataacagaaatgagagaagattaacgacaactccagaattcttccgacttcttctactctactctcttcctattctagtatacaatatagtacaacagagcctcttataattcatctcaagcttggaagtgtgcattgaagtgagtaaagtgaggtctttatatagaggtaggtatgacggttagcgaagaggaaatgtccgaactaccccgcaaccgccatcaaggagtgatctggagcgtccacgccaaaacctgggatcaacagtgggggttcggccgaacctgggctgggcccccctagcctggcctttggcctggctcctatcctggtcctcccctatccaatcctcagtgttttaggctgattttctagtattttgatgaagttcacaacccatccttgtatggatacatatttgtcctcactttagtctagatttcctcccaacctcagtgtttatcacctgcatacaaatatacaccaacacttgtagaatatgtgagattaagcacctatcactatgttggatgttttattatctgaaatttatgcagatgttggcagtatagaattggtatttaac

SEQ ID NO: 76163 - DNA, 1734 bp, Oryza sativa
atttttatgaattttcgcaaaccagctcttttcctcatattgactttctctcttatttctcaaggatgaatattttatttttggatcctcaccaagacaaaatgtgctagaatttatccctactctaaggctgatatgggagttccgtagggacaaactgtgacatacctgcatcatatatattgcaaagccaaaaatacggactcaagaagatcatcagccatactcctagatcaagggtctttatttgtggtagaaaatagaaaagtaaaatattttgtggaatagtggaataaagaaatgattctccttttttcatgtactttctctccattttgttttcttggcatgaatatggaaggggcatggctatattttcttttcatcatgctcaatgttttgagagcaagctttatttcctcttttttttttcttttccatagccatgcctttccctccttttctcatttttttttgctaagacctttttttttcttctaacagaagaaagcatagtctaatgtaggagtttatttgaatggaattttagtgggaagccaacttccagtgtaaaatcttagcttaattatatatgtggaaatggaaatgaccccttgatcatgagagtatgaaagatatctagcacgagtcacacaaatttgttaaagcttaacataatgtcaagcagtcatacgcataataaggtttatcaaagatatacttgcatacgaccttggtaggaataaagaatgaagtcaattggaggaatgagcttttaaaacaattttattttgaaaacaaattcccaagagtcataacaaaagttgcaagaattcctttcatctttaatcatctctcatatagcaaatacttagatgtataagggtccctaaacatggatggttgttcataagcacaggttcagctgagaataaagaatatacaagatcaaccatatgaaaaatttcattagttggaaattttatcttatacttatgcttgaaccaattgtttcctgaattttcaactctagtactataccatggtggagatatacaaataatggacgtgctcgcctgcttacctgtgaaaattgagaaggattggggccagctttggttcggccgaaccactctggcgcctgatccctcagcaactttctgcagtgtatagtgcttccaggtgttcagacctttcatcagttttcagagtatgtgcacgtcagaagctgggatatctcccccacacttattcaacacctgaactttattaaacctaaaacaaaaaaaaaaactttggcaaacattggggttaacaccaatgagccacattatttatagcaagtgcttacatgattggaaaaaaaaaactaagcacctactactttattcatgggagaggagacatctattttgcataatctctattctccttacccatttctacaaatggatgcttgattttagcgcacaaaccgcgactaagggtatcaacattattcctaagctcagcgagttctacccgtagctccgcgttgcggtccctaaactcaatattctccttgtggagcttcttcacttatgatgctagcttatgaaccgagggctccggcgactttacttcttcctcttgaaattggccggccccccttacaattggaggggggcgtcaaatgacgcttcaccttcataagtggagggctacgggattccgctgccccctccttctccgatg

SEQ ID NO: 76164 - DNA, 8523 bp, Oryza sativa
attaaaatgtgattattactaatgttaacaatactatatgaaaacaattttgtgttaaaggaaacataccattaaatatacaatggggttatttcattttggtaaacttaattttttttgtttttcaaaaattcagtaatcctaaattcgtaactgataggaactaataaacatgaactttgtatccatagtggctatccattatgtaattaatttaatactgaaattaataattagcaggttacaaaaataaaatttggaatcaagaaattataaagaaataccacatattcagcatgggaaaaaatatttatgaaaggtattaacaaatttacgccgtgcgttgcacgggttggtggctagtctagctagtgatgtataaaatgagtattttagttaactaatctaaccttagttcataggcttaaggtctttattatcatggttcatattttataaactaggggagctctagtccatgctagcaatttattatatcaacctagaaattattatataagataagtgccttaagttttggtggatgaggatggaactatgcattcactggtctaacaagttttatttgggtttcattatagctagagcgtatttctatatacatttatatatatacatattgctcaatcgatactatgtgattagcacctatcctataaatttaaactttagagctataacctgtacagaaggttccatattttattttactatgttgaagcccactgtttgctggttctatagatatttggttcacttcatttagactaaagatgaattttctacaaattttacaatttaaggttgctctatgatggttattacttacataagtatttagaggcttttatcatacagtaagtatataattttattttataacttggaagtatatgttttggtgattctacagaacttgggtttactcaaaaaggatctaagatgaattttatatgaacttctaaaattcagctcatctaaaactagtcatttaaaggtaatagttttagaggcatttgatgtatagtatgtatactatttcattttgctttataggagaacataagttggtggatctgtagaaactgagtttgctccaaaatgagttgagatgtactttatatgcattttataagtttgtgtatgctttatgtatgatttatcttagacccattttagagacaaggtctgtgctgagggtgccaagcttaatgttaccacattaaagttcatagttttgtgaacctacagaaatttgaatcatctcaaaataagttatatttgattttatatggattttacaagtttaggtgttttgctgttaaaaagtaaaggcttttagtattatcttttacattttcagattttaaactcatggggtccacctgtcggtctcaggccaatatgcgaaaaggcccctaggatttcaggaaatcaaaccgcagtcctatgactgttctgtgtgtcttgagcttttgcagaaaggaccctatattaatctaaattctcgtgaggaggtccctcgttcgagctgaagcagatcaagccatggctgagctcgatctcaagcttgccagcggcaaacggtggctcgtttgagggtgcgaccaaaagacaaaatgaagatcatgctattccgattccattcctctacttttctcggtcagtggacatcggagtgacgccggcggcgagtccgagcggcggctgtgcttaggctgctactgcatgttgagttggtgctcgattctaagtgaatgaaatgcatgaatgcaatcctatgggctcaagggtgctcaccgaaccttgaacgaggcgcgggaaagtctggacagcggcagcggtgaagaagatggtccggcgatggtgtagagctccgggaagacggcaacggctcgatccactcatcgaattgacatgcatgtgttttcatggggttagtgaggtcccagggatggtgtatacgcgaagaatcggacaatggctcaccggaggaggcggaatcgacaatggcgacggcgaccggaggtgaagaagacggtagccgatctccgcacttgctgcgccattgcctaggatttttgagggtttttgaggaagacttcaaggagaagacgttggcgcgacggctcggcttggtttggtctacagtggtcggaacgacgacgatgtcggctgcggcggcgcttggagcgcgctccggagtgccgggggcacgacggcgttcccgtcgatccgctgcacgatagaggatgaaattaaaaggataaatcctcggcatggtgaggagagtagagtacaatagtcgtcttcttcgcggccggcggcaaggatgagggcgacggagaagttgagagcctcctccctcggtttcttcggcttagaggtggagaatgatgtgtggagatgcagctgggaggaggagaaggctagaataggagtttgatggcgtcgacacgttgtggctacgcgtcgtacacagccggcaccaatctctctctctcggctgtctctggtcggctggaagatttgcacagggtgaggacgagccagagtggctgccaagtgggtccaggtcgtggcaaactaagctagggtgagagggttgggcagaaacgtgggtgaagaaaacgtttgaatgattttcaggattatttctctctcccactttagtaattcaattatttaatttgtgggtagaataatttagtgtggatttttctgaaggtatatgaagatacctagattccgtattctttagttgcactcaaaaattatggatagattactcacagaaattagaggaatatgggttctttggaaaatatttcgaatttttaggagacctaaacagagaagataaattctggaaaaattatttttattcatgataaattacctagtattttaataaattattttacttatacacttttatgcagttaaatgcaattttagacaaagtatggttttagccgattaagaactacaggtaatctagtttttattagtttgactgatttatttgaggtaccaaatttagttattaaattataccaaaattacagtgagttgtatgtgttgagtagagcctacatgaattttctcatgattttatcttgcacgaattattttagataattcgcaagacttatgtcttatatgtgtttccctttcctaaatgcatgtaaatgtttataaaagttatatttggactcttattaacctgaggtgatattgatatgttagaattacaatttaccttacacatgtcataagctccttacctatttatgcataaatttactttagcattaaattaagagaatgcttatagagatgattaagatagaatataccctatatgatataatttatttgttcactttcatgttcatgacatgtcttcagatggatgtccaaattagttttgtgaggcttgacattagccatgttgatatatttcaaggtgtatggtttctatttttgtgaaatcattatcatgattaatatttgtgatgaacaattggctatgcaaatgatttagttaaagaattggtttgagagtttgtgtgaatgttggtgtgagtacgtgtgactaatgtgggtcaggttgtgatatctgtgtccagaaacggttgttttgtctgattgtgtgcaggtgacttgagatcagccttggtcaatggtgaggaccgggactatgttcagggaggaacagaggtctattgcggtcgggataccacgtgagaaggtgactagagtctggattcttgaaggtcaacttcggtcaacggtggggatcgggacgagactcagggaggagttgaggtccagacggtcaaggataccgggtgacgaagttggatacgaaatggcatacggtggatggacaccgtgtgggagagatcttcgcaacgggcttcacgaggtgtgcgtgcaagcgtcggtgttcgcgaagggaattggaagaggtttatgtatggtgctacagtacggtggtgtactgtagcgtgcatatgtgtatgcgtgcttgtgtacagcatgcatatatgtgtggtatacgtgcaggtatgcatgcatgtacggtgctgtacatgtatgtgtgtgatcgatacatgcatgtgaagcatgtatgtgtgcatgattggttggccgagcagcaggagagcggctcggtggctgtggcttgttggagccggcccaggccgtgcggcgcgaggagaccgagtgcgagctggcgaaggatcggtaaaggaatccgatccggagcaggattttccatggccggtgcggctgtggtttcggagaaaaaggaaattgagagattgagtcctactgtgaagaggagtcctacgtctactttgattaggagggtttttcatgtataaatagagggggagcgtgaggattcctggtatcgcttttcggtatcgcttttcagagcgtggagttgatagtttagttagggtttcgagtttagtcgagatttttgtaaggagtgctgttgttgcactttgtaaacacagagataagcaataaagttgtcatctactttgagagttcttcgatttgtgtttcatcgggttcggcggtctaccagtgacataccaacggttcaacaggcgacaagacagcggttcgaccggcggcgtgcaagcggttcgactggcggcgtgcgagcggtccgaccggcggcggcgacaggattacgtcgagatttccatcgatttgagggtaacttttatttccgttaaaggtttttgggttttttgttttccctaccattcacccccctcttgtaggcttggtttcttgtgttcgatcctaaaagtggtatcagagccttgttttcttctttggattttaaccgatctagagtttttgccatggctactcccgctaggttttcaactaagcctcatgttttcgatggaacggatttttctcattggtatagtaggatgcaatcttacattatggctgaagattatgatatttggagaaaagtttctcatgcttatgtgattcctgaaactattaatactgctgctgaaaaaactgcttttgaacaaaattgcaaagctcgcaaaattcttttgagtggtatttctcgttctgattatgatcatgttgctcatcttcaaactgctcatgagatttggattgctttgagtaattttcatcagggaacaaataacattaaagaacttcatcgtgatcttttcaaaatatattaaatttgagatgaaacctgaagaagctttggatgattatctttctcggtttaataaaatttttagtgatcttagatctgttgattcttcttatgatgcaaattatccacaatctgagatttctcgtcactttttgaatggtctcgatatgtctatttgggagatgaaagttacatctattcaggagtctgtgaacatgtcttctttgactttggattcgctttacacaaaactgaaaactcatgagatgaatattctttctcgtaaaggtgattctaagtctagtgctttggtttcgtcttcaacttttttggatgttggtgcttcttcatcgaagccttctgttcttgctttatttaatgccatatccgatgatcaactcgaacagttcgaggaggaggatttggttttgctatctaacagattttctcgagctatgaaaaatgttaggaacaggaaaagaggagaactgaatcgttgttttgagtgtggagcacttgatcatcttcgttcgcattgtcctaagcttgggagaggaaagaaggaagatgatggaagagtcaaagaggatgacgtgaacaagaagaagaacatgaaggagaaggagaagaagaagcattgtatgcagtggttagttcaggaactcataaaagttattgatggatctgaagatgaagatgagggcaaaggtaagcaagttgttgatctagcttttattgctcgtaatgcaagttctgatgttgatgaatctgatgatgataatgaagaaaagcttagttatgatcaattagaatatgctgcttataagtttgctaagaaacttcaaacatgttctattgagcttgatgagaaggatcacactattgatattctaaatgctgaaattgctagattaaaatctttgattcataatgatgataattgtcaatcttgtgaagttttattttctgaaattaatgctttgcgagatgtcaattctgttaattgcaagaaattggaatttgagattgaaaaatctaaaaagttggagtcttcttttgctcttggatttgctttacatgctcgtgttgttgatgagttgattttgacaaagaatgttttgaaaaaatacaaagttgctttttgtgcaagttctttagtcaatgcttcatgtgtaaataaggcaacacaaaacaatggtgttttgatttctcaagattgttcaaagtgtgttttgaatgagttgaagttgaaagatgctttagagcgtgttaaacacatggaagaaattgttaaacaagatgaggtgttttcttgttcaacttgtagaaaataaaaagatcttttggatgcttgcaaaaattgtgctattcttactcaggaggtttcttatttgaaaagttctttgcaaagattttccgatggtaaaaagactctcaacatgattcttgatcaatctaaaattagcacacacaatcgtggtttaggttttgattcttatgctcatcatactagacatcctcctactgttttgggtgcttctaggagaggtgaaattttgattgaaactgagcctaagaacactgtgtttaaatctgttggcatcatgtcttctttgaatgcatcttcttcgaaatcaaatggtgtgaatgcaaaaccttctgttgatgcaaaaccatcaatttcaaaatcatctacttcacaaacttgtcgtgagaagtatacttgctctttttgtgaaaaagatggacatttggttggtttttgtttttgacttgcccgcaaacagaaaaaggaaagagaaattgcttttgcgaaacaacggtggcaaaaatcgggtttttgttcaaggagcacggttagaccgcagctaaaccggctgccaggcccggttagaccgcagggacagcggcggtcagaccggccccggggcaattttgcacgtaattcaaatcggacttttgtgaagcgacaaggtaagttttcaggtaagtctggttctgattttgttagtgcatatagtgcatatgtacctactggttctagtggtcgtgtgactcagtgttggattccaaaatttcttatttctaaccccaacacggaggcctcgacatcttcgttcgtaggtattttggtggcatactccccatgtgcattcaacgttgagattgcttttcatggtaacatcaatttacttttggattgacatattttttggttctactctctcgattattagcttttcatatgctagtgtttgaggtagtagtttttcttaatacaagtggatatatgtcgattcatgataaccttggtgatatcattggcaattggatgtctttctcgaaatctttaatttcttcttgatttttcttcggggagaattggaggttaatttgagggggagtttgtgctttttcatgcattcatgtttatttttatgcatttgctctaattctgaaaattaataaaaataagaaaaagaagagctttgttttatacctctagtatattcttgtgcatgctagcaaaataattgaggtctatttgttgctatgttagcttgtatgcattttaatctttatatgaagcttagatattgcttttaagtgagatgatgcatgacactaaatcttttacttgaattacgaaaatatgcaatattgatgctagcatatggtttgatttataaatgctttatatatatgcattattgaattgttattactcaaatagctttaaatgctcattgtgaaaagagaataaaaaatatgaaaacaatgaataccgaatccttggaaacagtcttgacgacaaggacgtattcgatgtgagcaaaataatgggtgccgaatccctggaaacagtcttgacgacagggacgtacccggaataaaagagaaaattatgagcaaaaaggctcaagaaaaagtaaaaattctcttggttgctttgtgctaaagctaatttgagaaagagtgataaatgcaataggtatatatgtatagtgtttatttttcaatctatgtgcttgtgaatatattgcattataaatcatttgaaatcatgaatcattattgctgatttaagcttaattgtaatatctttgattcatgtttatactatggtgcatgcttactaactagttgatgaatttatctcccatatctccaaaacatgatcttgaattgcttttggtacatttcaaagctctcgaaaaaaaagagaaaatataaaataaaaaatggttattccaagtggcaatcatgacataactgcatttgtg

SEQ ID NO: 76165 - DNA, 658 bp, Oryza sativa
gttttatttataaaatatgtcgttaggttttatccacttggcttatcgtacagtcgagatggctatgataccagcttgtcgcgacagggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaaataaacagcagcggactagcgagcctacggctccatcttcacaggcgctcaactggggtataagccaggactccacctaagacttcttctccaaagcttctcttactgaagaggggaaggattgagcaagaatgagtacaaccacagtactcagcaagccacaccggagatgcacaattaatgcaaaggagtacaaggggataataacataggggttatgttttgcagtaaacagcatttaaaagtcacttagttgcccaaagccattttgtaaggacgatcctagagctacacaatgttattaaacaaggccgtgaaccctcacgaacctgccttaacccaaggcctacgatgattcagaccgaattgtcaacccgaccctgggtcccagctcgtcccaagccaacccaggccaacca

SEQ ID NO: 76166 - DNA, 36549 bp, Oryza sativa
  unsure (1)..(36549): unsure at all n locations
ggcgctgatcatgagaagtgcactgtcgttgatgccactgatcttcctatggaccatcctgaaaagtgtatgcaggtcctggagcaggctttcaatgcaaagcagcttaccctgctcctgcgcagactcagcgtaaagcttttccaccattgcttgcagttgatgttccactgacatgggttttttcttccttttcctttgagagatatgatcaccatggattatgcgcaaacttgaagggagcttgttcatgttaaagaatgaagaacatcgtttgatgggaacttaatgcagccttggttttctctgccaaactattttatttggctcggttaggtgcattacataggaaacttcttagtgaagacaaagtctatatggttgttgtgctgtgacttttcttcctagataggatcattttcatactttattgaaaagtcatagttgtaccacactttccagagttcccaatggtcctttgtcatatctcatagtactgagtaaaagacgaacagtattggaatattattggtggattatttcgtgattgtaggaacctgcagagcaccttcctggtttccctcatgaaatttcagtttatgaacctgctaacttgttcttcaaaaacagatgacactgcattctcaactatctatggttcagagaacaataggtttgagtggtctggactctggagcactgtaaaataacagaggtactgtaatattcaagcttttagctgttcatcactttccaatatacataattgctctgttaaccagtttttgttttcaagcagaacagttttcagctgaactctcctttctctaccatactggcttgatccatatttagatctttggtatttgtgttgttgatcagcatgcttgtccatagaagcattgagaaagatgtatttgagccacttgtgatgcgtatttctgaaattgcgcaacactattttgggacagtgggctcatctgaaactggtgagaagggtcctacagtgcctgaatttccagagaagatcaaatgggaagtgcaacatctcgaagaattgtttgagggcattaaagaagacaaggaggaggtctatgagggttttaagtctgttagccttgcaatctccgagtggcagagaagattggctatagcataccaaaatgcagctagagatcctcgaccttttgagggaatgaaatgggcaatggagtatcatgagatgtgggttgaagacaataatataaaggagctggtgatgagatattggattttgatgaacatgagctttttgaatcacttagatatgtcaagactgcacaaggtggttcagaagctcatctcctggaaagtatcaagagtgggatgcagtgcataaagaatgtgttagccaccattcgatcaagaaaggaagcagacaacaggagctggtgcattgtggaacaggtcttctccccgctactgaaacttttgaaaactatcaatcatctagtatcagaagcggctgcccgcaacaacaagtctgagaactataagatccttgtcaagatcgatgctgaagtcaactgcttacaggatgcactagatttgattgatagaaataagaatgaggtttatgagaacttcagattaatagaagatctcatactaccattattaacattccttaaggccacatacaatgatcaatcagaatctttgagcttcctagatgcagtcaaacacggagtgaattacttggaaggtgtacttgacaagattgagcagaagcagcgggatggaaatgataatttccacattgtcaaagcagccttctcaccattgttgacatgcatgtacaccttcaggcgcatctcgttggaaaccttagcccatgaagataaatcagatgcttttattctgttggacaggatcagagatgatttgtcacagctcaaagatgtacttcagatggttcaagagaaagagaacggaatatacagtaactttgatgcaattgaagaacatattgatgagatttatgacggacatatgaatgttgaaggttccttaaaacttaaccagatgggtggtctgcgagacaagctccagttgattcatgaagagataacaaatatacggggaaaggtggatgactctttcaaggtccaggaggtctcatgccatgtcatgcgcatggctgcagcacatgaagcttcatcttctcatcagttgtcagcatcaaataccttctgcattaccatggaaagtgcgcagatgtggcagctcaaagttataattgatgaactagagacaagattgagacactgccttctatgccttgctgtgttcccagtggatgccatcatcaagaagagactgttaattcactggtggattggagaatgttttgtaacttcggtttctgaaggcaagagcttctttaataaattgctgctgtccaatgggttcattacgccagtaaagaaataccactgtgacaaagtccactcgtgcaaggtgcaaccttggatccgtgggctactgattgaagctgcaaagagcaaagcatttgttgagctcagttcagatggcagctccaggaatgactttaccaggacccgccgtgcatgcttgcatgctggaaagatccttacaaacttccatcctgatgttttgacgatttacaatatcaagcaacagtatgtagagttaaacaagacatggttttctgaaaagaaccgtttgaccactttgcagttaggacaatggcacgatgcaagttatgaccctcgggcacatcacgttgagattaacaatgccaagttcctaaagcaggtcaaatcctgcaagcagttgaagtacctgagtttgagaggcatatcaagaattgaggcccttccgaactcaattggaaagctctcaagacttgtcattcttgatctcaaagcgtgccataatctagaggatcttcctaaagaaatagtaaaactagtgaagctggagtacttggacgtttctgattgttacctgctctcaggtatgcctaaaggactaggcaagctttttcaacttgaagttctgaagggatttgttctatcaaacgccaagagcaaagatctatgccatctcaatgaacttgtcatgctaaaaaagttacgaaagctgagcattagaattggttatagcatagatagcggtcagtttgcgaattttggtgagctctgtgctctccggtcgcttacacttatttggggggcacacccaatatctacacacgggagttctccaagtcatgctgctcctcatgcaatgccttgtgttctccccttaggtcttgagaagctggagctccgttgttttccccttgtagaattgcctcactgggttagtcctgaaaagctgagaaaattgaagaagctctacatcagcggaggtaacatcagtgacctgggtgatttgaagtcctgggaggtgactgtacttcggctaaggttcctcaaacatatgaactattcatggactgccctgcatgattcattcaggaaactcgatgttttggaggcacatgaatgtgaaaatctacagccctggccttcctgcggaaaagggttatggcggaaagaaccgaatggaacgattgcacctgtgttgacctgaagtattgagctgggtccaatagggtgcagaattactgcctggaaatgggaatattgaaggatatatttgatcagcagtatatctgaattctgaagacattgccaatcactgtctggtaagatggcaattggcaattgtcctgcagcatatataaagatattaaacttctaactgtgttacatttctaagcacaaatccttgcatactttcacattgtcgaatgtttatagacttattgggcaacataagtcaaaaaataaaatgtactcgtcgattggttgcataggcttgaaagctgcaagtaacaagtgatcaacttgttttgaagttggctccatgactccatacagccatcctctcccgtcttcctggcatcttgttgtaaacctcctactgatgagtgatgagttgaaagaagatgcacacggatattagagtaccagtctgatcaggccagactgtgttgcaatcaacttcatcctgctgcagtctgcagatgttgcagatagtgaaattcaactccatttttctgaacccttgtaggatgttgaatttcatttcttgagcaaattgcccgatttataaactcatcagattatactagtatctacggttcgggatcggactgtatcctgccggtaccgtacacaaatcgaattcgttagaacctccacaaatattagtgccaccaagaactcagaaggcccggaacacgatggcaacgaaatccctccagcggccaaggcgattcatcatggcgccgatcgcctcttgcggcagcggcggcatcagcagatgctacaccgcagccaccaccgccgcgacgatggccagcggcggcgtccggctccgcaggagaggcttcgtgctgtgcgccgtggaccaccacggcgtgaggcgcgccgtcgtcggcggccagtttgtgaggaagtccgagctgaggcggcaggacgagctgctcgtctccctccacgagctcgtcggcgtcttccgagagctgcagcgcaagctcgggttccggcagtgggacgagttcaggcgcgcgcagcctgagctcgacgtgctgtaccagcaggctgcgcttccagggcaagcggtacaggagccgcatctatggcgagcccatgcccgatttcgacgacgccgtgcacgccgcagttcgggctccccgcattggtgatcgccgtgtctgcagccgttgcagcagctgcgactgttggtacagcgatctggctaacttgcattgcctcgttcgcaagtttgtgtagagatgaagcccttgttttactctcttgtatatgaaactccgatatgtcttgctacaacaatgcttatccatgtttaaatcagatcttacatagctttgccacggacaaccatacgtacatgctatgatgctaaacacagcacacacgacggctaccttctcataacatctcgctactgcaaattactaggagggataaaatggatggaatccaacagatcatcactaccaaatcaccaggattgctatttagcgcacaccttttcatatgaaagttttcatatatttttttttcgattaaagttttttttggacgaaaatttttagaaaaaagtgtgtgctagtaacggacgtttgactaataatagcactataggcaaaatcacatctacgcaaaacttgactaatcctttggcacggtttgaccaacactacaggcgcggtatttttcaaggtgaatcgtgatccgccgatggctcgacgtcgacgacgacgcgtgggtcttgccggtatatgtacctgctcgcccagtagaggtagttgacgaagccaagcagcccgacggcggcgacgacccagtagaagaggtcgaggcggctggtgttgagggtggcgccctcgagccacccgccgccgccgccgccgccgtgccgcctcgtggccctgttcaccacctgcaccagcagcgtggcgagccacgacgagaggccgagctcgcaccagaacagcgccgacgcgatggacttcatgccacggggcgcctcgctgctgaagagctcgaggaggcccgggaacgacgtcacgtcggagacgccgagcaggaagaactgtggcgccagccagaacagcgacatctgccccgccgccgcggcgtcggcccgccgcttcctctccacgacggcggcgatggccgacgccaggatcacggcggcgaacccggcgccgacgcgctgcaggtgggtgacgccgctggcgtagcccgtgcgccgccgcaggagcggcacgaggaagcggtcgtacaccgggagcagcgccatctggaacgcgctggggatgatgaagagcgtcgccggcgagacgtggatcctccccagccgggtgttggtcaagccgccctgctgcacggtgaaggtgaagaggagcgggttcgacatgtagccgatcagggagctgatgaagacggggagcacgcggagcacggcctttgtctcctccacgttcttcgtgctgcagactgaccaggccccgtctttgcctccattgatgcaagctttgtcaaggaatctgccaagatgcatgcaaagacaaaattttagtattgcactctgccaagaggacaatgctcaattgccaatattttctgctttgtattcaaagtagtctagaaaaagtactcagtatttcgttgaacatacttcagactactgtttgtttgagaagctatttcagttacttcagtagagcctccttgctcagtgcttctttcttcctgtgcttcttccagcttctcaggaagttgaagcttcctgttcttgaatgcaaccacaagaacctgggatagatagatcagaatgcagtcaactaacatgcacaggatctcttttcttgagaattgatgttgacatcatgttttgacccaacaaggagcacaacctacctggagtatccgagttagcggacttccttcgggtacatggttgcggtacaaagggagaccagcagcaaccacaagcagcccaagcaggatcaggaacgcgcacaccccaaacccgacatcccaccctttgctgttctccagccaaactatgaggatcaatcctatgaaacccccaaaggagattccgaaggtgtaccagttgaagaagctggactgctggcgggactcggaggggtcttcatggtcgaactggtctgctccgaggggcggcatacaagcacgcatgaagccatcgccaaaagcgctgatgtacagcgctgcgtaaagtaggacggcattcctgccatggacttctctgcagctgcttgcctctgcttccgcgttgcaaggcggtggacggagagagggaaggtaagcttgcagtgcgagcaaaccgtagccctgcatatatgattgccaataattcgttagatggttgaatagaccaagaagcagattaccagaaaaaaatgccaatttctttattattggtaggtttgcgcacagtaattggcaacggagaattaaacaaaaatagtttcctttgatcatattaggcttgatgtagatagttgagtaaaccaaaaagcgaattaccaaaaattccaatggaccaaagaggagtattgttctagctcgagttatgtaagagtctgagaggaaagctcctaacagagcaaacccagatgtggcaccaagaacattagtgactgtagttgaagagcttgagattcccatatgcattgttccatagagataggtaaccatattcagcatgtttgggacattgactgtgcttgtcaccacagtcagaactgtaagagatcgaaacatgtataaaatgcttcagcgatttaaagaaagaaaagaagcttgaaatggaaagagtaactcgtcacatgtctgcatattactagtaactagacaaaatcacataattcaggaaacatggataaagcaagtcaactggcaatcacttacaatatacaaaccatgctgctctgactcctccatgcacctttctattaataggatttcccctccagtccaaaaagcctccgactgccatggtttttctgatgagttcaaatatttctgatgagttcaaatatttctctcttgattactgcctggccattgcagcataagggggtataaatcatagtagatagacagttgaagtcagggactcaggacccaggggtattgatcacagatggataagtcaaatttgaagaagtcagaaaaacaaaatgacaaaaaaatattcttgaatagtatagccgtcacctaccacttgcaagcaccaacagtccaacactaaagttgactatcagattcagagttcctactccctactaaccaaaatatggaggtgtatcctgacaatttttttaagcaatctgtcactggcatgcattgacactgatgtacaaatatcttagataaaatgcatgtcttcaagtccaagccatcattctggactatcttgaaactaagctcttaatttattaattggtctgagaagtcgtctttaaagacgcttcctatgagaatcattgctgctcaaattatgagcacgaaatgcttatgcatgagttacataataaactctaccaattaggttaacctactattactcttgattatcagtccaaaactcaggtttgtaacttacagttgatttcctccatattaaccatcatggaacaacccaattgtggttttaccttttaatctaagcatccactactctacaatgcgtcttcaaggagatggcatcagctcgaacaggatacgcatatgaaaagtataaacaagagaaattaaaacctaaaaccctaaaaattattggttaaaaaagataaccaaaacatatttgctactcccattattcccttttacttgacactgtttacaagtttgattttatctttgaccaataaaaacttttaagttatgatgttttgatgaatgcaagtagttaattatatttaacatgcaaagtactttgataatataatatctccttaaatatttttaaatattttttataaaaaagacgaatggtcaaagtttgtacatgaatagtatctagtgtcaagtgaaagggagcatagggagtagctattatttttaatcatgggccgatgcaattaatacagattgtctgaaatgcacatcagtagcaaaaagaaaaggtttcaaattcaaccacacccttaaccatactagattagagaggtcatggtggctaaaacaatgatttacttgtccattggcagctgaatgggtgattgtccaaaagcaattaaatttcatcaagctgaacttcgagcatgcaacacatatacagagaaaatcaacttctttgtattgttgattggtttcaatttgaaagaaacaaatataattttctgctaaggtttgtggtgtcctgctgacatccttgtttcattggaaggcattcattgagcacaatgttttcaacttttcattcttagtataaaattacatatttttattatgacatgacataattgaagcttgaagaccaagcagaaatgatacttttatgtcagtacagtacatactctcattcttcagtaaactagtcagctatactatttttacaaaccttgttagtcatcagtttaggtaccacaaatattgatgttcttcctaagacacagtttacgcaactactttcaatattgaaaatctattttctggccttgcaagatagcgacagatagagataacatcactgtacgctagattgcattgattgtaacttgtaagttctgtcaagctgccataagccaatggagattataggatatctttgttacgatctatacaacacagacaggctaacaaaagaaaattaatcacaactctttgttttctcttacctatctattgcatactgtttggatctttaagctccaaaattgtcgccgtctgatctaacagtactgacccttttcttgttggcatatctcctagcccagaatgcataattgataaatgccaccagctcgaaggttgccaataacaagaagaagcgatcaaggcgtgtcctgttgaagtttgttccatctaaccatcctcttccattgtctccaagccttgtcattctgttgacgagctggacaaaggcacatcctgaccaggctgctattccgaccagaagagactgcactgctggtgcaatatgctttgcttcaggtgcctcgctctttatgaactgaaccagcccaccaatatatgctatatccatgatgcttagcaggaagaactgcatcaccagccagaagacggacattgggacaccgtcagctactaatgttagcccttgctgctccacgaccatcaacctctttgcttccaccaacatggcaatgcatgctgccattatcccacacgcagaggcaacaccgatgtgctgcagaggggtgataccattggtgtggcctgtgaatatcctcagcagtggtatcaagattctcctgtagcacggttgcatcagcatgtgaaatgttgttgggattgcgatgagagaggcagagggtatctggatcattcctatccctgagtccatcgtgctgccaacctgtatggttaacgtcatgagcaatgtgaagggcaagtaggcgaatatgcagctgatgaagattggaagcatccgagtaatagcctctgttttctcatcaactcgagtagtgctgcagaaaatacaaattgttttttcccgtcatgtattcaggatttgtccacaaatatattagggtattatggagattatgatttccacaaaaataggaattattatactcttggttctcaacatttatttaaaagttaaaagttcatacattgttttcagaaatacattgttttctggggatttttttattatcagggaacttaccaaatatttttgctgtcacatttgtcttccccgtcctcatctacatgatctgatgtactgatctcttgcagctcaataacatgaataacagcagcctgcctcttctttgatgatgtgacaagaacctggaaaggtaccagtaatacaacttcaaaacaatatgatcttctgttttccttgctttgtcttgctacattcaattttgttttagattgatgtgtggaaggactgccctaatttctttattgcttgtaattaatctgttatctgaaatttctagaaataggcatggtgactttccagcaataagcatggaaggtagaataatgcaatgtaatgctatcagacaaaagagtataaaacataacttggataacagcatccttcttgtatatatttgacttccacaaaatggatcgtggataatataaagcaacactaaccagttggcgtcaaaataaatcaatcatacacaaattcgttataattaacatgcataccaaattagaccgacaaacgtatataattgtggcatatgattttttacctgcaatattctagttagaggacttccattgagcttgcgcattccatagaaaggcagtccactggctgctatgagcagccctacaataacaataagggcacacaacaaaaagccaatgtcccaacccagattcttctcgatccacactaggaataccaatccaataagtgctccaagagagtttgcagacttgagccagcttaagaagttactcctgagatgcgatgcttctggatcatcattgctgaactgatcttcaccaagggctggtacgcaatcgcgcatgcagccctccccaatggcaaacattaataagctcaagtagagcagtgttaagttccagccttgcgctggctcacatttgcttggatctttgtttatctcacaaatcggaggatggagtgaaggcaagtgcgcttgcaatgctagcaacatatagccctgcatttcaaacacaaattgattataactcagcattttaaaaaaccctacctcctcatcttagaagcttaaaatgtcctgaaagcatatactatctccctcgtcttaaaatcctgtactaattcttttaggcgaataaaagcttcgatttgattactcattcgaacaaaatgttagcaaatcgaaagtgacacgaaaaatatgcttccaaagtgttcgattctaacatttggggatgccattgtaaactcacctccaccctagtacgattttctcccaattctgcctattacatcttccttaacctcgccggctcgtcctcacccacccaccccccccccccggctccctcctgctgctcctcctccggcgaactcttctcgtagccatcggtgatcgccctgcttctccgctctcgcttgatcccacgtcatccaggtcaaagaggacagatccgcgcgcgagcgcggagaagagtgcacatcccggtggatgcgcggccgatggccggtagctggtggcagcgatcggagagagcggggagaaatccggcgaccggccggaattccatcatctccacggagaagctaatgggggtgaagagaccggagggcaagggcatcttcgggagttcctaatatgacaaagtattttcagtgaaatacgatactttcaactcgaattccgcatggattttaaattttaaaattttagggatcaaatatttttaactataagtaactaagttcgaattaaaatttcgaactcgaactgattatccaactaatgaaacttgataaagttatcttttacctgctactaaacttagattgtgtttgggaggagtactccggcacgtaaaacggagcatgtattattgcacgattaaatgattaattatatattaactattttttaaaaaaaatggattaatataattttctaaaacaactttcgtatagaaattttttaaaataaaacacaccgtttagcagtttgaaaagcatgcacgcggaaaacaatacaggtgggttgggaaaactaggataagaactcagccttattattcctaactcaaactttgtacaactaaaactgatcatttataatagcatgcatgtaaatagtcattgaaacaaattacagttctctaaaatcgggttggaaacgagaaattaaattaccaggatcacaaaggggctaaacacaaagatggcagtggttggtttgatatatgcatttgagaggatgttcatcagcgcagtgaagaatgacacagcgccaaccagatatgtaatcatggatgacgaggtaacaatatccagatgcaatgtctgatggaagtatgccactaaactgaagtttgcgctgttagggcagctgcgcagagccaccaaaactgcaataaataaataaagagtaaatttcacaaaaactacatatactttagtcaaattatcgtaaaactacaaatttaatgtcatatatcacataactatagacttagcaacaaatttatcccaaaattacaggtttaaaactaagtatcataaaactacatatttaataatcaaattatcacaaaacatcatattttggggtttaatttttttaaactaatgttatgtttgagttgtaaatgtccaagttttatgattaaattgatattaaacatgtagttttacgataatttttttactaaaactatagttttgtgttattttaccttaaatctatagttctatgataaaaaaaaatagtgttaaatatgtagtattgtgttaaatttatagtttttgataatttgaccaaagtacttttaattttgtgaaatttactcataaataaataattaaataacagacttaggaattgtccagaaaattcatgcaagtccatcaaaaaataggattccaatcagaaattcatgcaaatatatcattaggcctagctatctaatttctgaagactgtgtgtgcggggcctatcaggctttgctcaaatttacttttgtctcttcttcagaattaatttgaggagtttaaggtctgattctgaatcctgatggaaatattctgtacaggaggtgatttctagttttctactgtactagttttttttacagcttaaattaccacgtattcatgtggcatggggtcaaaataatttagagtagcatcctaccatgtacatctgcgggaaagaaataagtagaaatggttctcattgcaggacgggatgaggctcgaacccggaccggctagctcgcagcttgtgttgctagccagaagaccccgggtcttttctctacctcgaatgttatctaacgctttgtcagttgtgatgtcgttttggtttatttcatatattttttgttgcctttattagtagttgcgttgcaagcaccaaataagtgaaagatatcctttaattgctctgctagccctgatggagacaaaatgaatattggttcttggacatgagattttcgtcagacttttcagaccaaatcatagaaaaataatgcttagatgtgtggatggagataagtagatggtacatagtgtgggaagagattttgcactgcgtcctttatcctttggcctattttcttttctttattgcgagtgaaacacaacacataggtgtccttatacatccctataaatagacacacgtacactttattccttgtgagtagattggaccgatatatcttaagataaacgaaagtcactacgtgtattatcaacatatacttaaaaaataattatctataaatacgagcacccatatcaaatataaaactttaacctagataataggtttcaccataagatatctaacaagttaaattacgtttcacttcatcttcgacctatcgtctgttggagttggatgactatatatataatagtatcaatttgccccacgtgtattagtactttataactttatttcatttaaacaatcttggaagatcggaatgtaatcctactgcaagactcactcgatgttgatatgttggatgtgtcctgcatgcccgttaaattattcgagtgttatacaattagcatctccccactgcacgttctatatgattttccacttattctttttttttttacgcgtggagctgttccatattcggctagcgagcgtgccaatcatgacaatattttacgttacactatttttttgacaaactgatttctgataatgggatataatatctatgatctagaacgttccttcttatgacttactagagaacagctttatattaggtggtagcaaacgtacaaatcatgataatattttctgatgttacatttttttttgacaaactgatatctgataatcagatatgatatattgatatccatgatctagatcgatctttcttatgacttggctgtgttcttggccgggtgcatcttcccaagtgtactatatcgttttacacacgcatgcttgatcctaaactgttaaatacgcgtgtttttttaaaaaatacatgaaagttgtttttaaaaataatattaatttattttaaaaaactaatactttattaattatgtgctaatgagttgttccgttttgtgtgtgtgagggattagttcccatccctttgagccaaacacaagcttatatccgtaatctcgtatttcaggataaccttttgctgaacgatacggttacatagaaattatatgacctttaatagctctaaaattaactcttttgtacagtagtcgtttaagaagatggtaactggacgtgccaatgatctttgttgcttaaaaaatggtggccacaggcttaaggaatggtgcaaaagctacaaattttcaccaaattcagcattagtttgaaaaaaaaaagacgttatcgcttattaatttgaacgttctcaaatggtgcaaatattgtgatcgcttgttaattaatttgttgagatcaaggaccatgtaattgtttcgaatgttgattaaaactttcgaaggagattggaagcggaaccttctctctcacttttgttggacaaggtgcggttatttgtttaaaccttaattcttgtaagaagcacttccacctttcaagtcctcctcaatggctcaccagggcggcggatcaaacatggaagaggactttggcaaggggaccccctctcgccgctcctcttcatcttggcaatcgaccctctacagcgtatcctctccaaggcaacagagctgggcgcaatttcaaagttgcgaggaagaacaactcggttgcggacctcgatgtatgcggacgatgttgtcatcttcattgatcccacccgagacgatgtcacggcctttgcggacatcttacaccgtttcggtacagctactgggctcgttaccaacctccagaaatcccaagttgcggcaatcagatgtgataacatagatctgacagacgtgctacagggtgtcccagcaatgatggcaagtttccccttaaaatacttgggcctcccactagttcttggaggattgcggaagatggacttgcaacttgtttttgacaaaatctcaggaaaggtcgcaagttggagggggaaaagcatgggagcagctggaagaactacgctagtcaagtctgtgctctcagcgcagccaatctacctcctgactgcctaggtgacgaaagaatccctggagcaacttgataagcagagacgtcattttctctgggctggcacaggcgatatcactgggggaaaatgcaaggtcaattggacaaagacgtgcttgccgactagccagggaggcttggggagtcctgaacctaaaaaaattcacaagggccttcagactgcgatggctttggcacgaatggaaagatccgaacaagccgtgggtgggtttggacacgccttgtgatgaaatcgacaaagacctcttcgctgcctcaacaaagataaccgtcggtgatgggaatatgacatgcttctgggattccgcttggattgatgggcgcaggccaaaagatcttatgccattggtctacgcaatctccaaaaataggaaaaagtccctacgccaagggaaagaggacgacgcatgggtgcatgacctaatctttgacgcaagctcaaccatcacagtcaacctagtggaacagctggtccgcttgtgggaagcggtccgaaatgtgcagttagtcagtgaagagccggatcagattgtttggaaattcacaggcaatggccattatacagcctcttcggcctatcatgcacaatgcttgggggcgccaagtacaaacctcaactctttgatttggaaagcatgggccctggggaaatgcaaatttcatgcctggctcatcatccagaatagagtctggacgtccgaccgacttgcaataagaggttggcagaacaacggccattgccccctctgtcgttgcgaagctaagacgggattgcatcctgtcgccacatgcagatacacaaagagaatatggcaccacgttgccggatgggtgggatatcatcaattggagccgtcccagtgggaggaagcccggtcagtccgccaatggtgggaaagcctagcaaatactcccaacatcccaaaaaagggccttcggtccctcatcctactagtagtctgagaaatctggaaggagagaaatcgtaggattttcgatcacaaagagatggcggtaggccttctcctagcaaaaataaaagaggaggctagcctgtgggccttagcaggggcaaaaagattgcgcgaattcgtcccacacattgtatagtttatagcttaaagtcttttttgctttacccttaggggttgtattttctccttctatattcaatgaaaaggcgcactcttgtgccgttttccgttcgaaaaaaattcttgtaagaagtatgggatgaacatacgcttttcattttgcgcaaaatttttagattttagcacagccctcttttaactgatttttgtgtcaaagtcatcgagagcggtagattttggatgttctgtagttctttatgctggagttaaatattctaactgttgtcatttaggctctcttaaaaattgttagaatgtttgatcgatcatgggcctgcagatttcagtgggcatacatatcgtccccccagctcaaaacagtatacagatggtcataatcttgtttacttgcgtgtaacaaatttgcaccatttgaatgatcaaattaataagcgacgatgattctactatggttcaaactaatgctgaatttgctgaaaatttttagcttttgggactgaatatggtgactccacatccaacattacgtacggatcctacaaagttataactaaaaagaagatctacttacgctctaaacttgaagatttctcctctttcatatccttaattcttagttcttaccccctacagagaaacgcctagggtctttcggctaactccacaaggtgatgggctagacgatctgagttcgaagcatcacctcttctaattatttgatattagatccttccctaatattcgtgtttttttaacataaaaaagaagcacagaaaaggttgcaagaacacaatatccaacaaatatgaaaacaagagacagactaaatgaaaacaactaattcattttccatgcatttacccaacaagacacaatatacctctagttacattctcaaggacgataaaattacctatacaacaaatttattttccatgcactacactatatgaaaacaagagtcagactaaatgcatctccctaaacaagaaacagaaacacaaattaatgtgtagctatatattattacaagaaacgattagaaacaatagacaagactaaatctacttaaagttaaaacacaaatgtgtagtgcatgcatgcagtggcttaccatagagaaagactgttgccttggtgcctccatgcttccttgcatccactgcgttccctctccaatctacatacccttcatcaagtgccatctatatatgcttctccaaatcagccttaatgcacatatatatacaccgttgtaccacaaattaacgaacaaaacagactgctgctgctcctatctctctatatgtttggagagtgttttcgaatctcagaagagacaagtaattaatatcctggacatctcatgatcaggagacgatggctaatatatataagtagctagctagctcttggtgtatatactcacgtggtctcctgtgcatttcccacatttttcttcaggtgacgcggcgtatggactgcgcgcggggctccgggacgtggccaaagatctcgtcacgtttaggctgcgttggggtgagggttttgggtaagctaatactatatcaatatacgcgcgagtatatttttcaaactattaaactgggtgtttttataaaaatatatatatataaatatcgtaaaaaattatacaaatctatcttttaaatttataatagttagtatttaattaattatacgctaataaaacataataatcagctaactctcgatcaaactcagcctaatgatgcatgtgtttactactacgtggcttgtcccgtcgctagctggtcagatctccgctctccggttagcctggagcttgcctgtcgctaccgctgcagatctcccccgaataatttggattttctgagtggtcgccacatcttccccgcgcgtgtcctgcgagttgaaattacgagtgtcagtaaactgaaacggcttgtaaagctgtgatgcacatgccgctttgacaaatttcaatatcttatgtccacgtgatcctctattcaatgaagttttcatgtgctgtaaattagtagacatgaaatatgtttttcaaggatgttctgtgtgtaaagatgattaaaataacagtgcatcactgattttgttgtgtgccagaagattcagaagatcctctgaatgctgctcttgatactagtagtctcttgcactgggggcagctatatcacgactaattccatgaggtaccaggaaagtaggaagagatataattgggcattagtaaaattttgtacggtcatagacatacagttgtattggagttgtctctgaatgatatattttgccacagaaaacgaccacttttacacacatttgggtcggaatggtacaaaatgtacatttgagtcgaaatgatcaacgaccaagtccagccaatcaactgaacacaaacagcatgatacaacttacatcagtacatggttaccttttgctttgcatctgtgaagtaaatggtgcttcaagagcaatcaaatctatcacggtgagtcctgatcagctgatggggtgaccatgcgtggattgtgccggtaggcatacttcttcgcccagtacaggtaattcaagaagccaagcagcccgataacagcaaccacccagtaaaacaagtcaaggtggctgttgttcaagcttgtaccctcgagccaccctctatggtgtccatgcctcgtagccttgttcaccagctccaccaggaacgtgcccatccatgaagcgagacccagctcgcaccagaacagcgccgtgccaatggacttcatatcctttggtgcttcgctgttgaagaactcaagcagcccgacgaacgatgtaacgtctgacacgccaagcaagaagaactgaggtgcaagccagaagagggacatctgcacagctgcctccttcctctttctctcgacgactgctgcaacggccgatgcaactatcatggaggcaaagcctaagccaacacgttgcaggtgagtgataccgcaggcatatcctgtgcgcttgcgcatgaacggaacaaggaagcgatcatagacggcgagcattagcatctggaatgtgatggggatcacaaagagcgtcgcgggggagatatgtatcttgcccagccttgtgtttgtcatgctaccttgttgcacagtgaaagtgaggagcagagggtttgagatataaccgatcatggagctgatgaagaggggaagcattcgaagaacaatctttgtctcctccactttcattgtgctgcaaactgaccaggctccatcttcaccatggttgatggaggctttgtcaagaaatctggcaaaaaaaaaagtgtgcagaagagtttataacatttactaaagaatcatattctcttaaaatccatgcatgatgtgtgatacccttaactgaaaaaatgtgtgtatcttgctgaagcttacttcagaaaatttgtaggacgtggtacttcaatagaatccagtccattacggttttcttgtgcttcctcaagtttctcgggaagttcatatttcctgttcttgaatgcaaccacaagaacctggaaaaggcaatttttcagataggcggcagatatggaatggtgattttctcctgagagatggaaatctattatatctataaagcaatagaaaaaagagccaccacgttcgctctcgcggcctaaaaattaccacgttaatcaaagaaaaaaagaaaaaaaaacaaacggacattattcttttggaaacatgacatactaggaacatactcacgcacgcattgtataggtttaggaaactgatcacaactcttaatcggatgaaaattagaagcaaaaaaacaaacgggcaggattctttttggaactgtgatataacaataaatattcatgtatggttatagtgtaggaaacggacaacagttaacaaaccaatcataattagattctttcatggaattagcatccatggcggtattagtttatacggttctgaattgtacacgattcatcccgtagtaataaatagatcgatactcctagcaatgaaaacaaaacgcaaaacacaaatattcagccataaatcttccagccgcaatcagctttaccaataaattagcaagacggaagttttgccgccggaatccacttcaataataaattggcacccaagaatgccataatcttatagcaaaggatcgtctaacaaataaatttgtgtgctacaaattaacatattagattggtaataaaaggaacctctatataagagtacaatttagagataactaaaatttggaatttaaaaataaggaatactagaagatgggtttagagtccataaaaatacaattagaaataacagaaattcgaaataaaaaaataaggaatagtgacagaagagtctagagcctatatatgaatttagaactaattgaaagtcgaaaataaaaaataagaaaaattaaaagtaaagtttagagtccatataaaaatatatttagaaataactgaaattcataatttttttaaaaaaaaaagaagattggaaaaagagtctagagtccatataggaatataatttagagataattgaaatttgaaattaaaaaaaatattggaagaagaatctagactccaaataggaatacaatttataaataacataaagtcataattaaaaataagaaatattggaagaacagtctattgttcatataggagtacaatttaaaaataacagaaatatgaaattaatagataagaaatattgaaagagaagtataaattatatatataaataaaatttagaaataactaaagtaaaaaacaataaataactttcacgcatatacattacagtatgaatattgcgcattggttagttttatcaagttagtacataaataatttaaaattatgttgtcatttcaatctattttaataataaaatgtgaatatatatatatggtattttatgggaaaaatataacgatgatgattgcgcgggccaccatgctagtttaagtttataacctgcagtatccgagttagagggcttccttctggtacttgattacggtagaaagggaggccagtggcaactatgagcaacccaagaagaattagcagtgcacacacgccaaatccaatgtcccaccccttgtagttctcgagccacactattagaatcaatcctataaatcctcctaaggagattccaaaggtgaaccagttgaagaaactggattgttggcgggattcagagggatcttcatggtcaaactgatctgctccaagtgatggcgtgcaagcacggatacagccttcactgaatgcccaggtgtacaagcctatgtgcaatatgacggtgttgaagccatgaacctcttcgcagttgcttagctctgcttcaatattgcaaggtggtggatggagtgaggggaggtaggcttgcagagcgagcaatccaagagcctgcacaagtagattgttaccttggaacttaaaccagtatgaagcagaaactacttgttcggtggctgtgagcaaagatagaaacttatatccagatattaagttttaaactagtgaaagtatctataagttaattgtctgaagaaaatcaatgctaatttaaccacaagcaaacaagaagatgccgatgtacttttttacatagaggtcctttaatatctttatcaagtaggcttcggatcaaggttatgccacagacccacagtaggtgatgaccaaaccatagttaaaaattcaacagaatatattcctttcaaaaaaaaaaaaaagttcaacagaatatgatctggtgttttggcttaattcacacctaactaattctgaaggagatataaaattgttttccttagcaacttgtaagaatcttgttttgtatgtatcccaagttcccagctactttgagcttgggaaaacgatttagcaacctaagcttttgaagtttcaggcaacctgcagctttttcgatatcggtgtgattacagctgagaataatgttagaagaaaaaacagaggcaacatgtgaaataattttcatgggtttctttcaacatctgatgtaactatatgatgctattagtttacattcattagctgtgattaaaataactgcgacgagtactgtgttttttttccccttctcttggcaggctgtcactagtaaagataaaaagaaagtgaaatcaagaaatttcaatggatgatacccagaatatatagaccgttgaatagaccatgaggcaaattaccagaaactccaacggaccaaagagtagtatggttctagagcgagtgatgtacgagtctgagaggaaagctcctaataaagcaaatccagatgtggcaccaatgaagttagtaactgtggttgcagagcttgaaactcccatatgcatggttccatggagatatgtaaccaaattcagcatgtttggaatattttccatgtttgttaccactgacagaactacaagagagaacaagcataaaaaaacacttcgatttcaataggaaaacctactgttagtgagtaattacacaaataacgcaagaagccaggaacaatatattaatcaatggactcagtagagcaacttacagaacataaaccatgcagctctgactcctccatgtacctttctgtctatcgggtttcccctccagtccacaaagcctccaaccaccatcagctacagatgaattagcgtcttcttgcacttgattactacttcttcattgcatacttccattccatcataggaggtatatatagacatatggtatactttttttttcctcgcaaagtggccccagctaaataaagaaagatgacaagtgaaagatcattggctattctatgcaatagattatagatgttgcccccaacagaaccaaccacagacgattgttgacttatagagtcaccactgtgcagcccaactgccaagaatgcagtaagcaagatacgataattatccggcgcactgtatttttccttctctcaggacatcgcgcctgaaaaagtgccaggcaggaggctacaggtgaagcatttcatcgaacatctgaagtgccttccttcgaggccgcagggctgcaatgcaacccaacccagcaaaccacttaaccacccccaatgtaacagatgactcgctcaatcacttcatcggtgcatgggaggactacgagggaataagcaggaggccatgctctcctatcgaagaggaagactgagcaaaatttcaatggacatgctgcaagaatggtaggcaaaaaaaggtgaaaattagactgctacttcagtatgaaacagcaatggtaaaatagctgctctttacgcctttacggtcttacccatggacatgcacaaccgccgtggcaggcagcccagcgcattggctcgccgcggggggcttcccatggaggctggttgttgatcactattcactactcttccccccaacccctcctacccctgaacgcgagcgggcggcggatggttcgggccgttcggctcgtcctcctcgtcggcgtcggcctcggcctcggcctcagagcatcacggtcgtggctcgtgaggagaggcggcgtcgccctcgaggctcgccgcacgccggcgctccgggacggtggggggcggtgatctcgcccgatgggcctcggttgcgcaagctgggccggaaaaggacagacacgaacgcgtctccgcacggttgggccgggccgaaaaacaccggacttgccggcccggaacgggagggcggaggctggggaggcggtggcggacatctccgagggagacggggatccgatccgacccttgctgagctgcgcctgagatgccggccaacacatccactggatgatcctcctcggctcctcgccgccgccggcgacgacgacgacgaaaaggtagcaacagaggtgtgggggaagcagacaaatgtacaacaccttcgtccgcattcagaggaaagatcggacagtatcacagtactgctggtttgtacgtgtttcctggtaggtactcctatatcgtatctgaagttctgaatatatgcctccaagctagtcgtgtgcttcgtctgaatcagtagtggtgattactaaaagtggaatatcctaatgcatatggtaacataaaaaaaaatatagctcttcgccagaataatttatggtgatcatcttctatgtaatgtcagctcaagaagcctcctctgatgatctatgttctgcttaacaaaccatttcctggcaacaaatcttgcgccatactagatcctgtcagacaggtaaaaatggagaaaagaaaagaaaattccattgtacagacacattagttacaaaatacatcatctgcatataactctcaaggtttgccaagtcagatacacctggtggaggaataacgagcaagaatattaaagcgataattttcattcctgtttctgtccataacaggtttttaaccgtctccccggcacatctagcaccggaactatacacttgtgacggcaatgcacaaccagtatagctcgtacagtccttcccatgtatacaagattcgacaccaacacaacctgattcttcacccacccaatgctgaaattatcccagtttccaccatgagaaattgacaatacatgccaggtgacagaacaatgatctagtcgctaccacgtaataaaatttggtctgcatccagatcttcctaaaacttcccagctagagagagccgatagaaactgagggtggcacggccatcttaaaaagggagccagccaccgacccttgccagcaagggcaagcaggatgagagctggctcactacggtgcagcgcccaaaaggctctggcgattgccctggtttccccatgctctctccttccacaggagctcaacctgctcaaagctgaggcctttagtctccggcacgtagagagccacgaagatgaaggccagcaccgctattccggcgatgatcaggaaggtcaggccggtcccaaccaacccgacgatcgagaggaatgtttgtgccacaatcaggttagatacccagttgacagtggctgacatgccaccacacattccacggtatgcctcggggtagatctcggagttcactgcccatggaactggccccatgcctggggagaagaaggcgatgtatagagcgagtcccgccaccgcgaaccatcccagtgcaccttggcaggcaccattgagtgcattcgaacagatatctgatgatgactgcagtatgaaggccattgctaggatggcgagggagaccaccacaccagccaagcttgtaagggccaggcgacgccggccacagcggtcaatcaggtagattccaacaatggtcccagcggcattcataccagcgactatgagggaaaggagcaatgccaacttgttggaggtaaacccagccatctggacaattgttgggctgtagtacatgacagtgttgatgccagtaaattgctggaacgcctgcacagattaacatgtcttaggggagaaaactccatgtagttaccaacaggatgcataaatcaaatgctccttgaggaatgcacttagcacagtgaaccgtttatctccctggtgactaaaagtttaagggactaagaacatacctaaaatgagtgggctagaatgctagatgatgaacatacctgaagaccagctccagcaaaaaatgctagccttagttcctttgacttgaaaatgtccaaatagctcccagtaccatcagactgaaattcatgcattgaagaagaagcaagaagctctacctcttcctctagacggtcagagtcataaatcttctctaggacagaaatagcttttgctttctcatcctgtaaagaaaagttaatgtaacaacaaaatgcagataaaaggagataatacatgactgaataaaagcttaaaatataaccttccagaaaagccaacggggagattctggcaaaaaaagcatcagaacaaactgtagaattgcaggcacagcagcaactccgagcatccagcgccatgttccaggaacctatgacatgtagcatgcatatcattgcaagtttgcaactactcgtactaatgtattaccagcttacgaatatctccactataactctcaagaaagatggttgtatatcttcttttataggacatcttatattgttttctaataatgcaggatttgttatgcatcaagattatgaaaccccaagtcaaattataaggagacgcacaatgataatttaatattgttggtcattgctttataaggttctacttgactgaattatttgattcaaatgacacataatttttcatcctcaggtaagtaaagtggtacttcaagaacaaacagtgaataggctactgaaatcacaaaatcatatgatgtgccaagggataaaatgtgcatttcagataaatacaggaagttcatttaagaaaaaagaaaacagaatgatgtatatactgcagtgaatttcagaaacagaaagatggagcattaacactagagtggctacgcaccaaacaacaccttgttggtgattcatccattgctgctggcaaggaagctgactcttgttcattgctaattaagtgttacacagttaactagcaccaacaggaatgttaataccataaaaggtaaatatatgaaaaggagaaaaaggtagtataaacatggcattgatgctgaaatcctttctcaagggagttcatcttgaataacataacatgtgcagcttttccatggttcttgtgcaagagtaccgaccccaagcttgttattttttcattaaagatatgatgcgagctcatatatatacttagttgcagttaacagttaagttccccatggcagtgcaagacctggtttgtggaagctcaataaaaaaatttcaactgcaatgttttcagcttgaacttgttccgtttatagttgaatgttaaaagaacttaaactgaaaactgctaatgtgtaggaataatggaataaaatatgctaattaaatggaggttgaatgtctacctcagtaaagccaagattgatgaggtaggagaagaattgaccaccagtaatcatgagtacattagttgacaccaaacctcccctaatttccgaaggagcagcttcagcaatgtaaactggcgctgtgactgatgctatacccacacccaagccaacaagaagccttccaagaatcagaatgtaaggaccaccagcagcacacataacaagtgagccaagtgcaaacagcatgtcagccacaagagtagacttcctacggccgtatgtatcattgatccagccgccgccagctgctccaatgatggctcctaccaatgccatgctaacgattgtctcctacggaagaaccaaaatcagttggtgcaggcgtgccatatggttaatgaccagtaatttgtactagattagattgaacctgtaagaaataattgtctctgactgctggaaagtcatcccgaatatacaaaagggctccagatatgacacctgatagaataaatttcttagctaagagcacaaatttatcatactgtcttctcttcttttcttttttttttttggcaaaagtatacagtacagtaattctgtgaagttacacacactcgaagattttgctagaaattaataagaatgatgcaagcattgatttcatcccgctgctaaaattaatatctatctttatgcagtactgtagagatcatagcacgaactcaacaaaataagtccactattcataaatctcatttcagacttccacttcaaactttgtttgtttgtatcaatgatatctaaccataggcttcctgaacatactgtcaaatatcaaattggaccaaacaccatctgaatgtttcatcatatgaaaatgaagtaacccaacaagtccaaagcaaccaaaaacatgtcgcttattactgcgaggggaaattcatcgagaacagctacacttgatgaaacgttcaggcaaaagttggaaggtaaatggcacacatgcaaccatatacctgtgtcgtagccaaagaggaacccgccgattcctgcggcgcccgtgagcgcgagcacgtagcggttgctgaagaaattcatgtgcttcttcccccctacgtcgtccaggagcccggagctcccgggcatggacaaatcgatcgtcatgccctccgctcccaccaaatctgaccgaaccccccccccncnnccccaaactcctcccaaaatccaaacttcggcaaacaatcaccaaaaaacaacgacctcaaaatcgctccacaaaaaaaatccaatctttgcccagatgcaagtaaagcctgctctacaaaatccaacctttcggccgcccccgaggtcacaggctcgggaaccaaccaaaccggggagaagaacggaagacgcgcgcagaaatttctagggacagagagagatttcaggagccgcggtcccggaccaaggtagaaagggagagattccaggggacggggcgacgagagaccagcattcggggaagaggcaggggcagcggcagcgagccagcgaggcgcggcttaaataggaaagctgcgctcgcacggctggcgggctgggtggtggttgggcaaatgatcggaggagagagctgggggagaagaaggtgagcttgcaggttttgaaggagaaattttgttgggttcagatgatcagatcagcatcgtcgcatcatcgattggcgatgaagccgatacgcttcgagtttccttttgattggttgacgaaagatatagggagacgccaccgtggggatcggaaattcggaattcggagggggaaaccgagcgagaccgcgagacggcgagagacggaccacggacctgaactcaggtcgtgtttggttgaaattaggaatgaaatcggatcgaaaacggatggaattatcatatttgtttttattttttttgaattgaaatcggaatcgaaaactcggatacggaaatgaaatcgaatattatcgaatacagatacggagcgaatacgagacggaacgaatacgatagcgaatatttaccagtatataaaaaacccctcaaattgagtttcttgattaaggaaaagatatcgcttattattttagttcaacatctccaacatttatatcgtcaattttatagacgatcccacaaccctatgtgaaaatcgattttcatggctattgctcttagagatccatatgcaaatatgattatcattttctattctcaagaccttttactagatgtataacttacttaccattgtataaattggagatgttatttattttacttcacatcttcgaaacttgtaatgtttgttttatactttaaatgctttcaaatacaactgttataaactacaaagtggtagatcccgttgagttctacaactttgatatggaacacatctccatcagatgttgttgtttgaattgcagttctgagatcttgtaaaaattaatatggtatattataatgaatatttagactccttaaatgacctcaaataataaaataatcaataagaaagttgtagatctcatcgagctctacaatgttgatataaagtttgtctccatctgattccgtatgaaaaagttatgtatatatacgttttttttttaaatttgctcaatgtctgcggatataaaaaaaatccggatagttccgaccgtattccgattccaacagataaaaatccggatagttccgaccgtttttcgattccgacagatagtacccttactgtattcgttttcgttccgagaaaaaaatccgaattcgtttccgaatccgggaatttccggatagttccgaccgaaactatccgaatccgaaaaatggtccagacggacggaaactatccgaaccactttcacctctagttgaaattaaaagtttatgtgtgtagaaaagttttgatgtgataaaaaagttagaagtttaaagaattattttggaactaaacacggactcaaagctgatggtaatccatacagcaacacttcacagatgacatcgatgaaattcctccacaaaagaaagtagatcttgtgctctcgattcaaaaggcaaaagaagtttaatggaaataaattactgaaagttgtaatgtatttccgtaatcttacgaagtcgctgataacgagagaaaaaaagaaaaggctataattgcaaatggagaaatcattaatcgacgaacaaagataggctgcaaaatgagttgtagccgtatcattttatccggtattagttcatttttcgtcacatgaaaaaaaaaagcgtctagacgcaacgggagagatgtgcgtgggccagtggtgggcccaccgcccgcgcttcgaaaccgacgagaggaaggccgtttctgctgaaccgcatcgccgaaagccccttggtccttggagagccaggaaacgtggctcgggctcggacggtcagatgctcggatgaacacatctccgccattatccgatctgtttattccgtccggccgcgcgcgttggcgtcagagagcatccgcgtccgttgggtgtggatcagcgcggtgaggtgtcgccgccgcctgggaccgggtggcccggggggccatccagcccaactgccgcctctcacgagtcacgtcaccgcggctgtgattgccctgtgggaggttgacggagatgcgctcgtggcggatgggtgagcggctcgtggctgcggaaaccggccgcgtcgttgtcgtcgcagggcccccgcgccacggctgcgaaggaaggcctctcgcttgttgcgcttgttgcgccttttgcacgtgccaccggcgctggtgaagtcgtacgtcattctcctgggcggtcagttccactgctttgccctagctgggcacgctgcacgggtgaacactgaggtggtgtttgagtcatgaagatgaaataaaattaaatgttttatgtaaaatgagatggtaatgacgtgtgattaattgagttttaattattataaacttgaaaaatgaattgagatggtaataacatatgattaattgagttttaattattacaaacttaaaaaataaattaatatgatattttagaacaacttacatatagaaagttttcgcacaaaacgcaccgtttaatagtttgaaaaacgtgccacgtttatctaaaagtttatccaacttttgttggagattcgaacggggcctgattagtgatttgttgggtatgcagcatcgagcatccggccaagccaaaacaccacgttccagtacacctcgtcaattggccaccatgctcgtcaggcttaagcccgcgtcttcggcgcttttcatactgcggtggccgtgctcgtgactccgcgagcgagcagggttggcagcatccagcgccctagcagccttagcgcacacgtcaagctcgagcacagcttgtatcttcatcaccgtcgtttcccactccttgttccggtcaccaactcaccatttgcattcatttgtggagttaggatgtgtcctaacgtgctcgatattagaccctcgagatctatgcaccacggaacattctttgagtaagtattatttagttaatagaagctcaacaggtgttgacatgttctgataatgaagtgctgatagatcatagaatgatagtgcagcatgtttattgattctttgagttgcagacattcatagagagccattgaatttgatcttagaccccctgtgaattatagattaccttgggcacaaccctgccatattctcttttgttccaagggataggagattaggggtgcaacgatgcacaataatcaatggatgcgcgacacgccgacacccgcggcttctctctaagcagacattgttggagtaccccaatttgttggtggtctcggtaaatatcgacctgaaatcgaatgccaccaacgaactaagtcggaagtccaattcgaatgaatagtgttcatttacatctgcttatcggatagttttccttgggaaaaacattggctccatgtggcaaattcattcggaaaagcaaaaatcccacgtagatgcaaagttcttcgtgttcttagcaacaaggggcagtcacctaacatcggacaaacacaaccttgtgtctagccaagttgtccataccatcccttatgtgtcgactgtcgcattgccagatttgtgcacacttgttcacccaatatccatacacccaacgggttcaggagaatattaaacaactgaatttctcaattgggccataggtatagcatatcatcaataattggtggtcccaagcatggcaagccatggcaaaacaaagtagagcagtgctcgacacgaccatcagcctagtcacttcgataatttgcagatagcgaaacaccttcgatggtgttagcagatcgctaagtgggttagccatcacaaaaaaactggtggacatggcgtgctacgggactgacgggggcaacccttaggtaaaattgtagctttcccctaataaagtcacaacaaattttgcaggtgtgtcttgctcggctcccatcaggctgcatgcttgcaacttgttggctttgtaaggttatgtaaaattcctccacgatcttaatataattggcttatgttctcctagatggtaaattttttgaaaaaaaatatataaaaattgcttagaatatttttttcctaaaacaaccttttaactttagagtagttaatttatccatttgtaaatttaaatattatcacaaaatcatataatacattattcatccatccaacaaggcccaattttgaagggatgaattcaacaagaacgattcaataggccaaggcataaagtaacaaattcaatgttggtttggtttgaagccctaccaaaacgttgatagtgtcaaaacctaggcactaccaaatttgacagagtagatttgctaccacctaggaaaaaatcggtcttaatccaaattccaccaaagtattgtcgaagttatcaaaatattaatagaatccaaattagcaccaatccaaatattgccctcatagccatttttttggggttctgctttttatgagcctaataacttgcagcttatctgaacatgtctacataacctgcttacctggattttccacctagtgtgttttcaaggttgctataagttgtcgaagcccacgacacaaagcctattagattcgaggcatgcaaagatatggagctcacagtggtgaccatgcccaaatttatgcccctctgacattgcactctccctagagcactatccattggtcgtggagtactagcgcattgccgtctaccggtaccactggaggacaactaagggagagagagagagagagagagagactagaggtaccattaacaaagatatgcaaaatcatctttaagctcatgtttttcatcactggtgagcttcagtggctatgggcttcactgcaaagcatgcctcctcaccgagtcgcaagctcgtgaccatcgctcatcgggtcgcaccgataggaggacccactaggcagcaaaaaaaaacatccttttgaaatattttaaaatacccttggatcatctcttattgttgatgaccaggtatggctagagaaccaatcatttcagagagccattgaataacccatttttgcaatttgcgtttgtccttggaagttggaagtaaacgcatgtcttcacatttgttcaatactccctccgtcccaaaatgtaagcatttttagctatgaatctggacaacagtgtgtccagattcatagctaaaagttgctatattttaggacggaggtagtttctctttttcaccactcattacgattctttttgttgtgatcatataagatatgtgttgttagctatttaccagtcttgaaaatttgcccatgctatttgtgtggtgagttacaaagttattgtggatacataagtacatactagtaatttgttaaatctagttaaatcacttgccaatactctggaacaatcaagtagtcttcgtgctcgaaacgcttggaaaacatagcccgagcacctgtatcatatcagtctccaaacatatgttacctataaaaaaaaccaatgcaactagtctattttaactcatgttgttattctctagttcttccttcaagcagtctccacgtcgaaagtctctgtcacactatttgcccacaactgttttataagtctgacaattagttgaggccatccatgcagacaaggcgtctaacaagtttggtgtgtagcaaagaatgaatcttcgacctcgtcggctatgagcctatggtgttctcgatgtattgaaagtgtttaatgcttacataaggataactcatttgccacaatgccattgtaggtatgacatataatggccaaggtaagtaagtcgacaataaaaacaattgcataagtgatgtactaacacatgaagaaaaattgaccagccgcatgagagaagcctaatggcaaagtaggataaacttgagggttcttcgatgagtaatatataatttctttccataaaagcacatacaacataagatattttatagaaggaatcttataacataccagtgcatacctttgtgagttgttgcggtaacgtagaaatcatcctaagaacacttgaagagctaggttaagttgagacaatgaaatggtcgatgtagattatttgttctatcaattaataatgaatggatggtcaacatatgtatggttgtgaacttatgatattggagccacatgatgctccctaaaaattaaggtggaatgggttttcatgatatgaaactattcaaccaagcgttattagaacagcagtcctggcgcctattagtttttcctaagagtctttgcactcaaatttttatatccttctggtgacatcattgatacagtttttaattcaacatctccagttacttggaagagcattaaatatggctttgagttattgaaaaaaatgactaatatggaggataagtgatggtgccaaggtgtggatttggtgagatcagtgaatcccaagggtgttggattgaggtgacaggcaagaaagaagatatcaagattaaagtgggtatatcaactcatggctgcagataaaaggaatgggat

SEQ ID NO: 76167 - DNA, 5221 bp, Oryza sativa
ttttcccccttccgttcccctctctcaaccgccgctccgccgtgcctatggccgccgccggcgaccataggggcgcgggcgccgcctcccgccggctgcgccatcgtggccgcctccgggcgcgccgtgtggccgccgcgtggggcccggccgttagccgcccgtgccctcgggtgcggctgacgcgtggggcccacagcgccggccggtgtgagcccgggtgcgcccggtccaccgaggaccatgaggctgccgcgtgggccccactcccgtggacccggtccacgcgccccctcccctcggctgacgcaataaacctttttaaattaaaatttaaatgaagaaattcgcaaatattcacttaaagaacatataaacttcaaatggccataacttggccatttgaacttggaattggaccgttcaaatctttaatttttccttaagaagtcaagaacccatttttgtactttgttcctgcttgttatatggagtttattagagtaaaagcctttttcctttccgttggtcgtgtagacgctgcagcttcggaagatccgctctacgtggaggttgaagccgacatttgggaaagcgagcaaggcaagtcacatcatccttgagcatattaaatccccgtttgtaaaattattttgatttaaattaatgcattatcgctttatttaaattcccgcgttatcactattttatttagtcatgtctatttacctttgttatgaccttattattattgttattgttattattaccttgttcaccctagaataaacaaaaccccgactagtgggtactctaatcatggtaccactagtatgaatttaggtagatgcttcgctgtttaattaggcaacattaggtggttttataactctagactttgggaatattcatatcacttggacattttggaatggttggattattgtggaattggatacacaccttcccctctattcaaaaccctcaaaatggttttaggccgggctcggggtgcatggttttgatagtagcacctcggccacataaggaccggtcttcgggcctctattgcaaagcactaccgtacttccacatgtctagtgggtaaggcttagtttgtggctcagcctggttataaacaaaagtatacggatggagatggatgaagtcgggggtcgatggacatctctaggacaaatgaaggctacacgagctgcggcccggcagtcgagatgtcatggcacagggctagtgtcctgctactaggggctcagtcctgcctacctgtcccggaggttccggccgtaggtggggctgggtcggtactcttgtctatggctaggatgggttgggaactatgtcacgtctttcgtccgtataccgtggtggtatgtggcacgtggttacacgtgagaaaggtgtgtcttgtgggtaaagatgtacacctctgatcaaagtataatctattcgaatagccgcgccctcggttatgggcaagcctagcaatgtacccaagttagtgttttaaattcttaaaacctgcttaacaactaaaatgtggaatggttggcctgggttgacttgggacgagctgggacccagggtcgggttgccagttcggtctgaatcatcgtaggccttgggttaaggcaggttcgtgtgggttcacggccttgattaataatattgtatagctctaggatcgtgtttacaaggtagctttgagcaactaagtgtcttttaatgctgtttactacaaaccctaaccccctatattataactcccttgtactcccttgcatttattctgcacttgtgggtgtgtcttgttgagtacggtggttgtacttagtcttgctcaatttttcccaaacccagaagaggagttcctggaagatgaaggctttggtgtctagctcgtgcctgccatcaagcgcctgtggtcatcgccctagtcttctgttgtttttcgtttgtcttcatgtgtgctgggccttcgccgcccatgtaataaattaactatttacgcttccgcttgttaaactctgtattgtatcaacttttggtgtaccttgcctcctgggacaaggaataatacacgcacgtaaggaacgcccgttgggttatttccggtcgtgacacttatctccttatttgcctagttgtgctatcatgtctcccattgtatgatcacttgtgatatcttgtgtattttcatgtgtattactcttgtttgagacatgttgtacctctctatggtttaggcttccttgtgatttaatttacttgttgtgaggtgcttgaaatagcaattcacaactgcccggaagttcctaggaagaactccggaagttccgggcagctttctctgcttgtgagaaaaagctgccaggaagttccggaccttttgccaggaagttccgggccctgattttaagcgctgcgatttgaagtaaattttaggaacgcctattcatccccccctctaggcgacatcacggcccattcaagccgatcttatctggtttaactatatttgctctatatgcctcgttgacatgttaaatctgccctttatattaagatcttattgcatctaagtatattaaatctgccctttatcttattctgcatccaggattatgtattgttaatatctgtagccgatcaagtagatttagttctttgttatctatttataactgccgatcgatttacatatgacaccgatcggctatcatttatggatttaaccacggtttctttgtctttatttcttgttgattgcaggatcaaatcaactggcacgcttgcacacccgaaggcgagttttggacctgcactggagttaagcagatctcccaggcctcgtgttttatgtcaacagcatactatcttcttagcctcgtacgttgtctcgggcaatttgtttccctccggaagaatgttcttgacaagtttcaataaatcaccaaatgccttgtcactaacaccattttttgccttccattgcaagaactccaaagtggtatccaactttttgtgcccctgctcgcaacctgggtacaacgacgctctgtggtcctataacatccgctccaatttatgggcctccttttcactttcacagtcctcctttgcgtcctgcaacatctgaccaagatcatccgcagcgtcgttatcgccagcatccctgtccacctcacccgtttgatttccttcaaatccagcgtattgagcccagtcaggaatgttctcgtcctccgcttcatcttcttccatttcaaccccttgctcaccgtgggatgtccaataattatagcttggcatgaaccccgactcaaacaagcggaaatgaatagtcctggatgcagaatactccttctggttcttacacttattgcatggacaacaaataaaaccgttccacttgttagcttcggcctctcaaaaaataatgcacgccgtcgataaactctttggaccgccggtcagcgtacatccattgtcgatccatctatatgaaatgaaaaaaaatcgtacataaataaattttcaaacaataatgacagtcaaacaataatgataaagtaattaaaaactctttcgacaagcatacaataatgacatatcattactcatacaattaataattataaaataatccaacaaacaattcttattaacaatttttgaagttctaaactaatattaatgttgtacttctcttaattttcaatttagtttgttttctattttttaagattaattttcatcatattttaatataagaataaaacttttttaagtaaacaaacaaaatttctatatattcttcttccccacacaaattttctctctcgtcaacttacaacaaagttttggagacaaaaaaaatgtgtgaaacatagctccaaaagtaatataacaacaaaaaacattggaggatgaagttactaacattttagacacctccgatttgtatttaatcactaaaaaaatttcacaagaaattttggcatgacctcccctctttctttgagaaattttgaagcttgctcagactagaggaggaataagacatatataaaggggggatttttagtcccggttggtgtacaaaccgggactaaagatcggttggtaacaccaacgggactaaagatctcggggagcctgacaacgtttgacatctttagaaccgggactaaatatcatctttagtcccggtttttaatagaactggaactattgtggatttcggccgaccgaccaaagatggtttctccaccagtgagattccgcctgtaaactgcgagacgaatttattaagcctaattaatccgtcattagcaaatgtttagtgtagcatcacattgtcaaatcatagcgtaattagcctcaaaagattcgtctcgcaatttatatgcaaactatttaattggttttttcgtccacatttaatgctccatgcatgtatctaaatatttgttgtgacagaatttttagaagtttgaagggaaataaacactgcctaagcaaatacacatgccgcaagttgctactgcagtattgccacgtgcatctgtacatgggccctaattgaactcctaagaccaatagcacatgcaagcatgcacaccatgtacttcctcctttctataatgtaactattttttaggttgtcactggtattaaaaaagtatgtgagaatgattggaggaagtatgtgattggttgaaaagagaaagtaggtgaagaagaatggttgtgattggtgagaggagaagctaggtagatgaagaaatagctttattttggaataaggtaatgtgctagaaatagctatattttagaacggaggaagacatggattcataaatggtcactctgaattgacgcttgccaatttctacatcaaggttcttcccatggatagctatagtgcacacctcagggtgacaagatgcattgacggtgatggaaccagatttcgtagacacgaatgcacatatgccccacatcttcaggataaaaggtactagtagcctcaactattgaaaccagacaaataacccctcgactcaatccggagtggttttggatccacgtggcagtgcagtcagcttttttttaaaaaaaaatcagtagaccccacatgccagttctccacccctctctctactggaaaaggatcctctgatttaactgttgtgcagtt

SEQ ID NO: 76168 - DNA, 7071 bp, Oryza sativa
tcttatcggatggcttgtcatggatcgatccaggtccctccttataaacttgtttatgggcatgagactgttttgccatgggaagttcgaatcggctccaggagaacggaattacaaaatgatttaacagccgatgagtattataaccttatggccgatgagagggaagatctagttcagtcacgttttgtgagcccttgcaaaggttactaaagataaagaacgagttgctcggcattacaacaagaagctaatacccaaagattttttggaaggcgaacttgtgtggaaattgattttgccgattggaactcgagatagcaaattcggcaagtggtcgccgaattgggaaggaccgttccaaatttataaagttgtatccaaaggagcttacatgttgcaaggacttgatggagaagtttatggcagagcactaaatggcaaatatttgaagaaatattacccatgtgttcgggttaacgcatgatcggctaatgttgccgatacatgatagcccatgtgtttacatcgccttgagatggtcgatatggttatatcgcccttagatatttttatattgtaatcaattgtgatttgccgatgtacaatagccgatatggttatatcgcccttagatgttttcatattgtaatcggttgtgatttgccgatgtacaatggccgatatggttatatcgtccttagatgttttcatattgtagtcggttgtggtttgtcgacatacaaatggtcgatattgttatatcgcccttagtcgttttgtataattttatcaatgttttttgacattgtaaaattaggggggcacatacatggaaaattgcaaaatttttagcgaatttagaagttatattaattggtcagatcagcaacattcttgatagccgatttgagtctcgctttctgctcttcgatagactttgggagatcggccagctttctatgttccatatccagctcggcattgcattcttcaagttgtgccaagagctcaatcttgcgagtttcgggccgatcaatattggacttaatcggaccctcagatagctgatcaagtttggccttctcttcatgaaaaagctgccgattggcttagattgtggcttcaatatccttgcgctcccgacgttcggctagtcttagcttggccttctccagcttgaattgatgttattcaagatagactgttggagttagaatatcggctagctcatctgggattagagcttggatctcatgtagccgagtcctaattggcccacagtttaccaccaagttgttcagtgacgatgcttccagccgatgagatatgtcttcaagtgttttctttacgtcatcggacaagggaacctattaacgaccaaatttggtaatatcagtatcggagatgaagattagattgaagcgggatcgaagatgaagattgtcgcggaaacagagtaagaatcggctgaagtccggatcggctacgattggatcggccgagttggagttagacttggttaggtgatgcagccgattccaataatacgacttggtgtacgacatcgggttggattgaggtgcttcaagatgattgccacgcatggatagagtcctgggaaggcaattgtatctattaattaggacattttatgtaatatccttagagatatgcttgagcaaaagtctgccgtaaagacttgtggtatcttagagtttgttagagaaaatagtcgtgtccggtatggacatatcttgtaattctcgggtataaatagaccccaagccctatgtaattaaaaaacaacacacacgttcaatacaattttggcgcatcgccacctttttgctttagttttatttcgacgagttctcgctatcgggttgagctgcatcggtttcgatcttcaacaagaggtaaaacttgttatgatggcttgtgttctcgggattagtgcttccatctttatgatactctaatcttgtttacgtaattcgtcgagttatcatatatcgtacataatctctggcaatatcactatctaacctacaatcggctaacatctgttagtagagggcagctgattaggttagattttgatgttgatttagattatataagatatccaccactatatgaaacttccaacggcttgattgtctagatattgttcttcttttcatacttaatgctgcatcagttgagtttgatatattaagtcgtgcttagaatatcaatctctagcatgccttctgattaccgattagggtagtatcggagtttcagccgatcttatctgatttaaccatattcgctctatatgctttagtgacagggtaatatctacagccgatcgagtagtttagttctttattatctatttatagtcaccgatcgattcacatatgacatcggctcaaagataaatgatatatcatcggcacttagccgatcgactatcatttatagatttaaccgcgatctctttgtttctatttcttgttgattgcaggatcaaatcaactggcacgctaacatacccgaaggcgagttttggacctgcattggagttaagcagatctcccaggcctcgtgttttacatcaacacgcttttggcacgcctggtgggactgataagaagtcagcaagcaattcttcctcatggccgagaaaccaccgctgtcgccatcctcggttagtctaggcattgttaaggaaaagatccagaagttgggattgactgacgtcaatgaaggaaatgtcgtgcccattgatccagaaaaattcacacctgatcagaagaaagatttcgacgcgatgatgcagcaggcacgggatcagttcttgaactcattcatgcagactcgcaagggaacattggttcagaagtataaagtaaaggtagttgccgatgatactgggaccagttcttctaaaggtgaagacgggaaacaagctctggacggctcggcgctacagacggttctctaggaggtcaaggtgacaattctcagggagtccatggggttcaaggtgatggggcgcatggagttcaaagtgatggtgctcaggggttgcagggaggaaattttaatcaggatagcaatgcatcacaggaattttttaataacttccaggatcggatcgactatgttgtgcaccatgctttgatcaatcagtctagggtgttagtcaataccttatcaaacatgatgaagtcaatagccgatggttcaatagctgagcatcaggctgcaggcccagtttatttgcaagcaggtgtcttcccaaattatcggcctttgatcaccgatgctcagccatctattcaggcagttccccccattgttccatcagctcagccgacagcgcctgcatcgactcccctatctactccgtcagcgttggcaccaggccagctggtgaaccctcggttattaataagagaacagccacaacatagtgggcaggttgcgaatcggctaatgcaagatgaggttgctgccacgtttctgccacctcaacctactattgatccaatacagcagcagccgattcaatagacacccccgattcaacagattgtacaaccaattcagcagcaggttgtgcaaccagttcagcaaacgccaccaaggcagcagcctccgcggccgattcagcagacaccgttaagacagcaaatcgttcagccgattcagcaccaaggctcaatgagcgcatcggccgggtttgcgacgcctggtggacagcctgtacaacaatatttaaatcaagttgtcccagaacacttggttcaccacgtatagccggatggcacagtaatgcctcaagttgttcccgaacacttggcatgtaatattcagccaaaccttcataattaccagggggacaacttgaattatcaatatcagcctccttccccgcaagcccagtatcagccagggggactggctcaaccccagtttgcgtctcaatacagtctgttcgaacccatgcaacaacattcacaggcagcagttcagcaacgaccgtgggccgatgtcattgccgacgtaatgagggaacaatttgggcttaaaccaaaagagactataagcttgtatcggcagccttaccctgagtgctttgagagagttcctcttcccaatcggttcaaagttccagatttctccaaattttcaggacaagatggtgtgtcaacttatgagcacattagccgacttttagctcagtgttgtaaagcatcggttgtggacgctctgagggttaggttgttccggttatctttgtctggatcggctttgtcttggttttcctctttgccgtatgggtcgatcaatagttgggccgatttggagaagcaattccacagctatttctatagtggggttcatgagatgaaattatctgacttgacggtgattaagcagcggcatgatgaacctatgcacgagtatattcagagattcagggagatgaggaacaaatgcttcagcttgagtttaactgacgcccagttagccaatctggcctttcagggtatgattgctccgattagggagaaattctcgtctaaagactttgatagcttgtcatatctgatacagaaggtaaccttgcacgagcataggtctgtggaagctaggaaatgctctaagaaggttaatcatgtttgtccttacatatatgggtcggatgatgatgaggatgactctgaaatagctacagccgaatgggtgaggagtaagaatgtcatatcgtgccaatgggtaaagagatctggaaaagaagagaggtatgactttgatataaacaaggctgataagatttttgacttgctacttcgagagaagcagattcaacttcctgccggtcacataattccatcggctgaagaattgggcaagaaaaggtattgcaagtggcacaactctgggtctcatatgactaatgattgcaaggtcttcaggcggcagatccaagcggctattgaagggggcaaaattaagtttgacgactctaagaggccgatgaaggttgatggcaatccttttcctgttaatatggtgcatacagctggccgaacagccgatgggggccgtgtaaggggttttcggatgaattcggctaagattatcaacaaatatcagaggaagtataacaagcagtaggagaagcattatgaagcagatgatgatggttttgatcctcattggagttgcgagttctttagattttgttggaatgaaggtatgaggctgccctctcttaaagactgtcctgggtgcagtgatgttgccgagaattcaagccgatcatatggtatgggtagtcggctaaggcagacaagagttcctattcatcaaagatcgggtccagtgaatcaagatcatgaccaagaggacaatgaaatcaggaaaaatcagtggtgtccttctggtattttcacgaagaattagaaaagaagggttcaaagattgaggaacagtgagcgctttcaggaggttgaacaggaaattaaccatcggctgaagaaagcaaagccgaggcaggagtggcgtgttaagaatcaggttcctgtagccgatgaggctgcagccgatgaggcaagaaagttagctaaggggaaaagtgtcgtaactacttcaatcaacatggttttcacatgtcgatgtcgatgaagttgaagaagaatcgggtaaattgattttgtcgccagagcaagcggtttttgagaaactagaggggacagagaatcggcatcttaagccattgtatataaatggttatgtcaatgggaagccgatgtccaagatgatggtcgatagtggggctgcagtgaacttgatgccttacgctacattcagaaagttgggtagaaacgctgaagatctcatcaagacaaacatggtgctcaaagactttggtggcaatccgtcagaaaccaaaggagttttgaatgtggaactgacagtcggcagcaaaactatccctacaacattctttgtcatcgatgggaagggttcctacagcttgttgcttggaagggattgtattcatgccaattgttgtcttccttcgaccatgcatcaatgcttgattcaatggcaaggcgacaggattgagatcgtgccagccgataggtcagtcaacgttgccagtgccgatttagctctttgggagatggatggtcttgattgcttatctggaaaagtttgggatagagattttctaaaagtgtccgattgtgatatacagccaattgaagatggagagcccaaattgttattttgagggcatcgtggagggctcaggagtctacgtcaaggacacggtggatgatctcgatgacaaggaaggacaaggttttatgtcggccggtgatttggaacaagttgatataggtccaggtgatcgaccaaggccgacgtttattagtaagaatttatctgcataatttagaaccaagttgatagagctgttgaaaaattcaaagattgcttcgcttggaaatattatgagatgcctggactcaaccgatcgattgtagaacatcggctacctatcaaaccggggttaggccacaccagcaacctctgaggagatgtaaggccgatatgcttgaacctgtcaaagctgaaattgaacgattgtatgatgctggttttattcgtccttgccgatacgctgaatgggtttctagtatagttcctgttattaagaagactggcaaggtcaaggtgtgcattgatttccgagatttgaataaaactacaccaaaggatgaatacccaatgccagtggccgatcagctagttgacgccgcgtcaggaaacaaaattttgagttttatggatggaaataatcaaatctttatggctgaagaagatatccataagacagcttttagatgtcctggtggaatcggcttatttgaatgggttgttatgactttcggtttgaagagtgctggagctacatatcaaagagccattaattacatatatcatgatctaatcggctggttggttgaagtctacattgatgatgtggttgtgaaatct

SEQ ID NO: 76169 - DNA, 1774 bp, Oryza sativa
ctcggtgatggcagaggtggccaatgtgggaacaaagtcgtccatcaataacaatgaagacaccagtcggcggtgacgaaggcggtcgacggtgaaagcgaagatgcccactaatggcggcataataggccagccctgtaggcggagataccaatcggcggcggcaaaagcaagccggtcggtgaagacgtggacacccatgaacggtggtgtgaccaaccaaccgtataggcgaggacaccagccgtgcaggcggagacaccagtcggcggcgacgaaggcaagccggtcggtgaagatgtagacactcatgaacggtggtgtgaccaaccaaccgtataggcgaggacaccagccgtgcaggcggagacaccagtcggcggcgacgaaggcaagccggtcggtgaagatgtagacgcccaacaacggcggcataataggccagtcgtgcaggcagaggcactagtcggcggcggcgaaggcaagccggtcggtgaagacgtagatgcctaacaaacggcggcataataggccagccgtgcaggcgaagacatcagttggcagcgacgggggcaggccggcggtgaagtcgtagacgcccaacagtggcggcataataggccagccgtgtaggcggaggcaccaatcggcggcgacggaggcaggccggcggtgaagtcgtagacgcctaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggcggtgaagacgtagacgcccaacactggtggtgtgaccaaccaaccatataggcgaagacaccagtcggcggcgacggaggcaggccggcggtgaagtcgtagacgcccaacagcggcggcataataggccagccgtgtaggcggaggcaccaatcggcgatggtgaaggcaagccagcagtgatgatgaagatgcccatcaacggtggaggtgacgtacccgacgacaaataaaacgggtcctctgcgtcgaactatggtaggtgcaggtcattgccgtggccgtgtatatcatccgcacggctcaacctcaatccaaccaatatatgcaaacacagaaacaccaggaagagttgattagcgatcaaaaatataaatgcttaatatctcatatgcatggcatgattagatgaattgtgcacgttgatccatgcacgtgttttgatggcatgattttgctagccacgggagctgataaggccgtgtcaattgcttgtcgatcaaatgctggtgctttttctttgcccgagtcacagcaaggctgaaagcttgacgatccatgatcggactcgccaacaatcgacattaaacagaagacaaaggaaagtcaggcattaacccgtgattagtcatcaagaataaaatattgataatcaatatagaccagaaggattaaattaaccagggaagggaaaaacagactcggactaatccggtcagtatatccatccggtggcttacgcggccttcaacatcagacacccggtgggtgaggttcgcacgacatctgcccagctagttggctcggtttcgccgactcgacctcccggtgacatgtctatgtgaattaaatcccggtcgccggcagtcccgagtgcaatcaacaacaattgatccgatgttctggttgctggtcgtctcgatct

SEQ ID NO: 76170 - DNA, 13102 bp, Oryza sativa
cggttgaaatggtgccatggactttattctttgatggatcggtatgtactcatggttgtggtatcggcctagttataatttcccctaggggggcatgtttcgagtttgcttatactattaagccttacgcgactaataatcaagctgagtatgaagcagtgctcaaagggttgcagttactcaaggaagttgaagccgatgctattgaaatcatgggggattctttgctagtaatcagtcagttggcaggagaatacgaatgcaagaatgatacgttaatggtttataatgagaagtgccaagaattgatgaaggaatttcagctggttactttgaagcatgtatctcgagaacaaaatattaaagctaatgatttggcccaaggggcatcggggtataagccgatgatcaaagatgttaaggttgaaattgcagctatgacagccgatgattggaggtatgatgtgcaccagtatttacggaatccatctcaatcggcttctaggaaattgcgatataaggcgttgaagtacactctattggatgatgagctttactatcggacgattgatggggtgttgctcaagtgtttgagtgccgattaggctaaagttgcaatcggcgaagtccatgagggaatttgtggcactcatcaatcggctcttaagatgaagtggttgcttcggcgtgcggggtatttttggccgacaatgctggaggattgtttcagatattacaaaggatgtcaggattgccaaaaatttcgagcaatacaaagggcaccagcatcggctatgaatcctatcattaaaccatggccgttagaggttgggagattgatatgatcagtatgataaatccgccatcgagtaaaggacataagtttatattggtggcgactgattatttcaccaaatgggtagaggcgattcctttgaagaaagttgattctggggacgctatacaatttgttcaagaacatataatttatcgatttggtattcctcaaaccattacaaccgatcaaggttcgattttcgtgtccgatgaatttgttcagtttgtcgatagcgtgggtatcaaatttttgaattcttcaccatattatgcacaagctaatgggtatgctgaggcatctaacaagagcttgataaaattgattaagaggaaaatttctgattatcctcggcagtggcatactcgtttagctgaagcgttgtggtcttatcggatggcttgtcatggttcaattcaagttcctccttataagcttgtttatggacatgaagccgttttgccatgggaagttagaatcggctccagaaggatagaattgcaagacgatttgacggccgatgagtattataaccttatggctgatgaaagggaggacttggttcaatcgcgtttacgagcccttgctaaggttaccaaagataaggaatgtgttgctaggcattataacaagaaagtggtgtccaaaactttttcggaaggtgaatttgtatggaagttgattttgccgattggaacttgggataacaagttcggcaagtggtcaccaaattgggaagaaccgtttcaaatctataaggttgtgtctaaaggggcatatatattgcaagggcttgatggtgaagtctatggacgagcgctcaatggcaaatacttgaagaaatatttcccaagtgtttgggttaacgcatgatcggctagtgttggcgatgcatgatagccgatgtgtttgcatcgccttgagatggccgatattgctatatcgcctttagttgtttttgtaatcggttgtgagttaccgatgtacaatggccgatattgctatatcgcccttagttgtttttgtattgtaatcggttgtgagttaccgatgtacagtggccgatattgttatatcgcccttagttcacaatataattttatcaatgcctatgacactgtaaaattaggggggcatatatatccacaacaagttgcaaaatttttgagcaaatttggaagttttattaattggcgcaaaggattgtcaagataaacattagaagtatctttaccgatcacaaaattcctaaggtctattacatagaaagttattgagatagatagctctggatagccaatatagcttttcgcctaatttgttctacttcttcaatggcttgagcatcttgagcgtcggttccagggataactttcagagacttggtcagatcagcgacattcttgatagccgattttagtcttgccttctgtccttcgacaacttgtgagagatcggctagcttcttgtgctccagatccagctcggcgttgcattcttgaagttgtgccaagagctcaatcttgcgagattcgagccgatcaatattggctttgatcgggccgtcagataacagatcaagcttggccttctcttcatgaacaagctgccgatttgcctggattgtggctaatctctgcttggccttctccagcttgaatcggtgttgttcaaggtagacagctggagtgagggcatcggctagctcatctgagagtagagcttggatatctgcaaaccttgcgctgatagaaccacagttagtcaccaagttgtctaatgatgcctctagccgatgggagatatcctcaagagtttttttcacatcatcggacaagggagctagagctttgctagtggtatcagtttctgtttcttcatcaagatagtctttgatatcaaatgagaacagatcggctaatacctgtagaagagaaaactgaagacaattatagatcagattgcatggtacagccgattgaaaaccttttgaaggtgatacttactgggatgttaggaacagcaggttgttcttcttcctcaacattgtgactatctgcagccgatggagtacaatcacttgatattcgttgcacaggagatgaagagggaggaggtggctgcaaaagaataaagtattatggaaggttgtccataagaaaaggatttatatgataatcttactggaggctggtttaaaggttgttgcagccaatttcttcctcacagcggtcttctttttttgcaaatgcaagatcaatgagtgatcggctaggaaggaacatgactgctagaggggatcaatgtaagtggtttaccctagaaaagtgagctggatcagaaggagtcggaggagttcgcttgggagaagccgatagagttcttgctatgtcactcacctcggctgcagcttgatcaacatcttcttcgatctgtttttcatccagagcttgatcaatggatggatctagggcaggcagatcatcagctagcttggttttcttcggcttggtttttcttctttggtgcctgagccgatggatttatagccgatgacctagtttttctcttcttgccgacgtcggctggttttctgatgagcccttgaaggagagttgaagtcctgggggcattatagccaataacaggaggagatggtccacccccgtttggaatcagccccagggcatactcaatatttctgccactattgctctggcgaggaggagagaactctgttgtctacaaattaaaaggaaaattagtcaagattagtcggctaaacaattattcagatgaaattaagtaaatcaagacatgcctgagggacaacatctggaaagaggtccgtcatgtacatagaagccaattgatggaataggtgcaatttccattcaccccaccatctgtcaaatgctttgctcctaaaggttgccagctctatgttgtcaatgttgcctagagggggtccttggagatttagcagccgatccatcattaaggttgatgaaatttcccctcggcactggatcttatcggcaaagaataagccgattgggagttggcccattcctagttgtctgcctgagctcattgggtgataaaactcataagaaacctggatgtttcttccttgattaatgccaacagggaggatacatggactgattgcagctgagaagatttctctgggtttctgatatttttcgtgattgatatcttcgaacctaaagtccaatggattctccagaagtgttgaatcttcgtagtggaaccaaactcgagtgtctttttggaaaccctcataaaaactacagaactagtccttgagcagctcagccgatagctttgctcctacatcggctggtgtggaggcatattctccgtatgatgcgcacctacgatgagtgtgttcttctccatcatcatctacagttggttccagtcttgggaatttggcttctgttatagatggccgattgataaacttcataactactagattcagccaagactgcaatagccaccatggtccacctgctccgactactgagccgacggccagcttagctgatatattgtgtagcatttggtacaaatagccgaggaggattttgcctaaaggaaattgtctctttgtctccaaggcttcggctacgaactgctagttggttgtagggccacagcttgatccacaaaagaggaatttttctagccacattagcagaaaagctacatgttctcgaggagtgacagaaccttggcccatatatgctgctacatagcctgaccagccacctatgctcttggtcctgaagtcatattgcttcttcgtgttcaagctcatagggttagccgatgaggtgacgtccagacccgtaatcattatgatatctatgagagttggagtcatcggcgcttgattgaacaagaaggcattgatggtgttggaccaaaaataggaggcagctgccattaggggctcgtctttagctgagttggctatggtgagatcaactgcttggccgattctgatttcatcccaatgaactcttttgctagccgacatgcgtttgaaccatgtgatccaacttttctcgggtgaggttttcttgagagatggccaggatttgaaagtgtttctccagtgacctaaatctgggttggtcagtctgaaaggaatcctattggttttgccaataacgaactcggtgggatcagggttgccaactgggcagagaaagtagtaatttgcgtgcgacaggttgggaattgcaactaggtatgagagatgctgcgaatccaaaagaaccaagaaggggaaaacaagataaggtgttggaagatcggtctgatgctgagaaaggggatctagccgatgggaacttacctcagcgtactcagctgacggcacggcaggcgggctagtggaagaagacatcgtcgcgggtggagatatggccggagatgaagtcgcctggggatcgccttgtgcgtcagagaaatcgccggagaagaagactacaaggttggcttcagcggtgaaaatggaagtaacgggataaatatttttcaggacagcagttagtatttaaagcactgaggataacggtcggaaaacggcggagtgcgaaacttgctcggagtcgatatgcggcaaatccgaaacattaccgaatattccggacttggggggcatgtgttaacgaccaaatttggtaatatcagtatcggagatgaagattagattgaagcgggatcgaagatgaagattgtcacggaaacagagtaagaatcggctgaagtccggatcggctacgattggatcggctgagttggagtcagacttggttaggtgatgcagccgattccaacaatacaacttggtgtacgacatcgggttgggttgaggtgcttcaagatgattgccacgcatggatagagtcctgggaaggcaattgtatctattaattaggacattttatgtaatttccttagagatatgctcgggcaaaagtctgccgtaaagacttgtggtatcttagagtttgttagagataatagtcgtgtccggtatggacacatcttgtaattcttgggtataaatagaccccaagccctatgtaaaaaaaacacacacgttcaatacaatttcggcgcatcaccacctttttgctttagttttattttgacgagttcttgctttcgggttgagctgcatcggtttcaatcttcaacaagaggtaaaacttgttatgatggcttgtgttctcgggattagtgcttccatctttatgatattctaatcttgtttacgtaattcgtcgagttatcatatatcgtacgtaatctctggcaatatcactatctaacctacaatcggctaacatctgttagtagagggcagccgattaggttagattttgatgttgatttagattatataagatatctaccactctatgaaacttccagcggcttgattgtctagatattgttcttcttttcatacttaatgctgcatcagttgagtttgatctattaagtcgttcttagaatatcaatctctagcctgccttctggttgccgattagggtagtatcggagtttcagccgatattatctgatttaaccatattcgctctatatgcttcagtgacatgttaaatccgccctttatgtcaggatcttattgcatttaagcatattaagcttttgtttgatatattatacttgttttagtatcctgatatagagtagtatcggagtattagccgatacatgctagatctatatgatcggctatgctataaacatatatagtcctgttattaatatatatttcgatccaagtgatttatactgtctcggcatggtaaccgatctatcccaattacttgatttaaatatatatatcgatatgagaactatatattggtaatatctacagccgatcgagtaggtttagttctttattatctatttatagtcgtcgatcgattcacatatgacatcagctcaaagataaatgatatatcatcggcacttagtcaatcggccatcatttatagatttaaccacgatctctttgtttctatttattgttgattgcaggatcaaatcaactggcacgctaacatacccaaagacgagttttggacctgcactggagttaagctgatctcccaggcctcgtgttttacatcaacagaaccaaagatttgttggtagtgtcttcttctgtttcttcatcaagataatctctaatgtcaaaagagaagagatcagctaaaacctgcagaaacaatttatggaagattgagagctaagtagatatagtcgatctaatcttttgcatcaggaggaaacttactgggatagcaggagcagttggttgtacttcttcctcaatatgatgactccccacagccgatggagttcggtcactcgacgattgttgtacaggggaagaaggaggaagttgtaaaagagacaagtgttatacaaaatcggctgaaatcaactagtaaatttaagaataacttactggtggagctggattgaaaattggtgctgccgatttcttctttacagcaattttcttcttctgcagctacaaagtatatgagtaatcggccgaaaagtgaaataattacaaaagagattgaagggagctgcttactcttaagagatgagtgggggcagaaggagttgaaggtgtttgcttgggtgaagccgatggtgttctttctgtgtcactcacttcggctcaacctgatcaacatcatcctcaatgtcttcttcatccagagcttgctcaatagatggatccaggacaagcagatcatcggttggtttaggtttcttgagtttggccttcttctttgaggctagagttaatgtatctgcagccgatgacctagttcttctcttcttacctgtatcggctggttctctgatgagcccttgaagaagagttgaggtcttgggggcattatagccaatgacaggaggggatggtccacctccattaggaattaaacctggggcatattggatatttataccactattgctttgatgtggaggggaagattctgttgtctgcaaaacaggaacaaaagattagtcaagtaatgaatcggctgacagttatgcagtttagtaatgacaaagtttacctggggtatgacattagggaatagatctgtcatgtacattgaggccgattgatgaaatagatgcagcttccattcaccccaccatctgtcaaagtttctgctcttgaatcctgccaattcgatattttcaatacaacccagaggaggtccttggaggttaagcagccaatccatcatcagagttgatgagatttctcctcggcactggatcttgtcggcaaagaataagccgattgggagttggcctaatccaagttgtttggttgaactcattgggtgatagaattcgtaggagacttggatatttctcccttggtggatgccgacgggtaagatgcatgggctgattgcagttgagagaacttccctggccttttggtatctttcatgattaatatcctcaaacctaaagtctgatggaagctcaagatctgctgagtcttcataagggaaccaaacccaggcatctttttgaaaaccttcataaaagctgcaaaaccagtccttgagcagctcagccgacagctttgctccagcatcggttggtgtggatgcatattctccatatgacatgcatctgcgatgagtgcgttcttctccatcatcttccacaatcggctctggcatcggaaattcagcttctgtcaccgatggcccgattgacaactttcatgaccatcagacttaaccaggtctgcagcagccaccatggtccacctgccctaactactgagccgacggctatcttggctgatgcattattcaacatttggtatagatagccgaggagattttgcccaagggaaattgtatctttgattctaaggcttcggctacaaattgccagttggtcataaggccgcaactggatccacagaaaagaaatgtttccagccacatgagtaaaaaggccacatgttctcgaggagtaacagatccttggcccatatatgctgccacatagccagaccaaccacctatgctttttgtccagaagtcgaattgattcttagtgttcatactcataggattagccgatgaagttacatctaaatcggtgatcatggtaatgtcgatcaaagttggagtcatcggcccttggctgaacaacaaggcattgatggtgttggaccagaaataggtggcggcagccatcagaggttcgtcattagcagaattggctatggtgagggcaagcgcttggccgatcccaatctcatcccagtgaactttcttactagccgatacgcgctggtaccatatggtccaactcttctcaggggtgattttctcaagagatggccaagacttgaaagtattctccagtgacccagattagagttggctaatctaaaggggattctgttggtttcacccatgataaaattagtgggggtcaagattgccgattggaccaagaaagtagtggttttcatgtgacgggctgggaatagcaactaagttggaaaggtgctgcaaatccaaaggaatcgggaagatgagaaaaggggaaatcgatttcatgcgaggaaaagggatctagccggtgagaacttacctcagcgtactcggccgatggcgcggtagacgggctagcggaagacaacatcgccacgggcggaggtctaactggagatgaaatcgcttggggatcgcctcgagcgtcggagaaatcgccggggagagaaaggagaaggttggcttcgacggtgaaaacagaagtaacggggtgaagatttttcagggccgcggttagtatttaaagcgctggggataacggtcggaaaacggcaaagtgcgaaactcgctcggagacgatttacagcaaatccgaaacattaccaaatattccgaacatggggggcatgtgttaacgaccaaatttggtaatatcagcatcggaaaagaggattagatcaaagtggagtcgaaggcggagattgattcgagaatagaacaagaatcggctggagtccagatcggctacgatcaggatcggctgggtcgagttagattgggtaagccgatacagccgattccgacaatacgacttggtgtacgacatcgggttgagttgatatgcttcaagatgattgccgcacatggatagagtcctgagaagacaattgtatctattaattaggatgttttatgtaatttccttagagatatgtttagggcaaaagtctgccgtaaagacttatggtatcttaaagtttgttagagataagagttcgacatggacatagtttgtaattttcgggtataaatagaccccgaaccccatgtaatcaattaacacacacattcaatacaatttcggcgcatcgccacccttttgctttagttttatttcaacgagttcttgctttcaggttgagctgcatcggtttcgatcttcaacaagaggtaaaacttgttatgatggcttgcattctcgggattagtgcttacatctttatgatactctaatcttgtttatgtaattcgtcgagttatcatatatcttacataatctctggcaatatcgttatctaacctgcaatcggccaacatctatcggtagagggcagccgattaggttagacatggacgttgatttagattatataagatatctaccactctatgaaacttccagtggcttgattgtctagatattgttcttcttttcatacttaatgctgcatcagttgagtttgatctattaagtcgtgcttagaatatcaagctctagcctgcctcctggttgccgattacggtagtatcggagtttcagccgtgaaagatctatgtagtagagttgccttgtaaggggagattggaatatctatgatcctaagagtgcggtgattgttttggtgattaatgacaacccagtgttggaactaactatttccatgagttggtgagattaggttaagttccggcatcaagttaaaagattgaagctagaagatggacattataccttgatgacgagcaagtgaagacattgatgatgcggggtatgaagtggctatctatggcaaaacggtgaagggcaagcaaggctcggctacagtggaccatggggggtgaagagcaagaaagaggcttggcgccgatggaccaaatccggtggtgaagggcgagtaaaggctttgtcgtgatggaccgtccgaggccatttgaagctatgagtaatccgtatcaattattagaagaccacaagatggaatgccgaagatcaagaggatgtggttctccaatgaacatcaagtcaaaagccaaagtgggtattgatcaaggcaaaggtataattgatttgggactaatatgcttaatgagtgtaggttgcttaggagtgggctaggatgcttggagaccccccaaaacatcaaaatcaaagcggcgagaagactcggagccgagttagactagtttactttttcgctttgagtttaggaaaaaaccatactattaagaggggttccaagtgtggttctgagataacacaagtgctcttggtggtgtccaagtgttgaaatatttttaggagctgcttttgaaaatggctctactcgggacagagagtcccacccggaggttttgtccggaacttcctggcaccgaggtgaggttgaaaaatttcctaagtgctgcccggaagttcctggcacttttacccggaacctcctggcaggtttccagttcaaacttgtgagtaacggctagatgacgtcacctagccgttatatatatggatctcgtccccagatccccctttggccattccactttagttcttgtgttccctagcttcttctagcctctcccaatgtgattttgcttccaccacccaaatcttgtgtatttcttgagtgagagagtgattttgagggtggtggtcaggattggagaaggttttgaaggctaggatgacttgagcacttggggtatctcgttgggctgtcatttggagcttgttactcttggagggtgacctcctagacggttaggtgtcgcccgcgagtttccaacaaggttgtggattgactcgggcaagtttgtgagggcgttattccacctccgaaaggaaacggaatacacggtgagtgaattccgagctgaggtttaggaggtcgtcttggtagagcaagcctcacttgtgctgttctcttggtgttcaagttggggatcttagtggtcacttgaaaccaaagagaagtacctaagggtgttggcttgaataccggagacctcttcctaggcctttgcttggtgaggcaaagggttaatcaagacctggctctttggagctcctcaacagagacgtaggattctcggtggagaatacgaacttcgggaaacaaatcttttgactcctctcactctctttacctttgtgattgtgatgcttattgtcacgtcccaaaatgaccctaaaatatatcctttaaaattatgcctagaataattaaaatccttgtgaaagcctccaaaaattaaaatgtgcactgttaaaagtcaaataaggcttggaggatttttgtataattcctaaaagcctaacatgtgtaaataaattttagtggaattttcagagcacaaataataattattaagaaataaacaaagttgaaaaggttttataaaaagaaaaaccctaaaaacccctctcccctctaatgggccggctcggcccatctcccttcccctctctctcctctaccccgcggcccactcggcctctccccgcgcgcgcgccgctgatgggcgggcccgcccgccaccctcgctgacgggtggggcccacccgtcatccccgtcctcccgctgctcccgacgccccgcccgcgccaagcgccgccgccgccgccgaatccgccgcatcccgccgcccccgcgtgcaattaagtggggggaattattccccgtgatcccctccccctttccccccatttttccctctctctctcgctttcaaacggccggatttgctcccgcaaatctcgccggcgccattgatggcggccggacctcccgcgccggtttcctttcccgccggccgccctttttcccttccaaccctatttaaaccctt

SEQ ID NO: 76171 - DNA, 17495 bp, Oryza sativa
cgctgacaagcttttagttatttcaatcgggcataatattgaggccatcactgatgacaaccatccgtgatgggcctgattgttatctttatcggaccttaattagagctcgtcaccgatggatgttatcagtgacgggcaaagtatatgggtccgattgagattacaaagataatctttgtcgggcctaaactaaagcccatcaccgataggatctcatcggcgacgggctcaaaatacatgcaccggtatatctttctacgcgtacatctttgtcggtgtttattttagcccgttagagataaggatattgtgacggtacgcaagccctaggcacgggaaaggccgttacaaataagaagtaatgtagtagtgacaacaataaatcgatcttagggcttgtttggtttggtgccaaattgtgccctaccaattcattggtaattttgaatagtacttctatatgtctggattggtgccaaattttaccaacaccagttcttaggtagtacaaaatttgtctatccaaatttggtagtgccaaaagttacctaaactttggtactatcaagattttagtagggcaccaaaccaaactggcccttagtgacctgaggcttgttccacactcttcacgttaaggttatacattagttcagaattaaggatgccaagatcaagagatgcgaggtacagagaatcggtgtgtcatgggggctggtggggccgacagaatctttcgagcgatgacctcaaacatgtttgcgttcccatctgctggatttctacaacgaacggagtttacggagagattgatacgtacgaatccgattgtaacctgagagaagatcgatacatgtacgtatacattggatgggctcatacggtacattggatcggctgagaagcggcccaatctattttaacacaggttctcaatacataacatctatggtgattacgatatgacacactagctcaatcaatggtcagatctctattagtattgtcgaaacaagatttcgacaatactaaaaggggtggctatcaagctaagaaagtggatgggtttggagacaaagaattttatataggttcaggccttcttattcaagaagtaacaccctactcctgtccggggatgattccgccgagtgtattattgattgtatgatctgggaaaaaaaatcgtcccgaaaggaacccggacacctccttatataggggaaggggtccgtattacaaaatacagtccatatccctaacggaatatgtgattacagatagaatacaattgtaaccgactaagacctcgggtatttccttgacatacaagttagaaaactaccccgagtcctcataaagatattctatctatatttggtaccatatacccaactaaattataactgtcgtgtagatatgggatatccataatctccacagtagcccccgagaccttcgcagatgacgaaatagccttctcaaaacaaaaatttataatccgagtgcttcaattcaagctgatccagcttgccgagtgctaaaatcaaagactgcgaagggcgaaaataaaacatggtgcatcgagtagatgcacctaattaagtgtagccccccgactatgtgattagttgaaaaactaaacatgtagtcaagaaccgagtggtttcatagcgaagcatgcatggtactcagtaaaatacccagccgactgcttctcaacttgaacatatcaagaataaaaaatacgaaaagggccgagtgataaacactcaaatggtccaaaaatagacatatttgataggaatccgagtaaaaaactcttaaaatgatccaccaaacatgataaaaatcatggtaatcaacgagtctaatagtctaagccatgactctcaccataaccaaattaagcatgtatcatgccaagagaatgactcttaataaattagtcatcccgaatcaacccaaacagcttttgcagcctaataaggcttacaaaaatagtataacaccttcctgtcgggcacctttttgtttgcatcgtgttaattccaaagaattatcaaaccgcattaaaaaggattttaacagcattgggccacatcattgcgagcacaaattgccaaagcaaaagcgtctaagtccctagggatcacaacgggccacgctgaaaataaaagtgggctgaagtactatgtttaggcccaagcccattagtactcccgataccctaataacaccgaagagaaataaaacgtctcttcgtcttccccgccgagactctcgccattttccccatttcctgctactgtacaaaactgcgccggcaaagctagggttcatcaatccgctccaacccatcctcaaaaactccacgaaatctctctacgcgcccacttctccgattcctcatccctttccagccatatctcggaccaaatcagaccatccagttcacattcatggcggaagagagagaaagctacgagagtcaatgggcgccctccgatgtgacggaagagaatctgaaggagatggtggcgcacggccttcttccagcgaaggagatcatcgggtggcgtccggcgtttggcgaagcattcccgacccccgatacgcacgaagtcgtggtatttgctcatttcttctatggcgggttttcccttccaacctcaagatttttccggggaattctaaatatctatggaatcagcctgcatcatctaaacccaaactccatagtccacattgccaactttattcatgcctgcgaagcttttctaggcattaggccacatttcgccttgttccgccgcatctttttcctcaagcctcagccaaacaagaacaaactatgtgttgttgggggggctaatttccaactcaggggaaccttgagccaaaaatatttctctatgcccttcaaaacctcaaacaaaggctggcacgcaaattggttttatgttcaaaatcctgagcctactcttcccgagtactcctgtcttcctccagtttatcaggacacttggaactcactgccaatgggagatgaagctgctcaggcagtggaactgatggagcggatgataaaactaaaagagcaaggtcttcaaggagaacagatcacccgacactttattaagagtcggttagctccaatcaaagaaagatctcgcacagccttcgagtttgacggcaagcatgacccaaaccgtgaagatccagattctctcgactttaaggtcatgaaagaaagcatgtataaaatcttttcaaatgccatcgttgtcagctattcgcacttgctaccagtcgtgccattcaatgctttcaatcctcctccaccggtatgtaatcaaacatttcaacctttcacaaaatatagttttgtctttttgttgaatcaattaacaatgaaggatattacacccaggaatttgctttgatgaagtcggatcccccagtcgttcaacgccgatcaccccaccaccaaaccggttgagggagcgggggtcccaagatccgttctgaagaccggccaaatacctccaatccagccggccagccagattcacgcaaaaggaagttggtgtcaagtgacgacgaaagcgatactgctagaaagcctggagaccgagaggcaaccaagaaactgccgaagcaggctactccaaggaaaaaaacatccagtcgtcctatgctgaagattaggaagtcttccaggtacaaatcatataacagtctcccttgcattgatgcgcacccagtgcggaaataatactgataaccaaacttgcaggaaaccatccgatatagatccttctggaaaagactctgacccgaccaacataggaacaaacttaaaagaaaccgagccaactgctgaggatcagccgagtgacaaccagccagtaaccgataatgtaggatctggtgatcaacccccgactggaaacgagtcggccgaagctggagccggaattaatcaggagcccctgattgaaaaccagtcggacactaggccaagccaagagattccagaagttggagctcgggcagacagcccttgtagacaagacgccagcaacgacccgatgccagggtcccccgttaaggcgcaagagtcgactcgtccccgtccggaaatcatcacaggtaaacaccttgcctaaaaccgtgttgatccaaatgactctgatcaattgtctaacctttgtcaatggatacgttaggaccaatgactggtgatgaagaagaaattccccatatacaagcagctgaagactcgcgccctcccatcctagtcaagtggtgggacgatgataggcaacctcaagaaatcgtaataaacaaacaaaaagaagatgaggaagtatgcttgctgaaaaaggcactcaacgaggctactcgcgttgtaaatgtaagtccattcatgcatagccttaattgtcccctttcatgttttgctgaaacgccagtaaattcatattacagagaatccatctcaggaatgaggcgaagaccgcaactcttgagaaattagtccctcatcttggaactcttgaagctactagaagccagctacatgaggttagagagttcgcgaggaaaactgagcatgatctgaggaatagaatctccgagcttcaagaatctaactatgaattaagtgattcatccaaaggtaaatgccatatctgtctgacgtattcgtgaagccttccttgccatatcgattaaccgaaaagcatttcagtgcaagccgccaggatttccgacctagagaagcaggtcgaggctctggagaaggacaaggccgaactagcaaagcagagggacttggccttaaaagatattgaaggtaatgataactgattccccatgttcttatagccacctggttatacgaatttattcgtgcagatcgcaaaatcaagtcccaggcacagtttcaataggcttaaaggggccagggataaagtcgctaatgccgctaccccactcatccaagccatgttcttcaataacgccggtccgagtacacttgacgcttccgagatcttcgacaagctgagagtcgctccggatacttacttcaagaatatcaaggaggctggaagtatgggagcaagcatggcattagctatgaccaaatctttataccccaaaatcgatattgacgccgttgatgggtttgcagacgggacaagcgaagaaatagccttcaacctcatcaatgatgcgcgaaaagccgctgacaagatcgctgctgacgtagttgagagattccaagatgttgaccttcggccgactgggtctgataattccgatgatgaagaaactgactctgattagtagcagtgattctgatgataatggaagatcaatttgtacaatactgatgaatttatgatgtgctagatatttcaaacttagcttctgatttcttaaaagcttttgtcaaaccttattgagcctaaaactcgcaaaagttattaaaaaactttcagtcctcattatctaagccaaaaaatcaagcagggcaatgataaatcaagtaagcaaattgaattgataaaaatcatgttccattattattatagtagccccccgactgaaaacttcaaggaaaaactagaagttagcagtcaaagaggaaagattcaaacgaaatgcctaagcataaaatcgatgaaggtgtttaatattccaagaattgttgacaagagtaccatcttcatgcttgagtcggtaagaacctggccgagtgactttagcgattatgaacggtccttcccacaagggagataacttatgccgatcctgtgtagtttgaattctcctcagaaccaggtcgccgactaaaaaggctcgcgatcgaacattccgattatgataacggcgcaacccttgtaaataccgagccgactggattagggctgcttcacgggcttcttccagtcggttgatatcatccactcgatcttcttcatagcgctcctcccggaagttacgaaatcggagggattcaaactctacctcacttggcagcattgcttccgcgccataaaccaagaagaacggcgactggccagtagcccgactgggagtggtgcgtagagaccaaagtacagacggcagctgttctacccacttgccagcataggggcgcagtcggtcgaaaactcgtgctttgatcccttgaagtaccatgccattggcgcgctcaacttgtccgttactcatggggtgtgccacagaggcataacaaattttaatgccaaagtcttcacaaaaatctttaaatactccgccggtaaattgagtgccgttatcagtaatgatacgattcggtaccccaaaccgatgtacaatattgatgaagaaatctctagctttgcctggagtgattgtgacgatcggtttggcttcaatccacttggaaaacttatccacagctacaaagagatgagtataacccccgactgcctttttgaatggaccgaccatatcaagcccccaaaccgcgaatggccaagacaacgggatggtttgcaactcctgagctggtaagtgagtttgttgggcaaagaattgacaaccctcgcatgttcgcacaattttgtcggcgtcggaaacagctgtgggccagaagaaaccctgccgataagccttgccaacaatggttcatgcagcagcgtggttaccacaaatgcctgaatgaatatcttttaacaattgtcttccctcttccaaagatacacagcgttgcaggattcctaatggactttttttgtacaattcggtctcgtggatgacatagagtctgctgcgcctggaaatctgctcggcttcatttttttctcgagggagttcttgtttggtcaaaaatcttatgaaaggttctctccagtcggcttcgatcatgcctacgccttgagtatccatggcttcaattgtttcttttctgggcacggttggtttataaagatactcaacgaacacatcagagggagctgcttcccgttttgaaccaaaattggccaatctgtctgctgcctcattattgtgtcgaaggacatgggtgagctcaagtccatcgaatttatcttccaacttgcgtacctcttgtcgataagcggtcatattatcatctagacaggaccattctttcatgacttgattaacaaccaactgagaatctccacgaacgattagttggcgaatgcctaaagagatggcaatccttaatccatggagcagcgcctcgtattccgccacgttatgggatgcaaaaaaatgtatctgcaatacgtagctcaatctttctccagtcggggaaattaagacaaccctagcttcagcgcccgtaagcctctttgacccatcaaaatgaatagtccaatattccatcttttcctttggcgtgtattcttggcactcggtccactcggcgaggaaatcagctaaagcttgtgacttgatcgaagttcatggcttgaaagatatgtccaaagacatcaattctcaggcccacttcgcaatccgtccatttgcgtcgcggttatgaagtatatccccgagtggaaacgatgtgaccaccgtgaccgagtgactttgaaaatagtgagataatttcctgacggtaattaagacaccatataataacttttgaacctgaggatatcttgtcttggagtcagccaaaacctcgctaacgaaataaattggtcgttgaacttttcgaatatggccttcctcttcacgctcgacaaccaggaccgtgctcacaacctgggaggtccccgacacatataatagtagcggctcttgcgaatgtggtgaggccaaaactggtggagtagtgagaagtttcttgaagtcttcaaaggctttttgtgcttcgggtccccactggaaattgtcagttttcttcaacaacttgaaaaaaggcatccctcgttcgccgagtcgcgaaacgaaccagctgagcgccgccatgcaaccagttagcttttggacatctttctgggagctcagcggtttcatgttgaggatggcgttgattttctccgggttggcctgtatgcctctttgagataccataaatctgagcagcttccctgacggtactccgaagatgcacttttcagggtttagcttcatcctgaaagcacgaatgcttgcaaaagtttcttctaaatccgcaatcaggtcatccttctgcttggtcttgacgactacatcatcaacataagcttcaacattgcggccgatctgagtcgaaaaacatctttgaatcatgcgttgataggttgctcctgcgttcttcaatccaaagggcatggtgatgtagcagtaggccccaaagggcgtaataaacgaggtcttcaagcagtcggattcttttagtctgatctaatgatatcccgaatagcagtccaagaaactgagtagctcgcagccggctgttgagtcaaccacctggtcaatgcgaggtaacccgaaaggatctttagggcaagacttgttgaggtcggtgtaatcgacacacatgcgccattgcccggtcttcttccgaactaggactgggttagccagccagtcgggatggaggacttctttgatgaagtctgctgctaacagctttgttaattcctctttgatcgcatccttcctatcttgtgcaaaacggcggagtcgttctttgatgggtttggcatcttccttgacatgtaaagagtgctcaatcacctctctgggaataccaggcatatcggatggtttccacgcaaaaatatctttattattctgaagaaaggtgatgagtgcgctttcctatttacaatctaactcagcgcctattacagcagttttggtaggatcggagggatctaatggaatcttcttagttttgtcgttgccttctttggtctttgacagcttggtcacaggcacttctccttcgcttgccgtggtcgcagccagtcggatctcttcgcgagcgagagtgatctcgcgggtttgggccatctcgcaactttctttgtcacatgtgatggcttgcttgatgtcgctccgtagtgatatgactcctcgaggaccaggcatcttcatcatcatgtaggtgtagtgtgggacggccatgaatttggctagagccggtcgtccgagtatagtatggtacgctgtctcgaaatcagcaactttgaaacaaatgttttctgtgcgaaaattctcccgagtgccgaaagtaaccggaagagtgatctggccgagtggtgtagctgataatcctggaataacaccgtggaagggtgaattactcggctttaattccgtgcgaggaatctgcatatcgaccagggtcttagcgaaaaggatgttgagtgcactgccaccatcgatgagagttcttcggagcttgacattgcgaaccactgggtctagtaccagggggtaccgccccgggtggaccactcggtcgggatgatccgagcggtcgaacttaattgctatctctaaccaccgaaggtattggggcgtgttaggctgaaccgcattgatctctcgttctgttagcttctgctttctcttagattcataagccaggggtccgccgaagatgtgattgagttctttgcgatgatcttgaaaaccagtcggggcatcgtcttcatcatctttcttctttgatgtgccttgatctccgtttgagggcttacgtgcgttcttgacgtattgctccgcaaactgtttgtagacgaagcaatctttggctgcgtggttggagttgggatgatgcggacattgggagttcattatcttgtcgaaggtgttgatgcgggaacgttgtcgggaagatggagaggttgttgccacaagttcttcgggcttacgcttgcgatccttatggttgttacttccactccctcctgcggtccgcgtatccttttttggcttccaagtggtgcccgactgcttggacgccgtaatagcatcttcggctttggcatactcattggctttttcaaacatctgcttgaccgtcttgggaggtttgtgtccgaacttgccgactaggtcctcgtcgcgaatgcctttagtaaaggcggcaatgatgacgtcgtcggtgatgtcggagattttgttgcgttgcttagagaagtgtcgaatgtaatcttgaagggattctctagacttctgaatgatgttatagagatcgaagtgtgtaccaggccgttcaaaagtgccttggaagttgacgatgaagtggtcgcgtagctctgcccatgatccgatcgtgccgcggggtagcccgtgaagccatgaccggtgtcacgtcccaaaacgactctaaaatacatcctctaaatgatgcctagaataattaaaatccgtgtgaaagcttccaaaaattaaaatgtgcaaagttaaaagtcaaataaggcttggaggatttttgtatatttcctaaaagcctaaaatgtgtaaataaattttagtgaaattttcagagcacaaataataattaagaagaaataaacaaagttaaaatgattttataaaaagaaaaaccctaaaatccctccttctctctaatgggccgaattcggcccatctccctccccctctctctcctctccccgcggcccattcggcctccctccccgcgcgcgcgccgctgacgggcgggcccgcccgccaccctcgctaacgggtggggcccacccatcatccccgacctcccgctgctcccgccgcctcgcccgtgccctagcgctgccgccgccgcgaatcccgccgcctcccgtcgtccccgcgtgcccgtgatcccctctccctttccccccatttttccctctctctctcgcattcaaacgggcggatttgcccccgcaaatctcaccggcgccattgatggcggccggacctcccgcgcctattccttcccctccggcccgcctctcccccttccaaccctatataaaccctccccgtgcctcctccgtccgtttccgcctcttgccaccctttctcctcgcctgattcgagctcgcgacgtcgccctctctctccgccatcgctgccgagcttcggtccgccgctgtcgccgccccggaccatctcccgccccagcgtcacctcctccagcttcgccgcaccgccagcgaccccgtccaccccctcgccgagtccgccgaccgctggaacgccgtcgaccccgtcgacccgagccgcgccgctgccttcctccgctccggccgcttttttcgtcgtcgccgtggtatgtggcatgtggttacacgtgaggaagatgtgtcttgtgggtaaagttgtacacctctgatcagagtataatctattcgaatagccgcgccctcggttatgggcaagccgagcaatgtacccaagttagtgttttaattcttaaaacttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgcatagctctaggatcgtatttacaaaatagctttgagcaactaagtgtcttttaatgctgtttactgcaaaccctaacaccctataatatggctcccttgtactcccttgcatttattctgcactcgtgggtgtgtcttgttgagtacggtggttgtactcagtcttgttcaatttttcccaaacctagaagaggagcccctagatgatgaaggctttggtgtctagctcgtgcctgccgtcaagcgcctgtggtcgtcgccctagtcttccgctgtttcctgtttgtctttgtgtgtgctgggccttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacaaccggacagaatccgctagggccacaggtagataattcgccatggctttgctgtctcctcctgctgcgcggattgcgaggccatagacggtgagccaaaactcggggttggtggtgccgtcatatttctcgattccagtcggcttaaagccggctggccaatcaactcgacgcaggtcgcttgtgaaggcagcaactccgtccatatcgtcgtcatagcgatccggtgaatgatggcctcttgctacgcggtgctggttgatggtgtcacgaagatcgacggggcgccttcgatgtggggagtgtggtcgttcaactcgatgctccctatatcgttcgggaggcgaaagaacagatcattcatcatgtcccctgctcttgcgactagatccggcgccggcaatgctgaggcttggctggtgatagtcctgagatcgaaggtgagggactcagctaccggtcggggtgcgggtgcttgcgaagttggctggaaccaaggcagcgatcatggtcttcgtctggttcaagatgttgacaacatgatcagcctgattgagtgcgtcttccttgaggagggtgtcgaggagagtgattgctgcaactgcgttctgctggagggtgcgaaaaaccgctgttccatcgacgtcttgttgcccgatgagttctctctctcgtcacccggattccaaggcgcgctgccgtcgatcttcagcctcctttgcaactcgctcgcgatcttgttgctcacgctgtagtcgttctcgctcttgtcgctgtcgttcttcctccagtcggcgacgttcagtctcttgtcgtgtacgctcttcatccgcttctcgggctctgcattgttcctccgtttcgttgtcagccatgaatacgccgaaaaagagaggcgtgtaattatcctcatagctgtcgtcgaagttgtcgaagtcacggtactcgtagcagtagccgaagtcgtcgtagtcgaggacctcggttggttgagaactaacgccaggggagctgaggtagccgtccaactcttccgtcgagaatgtcccaagaggttggagtataacgccaacctccctggatctagattggatcggggccgaagccggggctcgtctagatcttcgagtgggagatgccttggctgtgaagacagcggccaaatcatcaggaagtctcatcaggattgagggataggacccgtcatcttgatctagtcgctgaagagtagatcggatctcgtccgagtggtttgaaaccaactcgggagagatgatcttggagtaggcctcggccgagttcggaataccgaacggcgcggggacctagtctctccccgactggttcgaatccgagtcaaggagagagatcttaccgaagtcgttggtgatgaagttgaggctgccaaaccggaacgcctgcccgggagggaaggcgaagtcgtcgatgccggagacagaacccatcgcacttagtcggcaaaaacttgatgctccccctacctgacgcgccaactgtcgaaacaagatttcggcaatactaaaaggggatggctatcaagctaggaaagtggatgggtttggagacaaagaattttatacaggttcaggccttcttattcaagaagtaacaccctactcctgtccagggatgattccccgagtgtattattgattgtatgatctgggaaaaaaaaatcgtcccgaaaggaacccggacccctccttatataggggaaggggtccgtattacaaaatacagtccatatccctaacggaatatatgattacagatagaatacaatcgtaaccaactaagaactcgggtatttccttgacatacaagttagaaaactaccccgagtcctcataaagatattctatctatatttggtaccatatatccaactaaactataactgtcatgtagatatgggatatccataatctccacaagtataggtatagatagatatattgatattacctatacaatcttttttctaatagttgtcatcgatatgatagagggggcagctaatgggcgggtgatcgctctaggcgatcaccccccatcccctataaggtgctctctcacttcctcctcccctcttctcttcctactacatcatatatttttaaaaaaataaaaaaacaaagttgtaaaaaattatgtatagaaataccatatataaaaaatatttgaattcaaattcaaatttgaaactgtatgtaaacttttgacttataaactttgggtctataaactaatatttgaatttaaattcaaatttgaatcgggtatgtaaacttttgactaacaaactttaggtctataaactttacgtgtataaactttagatgcatagaaatactatatataaaaaatatttaaattcaaattcaaatttgaatcggatataattcaaattcaaatttgaatcggatataattcaatgacttataaaccttggctctataaactttaggtgtataatttttagatgtatagaaatactatatatataaaatatttgaattcaaatttaaatttgaattggatatataaacttttgacttataaactttgggtctctaaactttagatgtgtaaacttgaggtgtataaactttagatgtataaatttactaaaataggaaagtaatgcggtgccaaaaaaggaaactatgtgaagagaggggggaccgcgctggggcgatcgctaggggcgatcaatcgccccttagcctttccgtatgatagatagatagataaatacagatagatagatagatcgatagatattacctgtacaatctttttttctaacaactaggaggatagcccgctcattcgcgcaggcatgcgtattagtttgttttgaaaatagttctaacaaaataaactgaaattagagtaaggtgttttctatttttaattgggtgttcattgtatctctttttttcaataaatctcgataaacttttattggcaataatttttttaccaccccgtcaaccctctttttaattgattcgtatatatgtaattcgttatgcttgtgtatctataaacataagttctttaaaaaatatttgttatattttgaatttagtgattgagtgattctaatttcgattttgtattcaaaacaaattattgttttattctaaattgtccttttaaggatttaaaaatgtacatgatctcgtatcgtgttgtacttggactcatcttttaatacttattttattattccaatttctggtatttataacttatacctttatatggacagttgatattttatattctacatggaatctatttatatatttttttatagttttagttttttttgtttttgaatatgtattttaaatcaaattgcttgttttattttttttctgaatttaaatacgaatacctcataattgatctgaatgtcaacatcggcctcgcggagtatcttatcgacctcctcattagtgggcctctcctgatgcattgcacgtgacatggcaaggctcggcgatagagatgaagctgttttctagtccttgttgaagacacggaacgtctccctctgcccctcctctcagtcctttgtccttcacctcattacctaacgtgctattaggctctagaagtcatggaaagtcgatgttggcgcttccatcagtgtccacctcgctaaggttgtgttgttccccctcctttcctaacttagctccttagttttctatgcgcatgctttccaaactactaaacggtgctttttctaaatgttgctttaaagcagcatattaatccattttataaaaaaaataactaatacttaatattctaatgtaatgcatgctttccaaactactaaacggtgctttttctaaaagttgctttaaagcagcatattaatccattttataaaaaattctaatgtaatgagtcgcttcattttacgtgcgtgggagattagatcctacacccatctaatgaacacaacctaataatatcttgcagctccgcctccgttgggtttaggccgagtatgcatcatggttccaagatccttgcctccttggtggtgattaaatatggactttatactcacccatttgaattcattaatcctttcacagtgcaaattttgcttaaatatttgtagtcagaacggctacattatctaaattttatatagtaaataaaggtaatatggatcttgaattatgatttaataataataaaagttcctttgtaacacaagattgaaaaaaaagaatagaaaaggttcaaatatgataggaatacatgtgtaaaatgagtattgaaaagaacggatgtttcaatgtattgcagaaaaacacaggaaatgaaaatttgcaaataaattgagaaaagtgcatgtaacttgagagtcatggtcatttaactctatgattattattattattattattattatttatatattatgtgttagctcgaaaataagaaaagttggctcgaaaatgggagaggagagtgggatccccgaggatagttggagggttgagggatacgtaagtacgtgtgtgcccacatatggtggggttgggtgtactggaatttattttgagatatctaacagttaaaattagtggggtcgacctatttaaaaagatatgaatggttggattttttttcctttttatcaaaatttttaggattttttcgtcccaacctggactaaagatcgtaactttagtcccggttggtattaccaactggggctaaagatcctggtgatctttagccccggttggtgctaccaaccgggactaaagtcccacccctatatatatgtcttcttcctcctccaactgcccgagcaagcttcaaaatttcttcaaaaaagaggggaggtcatgccaaaatttctattgaatttattttggtgattacatacaaatcggaggtgcctaaagggtttgcaacttcatcctccaatgtttttttttgtcatactacatttgcacctatgttttgcacactttttttgtctccaaaatttagttgtaagttgatcagagagaaaatgtgtgtggggaagaaaaaatatatagaaatttagttcatttgctaaacaaggttttataaaatagttgagaaggaaaactctagtgaaagttaatcttaaataatagaaaacaaactaaaatgaaaattaaaagaagtaaaatacagtaaaattagtttaaaactttacaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacgctgaccggcggtccaaagagtttattgacggcgtgcactattttttgagagt

SEQ ID NO: 76172 - DNA, 668 bp, Oryza sativa
gtatccccggtcgacactttcatcaaaataaatattgtcttccaaaataatcagggcatatttatacagttcacaagtaacatataaataaattccataaaaaatgaatatggatagcacaaaatcaaattcataataaattcttcccaatttttttcattttaaattaaaataataaacatatttgaggatgttttattaatggtatattcattggttcatcaaaatatcaaaatcgaaaaaccaaacaattagtagaggtggtggcaatggggcgggatggggctgggtaggaaaggaacaccgtgttcccgctccccacattctcccctcacccctagctctgcagagccaaccgggtggaaaacctcacctgcccttacccctgtagtagacctggtgggtgagcaaggtcccactcaccttgtgcgtgagtgccaacattggctaccaatgccgagctacgacaggaaacaacggcttggagggcagcaacgaggcaacaacgtgagggtgacaaatgtagaatattttatagtaatttatagaaatcaaactaatttatgtaaaaaaactaaaattgtatatactactatttcgaaagaaatgtacactacacacagggtttaaagtgttagacgcgtcaactgcgcacacctattttctag

SEQ ID NO: 76173 - DNA, 77484 bp, Oryza sativa
  unsure (1)..(77484): unsure at all n locations
tttgactgtcaggcttgagaagccagcatcctatgatcagattaaggcagctatcaagtaagtgtagcataaattagaattgcccttacagaaagtgaagaggctaaagtattgggtaccagaacgtcatctaagactagcaattgacttttgtttgttctgttttctagggaggagtctgaggggaaactcaagggtattctgggttacgttgaggaggaccttgtttccacagacttccagggtgacaacaggtggagatctgtttaaattcgtcttgtatttggatactcggttactcgaagcccctgacctcttttgctctgtgtaacaggtcaagcatctttgatgcaaaggccggtattgctctcaatgacaactttgttaagcttgtgtcttggtatgacaacgaatggggatacaggtaatcatttctatgtgcattagaaagctatacttgttttttagttcatggttgtttggttcatatcgcgtaggctagctctccattagaaagctatactggctgttttgttcatatccttggaattttaacatgttctatggtagttctctgaactacattaccttggtcaggttgaacccttgttttctaatgtattactggttagttgcagttcttaacacaaactggatcacactccagtgtgccctctttcttttgctagttggattcaatattagagaattctgcactagtatctttttgccatactgttcaaataattcgtacccactccattttattactgtccaaataattcgtacattaacccactcctttttatttcagctctcgcgttgttgacctgatccgtcacatgtacaacacccagtagaagatggtcactctttcggaagaaatggagtagagtgctactgaaaataagtcggaccttttgcgagctactccagtagagcttcattagctgtatgctgccttttgtttttgctggcttttcgcatgatgttttattaaaactcgatgtaatgttaatttgtgtacttcatctccggcactttataaatcgtggtttttgaatttgaaagttcaagtggcattagacgaataatttcttgaggattagttggctgcgctgttgattgtagatgcttggttcatatccatagttgttgatattcacggcacgggtttgctgaaaaaatgtcgcctttttttctgcttgatttcagtcggattctttcgtctgatcgctcaagtgctcgcttgctctctgctccgactacattggcccgccgccatgtactcggttgctctttttttacagccaaacgtgcgaagtgttttcatctccttttttagaaaggagcctggggccctgcttttttatagaaggcaaatcctttttatagaaagcaaatagagtaaccaatttatcgctggggactccagctgaaggacactcgcagctagcgcccaaaacagagaacttggctatcggaaacaacactaaccagtcccgactcttgctggacgagggtcgttgaataacttcacgaatgttgtctaccaaagactgggtcggaatttcttcagctttcaaaagtggcgatgagtttgcagcgaaaaatcatatcatttctgacacggcggacacgcgggccgcgcctagcttaacgcactcgacgtgcaggcgcgtgaggcccgcgaacacgcggggatacttgtcgcggtaggacgcgaggcgcgccccttgcctagcgacgtccctgcccgcgcacagaagctccggcttctccgacgagacggtgaaccacaggtcgtggatcctgcggccgcgggccatggcgtcgtcgaccgcgcggacgatgccgaccgacttgtccctcgagaagaagctcaggcccaggcggcggatggcgtgccggctctcgtgcgctgccaggatgctctgcaccgcgcgcaccatcgcgtggttgctcctcgcggactcggatagggtggatgtgaagccgtcgtcggggtcgtcgtcggggtcgggtgcgaaggagtcgacgtccagctcgatgttggcgagcatgccggggacgcggctccaccgcctcgagaggaggctgcatcgcacggcgtcccgtgtgtccagcttgtccaggatgaggagcaggacgtcgtcgggcagatcgctcagcagcgtcgtcatcgtgtttttgtcgcggtctggcgttcgttacctgtggcgcgcgcgcgagaccgagagcaagcgccggcccgcgcctatatctttctcgtttatatgtccgcgagacgccgagaccgcgacgtttggtcgtctgccgctgcaatgctgcatgctttagtcgtcttgactcgtttccgattccatattttcgccaccagaatcccgacgaccgacgtgggaggtggcaggaggcgactggttggttgacagacccagattggaatatgggctggattcactcgttccaagttcggcccatgccaaaacagcccacttcatcgaattggatcacaattcctgatttccaagcccaatatacctataatccatacgggttattactttgagatattctgtctacaaaaacaaaccggcatacagccttgagccttctgtttggaaaggtttaggcccctttaaatcaaaggaaaaaccataggaattctaaaggattttatcctataggaaatgggaccacctatacatttgtcgataaattttctcctaaaattttgacagatgtaattatagtacaattatagtgtaattacactgaaatttatatgtaattacactgtaacttgcatgtaattacaatgtaacttgtatataagtttcacgtaattttgaattgttaaatctattacaagatttgttttggtgaggaaaaacaatcatagcacacacatatgtgtaaggatttattctcacaacctctattttaccgaaataacatattatagagagatttttgaaagttacatacgagttacactatagttacagtgtaatcacactactgtcaaatttttgggagaaaatttgtcaacaaatatatagcaaaatcgatgggaagggacataatcctatagagtcctttgaaacaaatgattgtttcctattaattcctttgaaattcctatggagtgaaccttactaaagcaattttggaggaaaacaagcatgaggtcgagacctcatgttttcctcttcatgtgtctaaggttcctgcgtttttcctgtgtgctaatcaaacgacagttcgaggccccctttgaattggaggaaaaatggaggaaaacaaaggaattgaaatcctactctattcatgcctttgattcgtaggaatgagaaaagaaaaaacgtaggaaactttcctattcctacaattctaaaggaaaaacgtagaaaatttaacatccactcaaacctcttggaaaactttccttaaatctatctctctcatctgattcttgcgtttttcctacggtccaatcaaacgatcattcctgtgtttctcctgtgttctgcaatcctctatttttacacttgcatttctatcagaatcctatgtttttcctattcaccgttttttcaatcctgcgattcaaatgggccctcagggatctaataagtgtggcattcaattcctacgtttttcctattcctctgttttctcaatcttgcgattcaaaggtgcccttaattgtgcatacaatgaagtacttgaatatcgtgattatcttgtgtacttggggggatgatttgatactatttataagaaaacacgtgaaacttctcttggtatcaccttttgtgaataagggaataacatgtctcctcgctatgctatggaaatagatgttacattcgtacttcttatatgtactaaaacacttttttatcatataaattttattctaaatataaccttccacccaccctttcatcttaaccatcttccatttgattctttcactaaggccctgttcttttctccaacaaaacttggataaaaataaagatttttgtggcacacatttcaaactgttaagccgtgcgtttcgtgcttctatatgaaagttgctctaaaatatcagataatatgttttccaaatttataacaattaaaactcaatcgatcatacgttaataccacctcgttttgtgtaaaaaacttaatcttcatcttcattttcagaagaaaagaaacaccacctaagtctctcatctataagtcataaccatctctcacttaatttctctacctattttctcacatcaatcaattatttaaattttaccttaaacttatttttttccaaagatagatatgttgaacatgtgttgggctattgtctattcacagctccattgtttgtttgttggtttattagctacaaccaaaatttaacttttgaaacttaataaattagagttaattttgagattttttcatcgtatttgtttttttacttttaaattattaagacacgattttaaaaatattatttgtaaattattttttattgcttccattattttttttttgaaagcttagagatctagagcaaagcgaggccgatcttcagtgctcaaccgccgcagcttagcgcgccaaaaatattgctatcttctcaaatttccctccaattcccctactcccccttccgtctctctcctccctcgtcggccccgcgccggcgccacaatctctgcctccgcagccgcgcccgccgcctccggagatgtactccccgccccacgccgccgactcggactccgagggatccctcctctccgacgtctccgcctccccgccacgccgccgctcgcctcctcgcccggcgccgcctcctcctcctcctcctcctccgcccaagcaccgtactaggcccgccgcccccaccaaacccaagctcaagcccacgccgcccgctgcctccgcgcccgcgcccgccccgccgcctccgcctacgctccgcgccgccgcgctctccgatccgcacggcctcgccgcgcgcatcgccgccggctctgctctcaccgcggcctccggcactgcctcgtcgtcctccttccgccgtctcgtccagtcgcgcaacccttccttcgatccagccaccgccttcacggctcccgcttcgtccgctccctccgaggttccgagcgccgctccgcggccgcccccgaccgccgccaccgacgcgccgccgcagaccaggcccaagcgggtgcaccccaactccgtgtcggaggtagcggccgcgtcggcggcggcggagcagccgaagcgggcaagagggggatccgagggcaacttcgtgcggctgaacatcaacgggtacggcaggaggaggacgttcaagaattcgcaggccaagcgctcgacgaaatgtcgatcctggcggcggcagcgcgccgccggtgcaacaccccgttctcagggcgacgaggaaggggatctcgtggcggaggccctgctggagcgggagaagcaggcagctagcgatagtgttctggaggctgtcgagagtgtgagggaggacccatcggagcaaaatctcaagagcttgctgaatgcagcatatgggcacgattcgttccgccaggggcagcttgaggcgatccagcaaattgttgcaggggagtcaacaatgcttgtgctgcccaccggtgcgggcaagtcgctatgctaccaggtatgcttcaaaatttgagctattaagtttatattggtcggtgctgaaaagttgatgatgctattttctcaggtgcctgctatgattttgcctggactgacactggtggtgagtccactgctttccttgatggttgatcaattgaggaagctccctgcatttctgccaggtggccttcttgcgagcagtcaggtaaaggcaaaatgtttgcagttgctgctagttccatccattcttgttttgactattgtgtaacattacctcatttatccagacatcggatgagtttcatgatacactacaaaggctgcgtgcaggggaaataaaggtacaattttcttaatgtcgacatctgatcagtttaagcattctccagtgactacagccttgatgctgccttatctagagaacatttccttactatctttatcaattcttccagtgcagcatttttcttggagtaactagaacatgaatcattaagaagcacaaatgtattttttttttgcacttcaatgttttgctaggttatgctgagattctttatttttgggatcaggtgctttttgtttcccctgagagattcttgaacgaagaattcctcctgatatttagggacacactaccaatatctcttgtggcgattgatgaagctcattgcatttctgaatggtgagctgacattgttcttagttcagttgagaagacatgatacttctttacagttggtactgtgttattacttttgtgttcacatcatttttgtgatacatcttattaattttaccgttgttttgttttcctagtttattattcacttgttgtgtagtgttagacagttagtacaactgtcttgctaagtttataacttattcctgactgaatgtacaggtctcataattttagaccttcatatctgagactccgagcgtcactacttaggagaaagctcaatgttcaatgtattcttgcaatgactgcaactgcaacgacccaaaccttggaggagataatgaatgccttagaaataccatctgataatctcattcaaacatctcaaataagagaaaatctacagctgtctatcagcacaagtgataacaggtaggccacttctctttgcacccatgaatgcaaccagagtcagtttaatacgtatttacatgtgaaagaaggtatgctatctggttttcaagagcatttgcacgtatgcagactgaaagatttgatgttattattgaagtctcccccttttgttgacatgagaagtattatcgtctactgcaagtttcaggtatgttttttttttttaaaaaaaatcctaaagatgttccaaagaccacgcatctgtctatataccctaaatgtgtatgcactatatgaagatttgacccctttttaattattgcgaacaggcagaaactgacttcgtctctaagtacttgtgtgataacaacattactgccaaggttgacattaatctttagcttgatattaatttgctgcgccaactttaattacatattctattgttttatagagctaccatagtggacttctgattaagaacaggagccgtgtacaggagctattttgctctaacaaaataagagtggtatgtggtttcttctttagttctttggcatgaccttttctcgtcaaatgcattatgtaagacgtggtgtctaacatttgttttctccatccttgagcaaaggttgttgcaactgtggcatttggcatgggtcttgataagagtgatgtcgaaggggtatggatatacatacattatgatgctcaaactgtatgatagaattgcatttgctccttgtttttaagtgaacttcatttctacactatctcaaattttgtgtatctcataacgttaagcataactaaattatgttaatggtctgactcgagcattccacccttaaaggtgattcactatagcttgccagaaagcttagaagaatacatccaggaaactgggcgtgctggaagggatggacggttatcacactgtcatctacttcttgactcagcaacattctataagatccgtagtctttcacacaggtgaatctttttttcctaatcaacatgctctgcctgccacagttttcctataatttcaccgagcaaccttttcttggcagtgatggtgttgatggatatgcaatgagcaaatttctttaccagatattttcctctgagaacacaactgggtgcatttgttcattggctaaagagttgacctcacgcaagtttgatataaaagaagaggtttgcaccttcggaccttcctcttcaggccagcatgcacctagtttcttatgtcatgcactcatcctactacctacataggcctagtttgctcgcactatgttatactgaacgggtcaaatggatatcaatttttggggcacgtgtgtttgatggctatttgctgtgctctgtaagaatttgcaatgtcactaaattttatttcttagcttaaatgatgtcttagtggatgagctgtctagcattcaattgttcagaacatcatagagaaaattatcggtatgatgccccaagaagattccagtgtttagtttacggaagttgtttccacattctattaatctcttaatgttactcttccagtcaaaaccacattgccattccatgcaattggaatcagctataatgcatttaggttccaggaatactacaaggaatagcatttatagactttttctctgaagccgttagacagtttcttcccctaatattttacatggaatccacctttcccaccaatatcttcatgcacttctttataatactcttatcctaaagccttttagttcctgaatgaccgaaaatattaaatggtccagcaaatttttagattcaatgatcttatcttcttatttttctaacaatgcaggtgcttttgacaattctcacacagctggaaattggtgatcaacaatacatccgtttacttcctcagttcagtgttacctgcacactgtattttcacaaggtatgccacaggcttctccagtgatctggaccttttttgatttgcgtgtcaagatgctcagttgacgatcttcttgtctgtcatgtaacaatgagtgatcttaattgttcaccgcctagacacttaattaacatggcttgcctttacttaaaaaaaattcatggatttaccatgttcattgttattttgtcaagcaatattcatttttctttcatatcttgatcattggattaaattgatgcagacatcaccacaactgcttgctgacaaggatatactaattagatcggttttgaataggtaacacactatcaacttttgttccaaaattttttctgaatgtgctacacatttctaagatgtcgattctgaattcgtggagaaagcagatcagagatgaaggatggacattatgtctttgacataccaagaatagctaatgatctgaagatcactatgaatgaagtatttgatcacctacataaactaaaggtttgcccttctcttctaaattagctagaatgttaaacatatttgtttgggctgcatcatctgttgcaacttttttgaaagaaaggataggagctctgcctagtgtatgaactgagtagaaactcattcttgctagttgcttggagtcatgctattttaacctttagtttagcctatcattatctacttatttacttcatgttgcttacatatgttctggcaaactctaccattatcggtcttgcgctaatggttatcttagaatggttattgctgttattatccagattccagaagatatgatcacgtagtataggcttatagtctggttgtggtgactgttgaaccactgcccgtttttcttttctatgatcatctatattccttttaaaagactctagtgatgccaccaccgctgatgtatggggctatcaggctatgagaccagtatacacatgattgctatgctcactgtatatttgttgtttctaatggtttgcttctttttcaccttgattaaagtgaaaaactcacaaacatgttagttttatttgtagttttaaattggtcacactgcacgatttattattaatacgtgttttattgtcacgtgaaaatgcatttaagggtttatgtctcactttggaaaactacaatcctataagcatgtcccttttctttttgtttcataaagatgaagcattttgtttcaaccaaacagaaacaatttttttttcagaaaatggactcaatttttttatttctataatccgctgcaacgcacaggtatttagcaagtattgcaaatatgtatatgttgaagccttaaactttctttgttcctctgttatttagttttcaggagaaatatcatttgaattgaaagatcctgcttactgttatgtgatcttgtggaggccagatgacttcaatgctctttcagcaaatctcacaaaatggctttctgaagtagaaagctcaaaggtgcttcttaaattgcctctcttgaatattcattttgcttcatattgtaaattgccaatctttactacataagttctgttttcttttgtaaggatttaagttgtggtactaatacaagtttggtcttatgactactaaaaaagggtcttatttattttgagcaagaaagcggattcaatgaaattagagtaaaaatagaagttagatatactgattcatggaatctgctgttcaaacagatcagtaagttagatgctatgtttgctcttgcaaactttgctgtcaaagggtgtaaaaggacgggaggatgctctggttcccagcacactccgtgcattcagaagaagattatggagtacttcagcaaggacgatggcacctcagagaatgattgccgcactcagctgcagaagagcaggtttctgtactctttttctagatcgaacttaacagagcattacttgccatttgtttcttgtgatgttccaatctaaaatttatccgactgaagcatttcatcttactttttttgcagcccattcttgcaagccgatataaaggtaagcactgatgatgtgatacatttcccttgtgattctgtataatgcaataattccaattgtatctccaccatacttctaggtgttcattcaaagcaactcattcgcaaagttcaccccgagggctgttgcgaggattatgcacggcatctcgagccctgcttttccatctgtcacttggtccaaaaatcacttctggtctgcctctctggctgccttttctcattattttcctctgtcacctatttacctgaacctgaatctttgctgacaggggacgttatgtggaggttgattttccactggtcatggaagcagccaaagctgaactggttaaacttgtcggaaaaggggaacagtgctagcagttggcgatcaagaacagttcttgcccccagctacctgtacatacatactcgtatgcttgcaagccaccgcggccacccaatcagataggcatctaaaggaggtctgcgcccactggccactgccctgattgtttcctttacttaaaactactctgattgtcttgtcgtacgcttgacactgactgcaatttgtccttcaccttgtatatatataggcacgtaaagaaggcgttgcagtgagcatcctcctgcagaggaaacttctgctaggtatgcgtgtgtctaccccaggaacgctttcccgtcgagctggctaagaggcttttctgccatatgattgaggggtgccagctcagtaattctgcttgggtgaagagaatgatgccgctcgcacgactggagtatatcggaagcaagagtcagaagcagaacccattcttcttgtacagacaacactgctccatatctaattatcgttctccttttcctttccaaatgagaatcaactcttcgacgggcgggtaaagtgtgaagtgtcacagtaaagcaccggaaacctggttgccactgcagtatctcctctcttcaccatgggccatccttgcgtagacccaattctgttacgtttccactgcaaaaaatctccccaagtcccaggtggccaggtacatatctatttccccgccctcctattctcatttgcttactcccttcgacccaaagttaacatgacacatgatgtatggtgtgatatattttaatactacgaatacgaatttaaatattatgtgttatatcttgtactagattaatttatttcggatcgaaagggtattataccctgaggtggatgcgtgctagtgtaccgtagcatttgccatggggcgccccatgtgctttccttctgtctcttggcccattcttgcgcggcttcacttcacgtggagcgagagcgagccattcttcacggggcatgcggcttcacgaaaccagattcatttgacgtgcgtgcggtgattgctcgtcgcttcgctggatctgagtgacaaagggtcctgcacttgattgcgtattttcaatcagtatagctggtgtatgtacgcctgtacgggggcggctgtagccggggacaccgtgtctaacctaatctatgtgcgacgaaggagaaccgtgggctgctcaagacgatgtttgtgaggttgcatcaaaagatgttacccgcacggttgccgcagtttaccaggctgacacgacacggcaaatgtatttttagcgttaagccatgtgttagcaggtttaatgttgggattaaaaccgctgaaaacgaaggtggttgttgccttcagaattagattagaaagatgctccacatcaatttactaaagtacagcgacgtgtaaggggagcgaagaggcatattcggcggctccaacctggcgacccgaagcatattcagcctcctgcccaacaaggcatttagcaccgaagtcctacgtgccaacgtgcagggaagttcctcgtgctgtgcacagtgcacattgtttctttgccgttgaagattatacagtacattctttttgcaacacgtacatattatgctatgtagcccctttggaacacataacttcattaagaaaaagaaataattatctttcagggtacaatacactaccatatttaagataactcgagattttaagaatcaattatctttcagtgtacaatacactaccatgtttaagataagttctacttgagttatgtaatgaatcacaatgccttcatttaaaaaagaaacaattatctttcagtgtacaataccatatttaagattactcgagattttaagaaacaatcgataggctgagtagtcaactggcgataatatgaaaaaaactaggtcttctagcttcgggtttattttttctaaattttataattatttttagctataaatttaaataaaagtgagggattatatctataatctttagaggaactaaagattactcaatagaagaaatcgtatttaccataagctcttaaattagaagcattattgtttagagtactcagaggtgcatgggtcttaaaataacagctgcgcctacaatttaatacacaacactacataccttcgttacagagaatattcgctcctaaattatgaaaacttggaggcgagaaaagaagaagagaaaaaagaaaacgagcaagcaaagaagaacctaggaaaagagctcgcaaacaaagaccgaaccgttccaaaaaggaaaaaaaaatcaataaaccccagaagaagcctctcctcctctcgactcctctcctcgccgctctcgttgcttcctcgcggggagttggaaccccctcccctctccctctccctctcgctgactcgctcttcgaggagaaggcgaaggctcccgcgccgcggagtcggagatggccgccgccgccgccgtggtgaactacccgctcgtcgcggcgctcgtggcgttcgcgctcgcgcagtcctccaaattcttcaccacctggtgagtcgagttgccctacctctccctctgcgcccccgctcggcggccgctcccctccacgcgctgcgtttgtgggtgacggtttggctccatgacagtggccgttctcgatcgctggagacgtgtggttcggtgtttttgcattgcgtaatcggtgggaatcgtgggggcgaggtctcgttggcttcgatgttgcgtttcgtggtttgcgcgttggtagaaacaaggagctgacttggagaattgagatttgaggcctacgaggagctgaggcgtcctagatttgttttttttttttggttcgctggcatggtttggattgtagctagcccgtagatcctcacggaggttagagagatccttttcctatttctgtattttgcttggctttgacagtgtgatctgcagcaactgcttctgtagggggtagaactgcttttcttgggatacttttgtctagaagagacaaacaggatttctaaatccagcgtgatgtgagagttggacggctactgtagtgcgcttgcacgatttcgtttacatttttggtacgttttgtcgtgaactactggttgagagcattacttgagaggcactaataacagggtgttttgctacttagtgccttattactatagcctgagggcattttagtgccctgtgaaatttttactgggcaatttgatatatttttctgactcacgttggttctactttatagtacttttaggcaagagttgtgcagattgcttgcaaataatgagtgtagtaaaattattaattaaagtaagcttggtcttccttgatatttctggaagatttaagacaatagttggtatctgttatgggcgtatcagacatgaaatagtcgtaattgttgtatttaagtatcaagtgtctcacatttttgtgttgcacagtataatatgctttgttgtgcaggttatttttgaaatcactaggacaatagttggtatctgtattctgttatgggtttatcagacataaaataggcactattgtagtatttaagtatcaagtgtgtcacatttttgtgctgcacagtacaatatgctttgttgtacaggttattttttaaatcaccaaaaatcactaggtgatttcaaaaataaatacacattgaattggcatcaggacaggatcttttgttttcaaactggaaaacatctatctttctaatttcattaagtaaggaaaggaaaaaaatgttatacaaaattagtagataaaggactagaccaggaacagtatatacaaggactacatatggccctcgtgaaagcttgccagctagaaatttagataatacttcatgtatagtctgtcaggaattcgatcactcctgttgtcttgttctgatctaatgtgtatgaggtgttttgccttttctctaattgtattgctatcttcaatctgaatgtgaaaggggggcgatgaaaatcttgaacaccagtaatctatatatatgaataacaaattttcccaaaaaaaaaaacaatatactttctgcaatttaacctgtcagaaaatcataggtggcgccggaaataattccctattgtgctaatgtttatcaattacctattgtactaatgttttattgttttattgaaaaccctaaataactattctatcattgattaactgatttgatgcaggtttaaagagaagcgttgggatgccaggcaacttatagcttctggggggatgccatcatcccactcagccacagtgacagcgcttgcagtggccataggaatccaagaaggctatcgtagcgccacctttgcaacttcagtaattattgcatgtgtggtgagtagatgttcttgattcttatttgtatctttaggtcttagctgcttctgtaacttctgttgcatgagtatgatactatagaggaaaatatgagagaattttgcattcatttcattggttccacacaaacagatgcccttctgcatatatgaaatactttgctcagtgttagttagataagacatttatgttttttttcccactaactagttctatcatctcatttttgccatttgatatggtctaagcctacatgtaaatgagtgagtttagtgtcatggatggaattacaaatgaaaaattaaatctcatatacaacactgatctatatttgtgtttgctcttgtacaatgcaaagcttctgtttcaagtgcatcttcatgacaatatccattgcctctgcctcgttgaacagtactacctagttgggaaatacaactatcttgtttgatctaaatgcttatgtctatattatttgattttctttttttctttaacttgtgtttgtaggtgatgcatgatgcttttggagttcgcttacatgctgggaagcaggcagaggtttgtctttctcatcctgaaaggtttcagccttctgtttgaacaggatataatagaatgaaagggttttccatggcagcttctgattgtatcttcatggactaataaacagaattcgattatctatagctggcatttaaatttttgacatgcagtgttgtttgttgggctaatatgtcagctttaatattcttgtccttcaacttctgtttcttgggctcataaaatttgatatccttattggttcaacacttttggcctgaattcatggacctatccacttttatgccagcaagaaaatttagataatggcaactgtatgtttaacttctgcttggcctgaactctttaccttttcacttttatgtggagaataaatttagacaatgccaactgtatgttgtagtttgaactttgaagtgacatttccttgtgagaaaacgttcttgttcttctggtcactccgccatcagttaatgttgaattgtagatttggatggtccagtaaatatgtgctatctgatatgctctattttattttaaatgactaaagtcagagcatactaatattgttgatgcaaatctttcaggtattgaatcaaattgtgtacgagctaccagaagagcatccattatcagagacaaagccattgcgtgaaattcttggacacacagttcctcaggttagcttagtttgcatgattctgtcgaattttagctatttctgtggccttgtaaatactgatattcaaagcagaaagaaccgtaggaagattctctaagcataaaggcagatactagatacaccttgtagcaccctaatataatgcaactgtcgaaagttcatgggtatgatacaaacacaatatcgttaacaaacacttaaaacttctctgaagaaataaacagtaggttaagtcataggacatcttacagatacattatctactctgttttttttttggggggggtggggggtgcgaatatgcagttctcattgtttcaagaagaggaggttttgcatgtgcctcagcatttttacactcttctactaccatgctcacatcggctattgggcatttcttatgcttgtcagaatcatcaccagatatacattatatgctcgtaatctaaatgtaatttcgttctcttttttatgtcaggttgtggccggttgcatcattggaatccttatagctgttgttatgcgcttagctctatggagttcttagacacgcattactcgtaggtatttgcttgatcacctcatatcgcatcgctgatgagttgtgaagcatgaaaactcaaatctcctcttggatgtgatttgtacaaatgctcagttttatgactatactataaggttcctaaccggtgtaggtctgcgttgtaggaggtagattgtagttcagttggtgctgtacatcgtagaaatttactgtgaattggaagctcatgtgatcaacctttgttatacaactggcaatgatcatgctgtcaacttttctttctggcacgcagtgatattttaagttctgcatcactgtccttagtttattattttactgtgctgtgcttgttagacctagaatgttactaccatacaaatgtcccaaaatttggtcctgggcagtactcagtagtgtgtgtgcctatgctgttttactgtcattcatagttcagactaatctgttttcctctgaatcctgaaatgcaagaactttttgttatttcctctcggtgaacctgatatatttgatatttcagaatttctagtgcaaacaaacaggaattgttctctgtttctctcttacacagatcacagatcaaacaaaaatattttcttaataagtatgagcaaagtactcggagaagttacacggagagaattattaccaccttgtatatatatgtaagtattctaagagtaaagtttgaagcctcgtccttattatatgtagctacaacgatgaggtatacatgtgctcaggctctcagagcttgcacggcgacgatgctccggggtggtgcaccacgatgaggttgtacgcgtcgagcgtgaggaagtcgtccagctccggcgcggtgcactgccggctgaagatcctgccggcctccgcgtaccggccgcgccggaacctctcggcgcccacctcggcctccaccctcgccatctccacctccacgacgcgcgccagcagctcgggcgtggcccggacctccacgccgccggcgtccagcaccgcgccgtgccggagccactgccagttctgcacccggctgatctccgcggtggcggcgtcctccatcaggttgtacagcggcacggagcccgacccggatagccacgccgcgacgtactgcacgccgacgcgcgtgttgtggcgcaggccctccaccgtgcgcgccccgcgcggcggctggagcaggtcctcctccgtgacggcgacgccggcacgggcggcgtcgccagccgccgcgtcgatctggttcggcctccctccgaggtgtccctcgaacacctcccggatcgccgggatgagccccgggtgcgccgcccacgtcccgtcgtgcccggcgcgcacctcccgcagcttgtccttgcgcaccagctccagcgccgcctcgttcgccgccgcgtcgtccttgatcgggatctgcgccgcctgcaccacatcagcaaccgtttggttaatcaactagctcgaggagctctccaacgggcgagtggatcgatcttttttcgatgactgaccatgccgcccatggcgtggacgccgcggcggtggcaggtctggatgaggaggtgggagtaggagcgcatgaagtgctgggccatgccgacgagggcgcggtcggggaggaggcggtcggggcgggcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccccctccctatccccgcctccttctccgccctctcgaacacccccttccatatcctcgcctccctgcattaaaaaaaaaagttacatacatcgatcagttcaacccaaaaacgtatgttggtgataaaaatcaggtaattcactccatattctaagcactctccctcacgcaaggttccttaagtatcaaacgtggaatgaaagcggggctatttttttttattaattgcgtaccagccagaatttgaacttagatatgcccatgtcttgatcatcacaagctttgtgccagtgcgccatggatggatgtgtttgtgcgtgcttacctagagtgctccatcttggggaggtagaagaaggggccgaagtcggcgccctggccggagcggaaggcggcgtggctgtggaagaagtagaggccgaagtcgacgaggcagccgatggccggctcgccgtcgacgaggacgtgcgcctcggggaggtgccagccgcgcggcctcacgaagagcgtcgcggggcggtcgccgagcctgtactcccgccctcgcgccgcgtcgcggtaggtgatcgtgccggcaaccgcgtcgcgcaggttcacctgcccgcgcatcaggttctcccacgtcggcgacagcgcgtcctcgaagtcagccttgcacccacaataaccacgacgtcacgctcacgccacgtcaagatcctcaccgatggcgcgccggagttgtgtgctgcttaccatgaagaccttggcgccggagtggaaggcgttgatgaccatcttgcgcggctcggcggggccggtgatctcgacggtgcggtcggcgatggccggcggcacgggggcgcacgcccagccgcctgcctcgcggacgggcctcgtggccgggtcgaaccgggggagctcgccggcgtcgtaccgccgctgcgcctcccgcctgcgctccatggcgtaccggacggcgccgcggaactcgcgctgcaggccggccacgaaggccagcgagtcgcgggtgaggatggccgcgaactccgggtcgtaccggccgaggatgtccacgccctccggcgtgtcgtagcacgggcacggcggcgctgcggcgttggtggccatggagtcagtcgagtggaattcgttcgagcaccgatcccaagtgtgagtagaaaatgggagtgtgcagagagcgtgcttccttccgttgtataactccaaatatatacgcgagaggtagtgtaaaatttgaagactatcgtctttgatgatgtggcaaggatgaaattttgtcatttttctccaaagagatcaagattgcactagtttgtaatgctgaagcggactctggaaattatcatgatgctaggttttgcagagccactacaatttgaaaaataagtgtcatatgcacaacaacaaacatagcaaccataatccatgcataaactgccttatatagcaatgcagtctaattgtaaaaagaaggaaccacagttcaaagtacttaatttgtaggtgtggccgaccgttgattgctggggattttgttttacttaccagttaccaacctacatagatgtcaaaagctcctggcttattttcagagagtaaccatacacagttcgtttcttttgtgagagaggaatttatggatggactaatgaagaggtgctccaggtttctaatacaaagttaagtaattaagccctttcagaaaatctgagtactgaagcctcaccaaaatgactaattaaggccaagtttcgttgtctatgcgcaaagcagctagctggtgttgtacaagccaattcaagctgaattaatcgcgcatacatccaaattcatcacccaattaagttctgtagtttgcagtttctgagctaacataaccgtgtttgttcactggcgatggtcgtgttaagcgcgggaagctcactgtgtcccatcagctaaaactgtatatatgttattccaaataaattgcattagcttgtctaacaaatgacactcaactcacgccactaacctttgctgctttgcccggcgtgtgtttatataaggcgttggatgagatggatgacgatgcggcatgcatcagcgtgcatatggagacggatcagtagacgtggtggttacgataaggcagacggggagcaagtgcggtgcgcatcaatcagctcgatcgcgtgcgtgcatgggcacttacgtacagcacaggccagcagcaggaggaggtaataagcgtggcttgtttcgttggcgcaccgagagaggcgagtggctccaaaccgcagcctttggctgcttgtgcggtttctctccttatccgcatgaactgcccaatttggcccatttggggaagggagagccgtgccgtcacgcccccaacctccattcgccgccgccggcagccgactatacggccagcctagatgaaaaatctcttcgggcctttccgaacaaattaacctcacggcagcggatcgctgcgggttgcgcaggtacactgggctctcgcgttttgcacgcaacgcaggcgttggacgggttcgatcggccggcggcgaaacgtggcggttggagaacaggagaagcagaaattaagcgtctttcacgatggcgttcttgtgaggtttttcttgtttcgttcctcttatcgtcaggtgagcgccgaggaggcaggtggtgtggccggctgcaaaagaagcggattccgcgcgtgctggcacgggtctcgtgcggcacggccgcacggtgattcgtggcgccgtgtgtgcccgtgaggttcgattctatatcggggggcgaattagactgtcgtaggagcaagagcaagtttgatagtatagtcaactattaactccaaatcatctataatcaatttaatagctaattcatacaatagttatatactacactattaatatctagtctcacatatcatacacactatgtcttgaagtccatgttatagccggttataaatctgtagtccactgctcttctcttatttttttatctttttaaaatatgtttatagttggtttatagcttgctactgtacctgctctaagagcaaggataataataaaaccaattgcttacttatagcctatctatcagctcactcatacagtgcttaactcttcactataaatatatggtccacctatctgtctcacagatatttttatttatatacctaagccgactgtaaacttacagcccgcttctcatctctctcctttcctgtctcattcatctcagctgtctgttatacttgctctaacgtgagtgcgtgacggcggtgttgatgggcgatagaggcgtggcccgcactgtggttggccattcggcctactcagcctcggccttggcggcctggcttgaccaggagccgcagcccgcagccctcgcggggctctcggccggttcgccagaaggctgggcgggtacgctatgccgatgggctgtttttcacttgtttcgccgggcctttccggggacaatgtccgcatgtgtgcgtcgtgccctttctcagccagaggctaatatacttttcctccgcagccactctcaaacatgttaaaaagtagtactgtgtcattttattatgccccattaatacggctccagatttcagatttagagtttgtatgttaaaatgtatgttaatatgcccgtgctaacactacgatgacgatatatgataatacagatcatacaatttaaaatgcatcacacgtgttctttaatcttcatacaaaatttaaagaatggcataaaataaataccgtttcttgttttccttcacaatactgaagttttaatcctaaaaagtatgataatttacagagaaatttgagcactcgatacaaaactcactttatgagcttctctcatcctaggtggcttgttgccatgtggtaaagaaaaatcctgcctagcttcaaaatagaattgctccacctcctacttccctgatttgctcatgtagtgaagcaaatgacatgcgatttaacgggaaaaaaacactaatattttaacactgcttgtgacatagctagaatgagtatctctgaacaaatatattttttaaggaaattcgagttcaataattaggtatagctatcagtcaaagagcatcctcagtagctcaagcagtaactacttaatttactgattcagtttgaaggagccgaacaatctactacagactctggtgcattagggcctgtttggcgtagagctggagctcagccaaacagtttcagctccactaaaactgggagtggagttgggtggagctctctcacaaaatgaactggagttgtggagctggnnnnaggcngntncacaactccactccagacccaacttctgggttaaatttaggagttggagctataacaaacaggcccttaatcacgaaaaaatgtggatcagcaacaattatcgaagcaagaattactgaatcatgagtactaaataaaaatgataagcaccaaacctagatcggcatgagtaccaaatggaaattgataatcataagtactatcgcgacattgaaggtgaaatacagttccatgaccaaaatgaactattctagtctaatgatgtctcgccagagctcattctgtcaactattgccaaacaaataatgtgcatataaagtcacacaaataccaggttattgtgtatgctagactaatgagaagtaatttaaatgagaggcaccttagcacttagcagctagacatttatttctccatatatatttctacaatcatatattgacatataccacttgtataggaagcagaaaagactaacaaatttgtacctgcgttcacatgatacaatcattctctgtgataccaagaactacactgataacaaatttggttcttacatcatttggctttttctaattgtagaagccattaactcagaaggttcaacctccatttttctattcttcatcgcattagcaatcttaaaaatcatgaaatatgcatgtacacccgttggttactttcaaataccaggattcaaagtcatggcaggatttacatccatatctatactacaaatgcatcaagatacatggtgtaaaggtcatagaaataagtgattgtcctgccaaaaaaggtgtatttggttgagattggctttgttagaaatgaaaagacaaataagataggcaagatgatcttaattttagctgctagaattaaggccatgtaataacaaataggagaatttcaaaaaattaaatgattttcctattcaatctaatagtgttttgactttgtgattccttcatatggaagggcagccaatttgtaacaaaggcggaaactgggactatcagatcgtaaaaaatttctaaacaaatgcataatctcggaagtgaagcctaacctattttccttaacagctgaacacatttagaacaaagtcagaagctgagacacctgaacaggacaatttgttaagctatttctaaaatctagatctcatgttagtccatctaaatgttgtgcctatttacattctgagctttaaacttattatacatattttgaaatatataccatatgctgaatctgaataacacaatttgctttctataggtattcataaaaaaaatgcagcaatcctgtataacgtattaacgtatacccaaacaagatgatcttggttatatctactggaaattatgcttggaattgattcagtaaaatgaacttggccaacaagcagaaaaacaacagccgtgcagcagtcttagatctatgtacaccgaataccttgttttatctcaaagggaatatccgcgacagacgttaatatgttcatggcaaatcacaatcgaaaataattaagtgatgacatatgcatttcagcatatggcatcactttattattatgcatttcacactaaaaattatcaaaaatccagtgttaattaagtgatgccaacaacaaagaagattgaaataaaagtgcttgtgatagcacctcgcaacataataatcacgtagagtggatagcaagcacaaaaacaaaatagtgcagaggagcacaaaaaggagcaagaaatagtgcagaagaggataactggcattaccttaaatgcagaggatgttgagcagtagtgacctggagcagatatgctacaagaaaatgtaagctgttaaaacaataatattcagttagaaaccaaactatttgtttccattgaagattgtttaacagagtaaaaaaaaatccatgtgagagactacactaaaccgaccactgcagccggcagctgtataccgagccaaccaaatgaaatcaaatcagaaccttggagctgcattagtttgactacaaataagcgtgagaccctggggtgcagcggcgattgaacctgagatctacttctctctttttttctgcaatgtgcccctgtgccggcatgaagtatgaacacatgtgccgtcgttcacctatacagctccagcaatcatgtgccatcgtttttattgatggaagagtagaaaaaaaatctaataccatgggagattgatttattgcaaggagcagggtaatctgtgaccagctgaatttccagccactataggagcatctccaaacctccaattctgatattttggctatgattataggtctcgagcaagcaaactgatgttgcaatgattttagcttcaataggaaaaaaatgggtacaaatcagctgcatgctaaagatgccatcaataacaaagtaacttaacgggatttacaaaatgatcagagagccatgatctgactctatccctcccaaggttgcgctcctacagaacaaaaacgagacaataagcaagtttcaccagcaaaatgcgtgaaacaaatagtaactcattgcacagatttcagttggcaactaaacatcgaagtttgtgggataaaattttggggagaacttactgctagcatatgggaatttgcctgcgcaatctgccagttagcgagccgcagcttctggcccatttccgctcaactctatgattttgctgcatgcaccaaaacaaagcaaaaatagagtcaaaccaagagcacatagcatcaaaatccccagccactcaaagcctcaacagaagggatgaactgatgcaaggaatcatgtggtttcagggacgtactccctctcctcaaggagccccagaggttccgagttctcctggaattgacacaaaatttagaaaaaaatatcaccgttaaattagtagcaatctcatgaggagatcgagattaacagagagagatgggatcttgccttaccagctgcacaattccctccttgcccgcatccgctgcacacaccggtccgtcatggtccatgggtgtacctcctcattacagccccgcccttggatatcgagctcacgccattcgcggccatcctccccggtgcagcagcggcggccgcctccgcctccaccgctggcagtgccaggatggcgatctggtgggggagcaaagacgacagcctccatggtggctcgtctcaatggaggaggtgcagtggcatccataacgcgaggcggagatcggggatccgcagtgccggggcggggtagggtttggggatttggagtggcggcacgacggcagcggcggggtaggatttagggattgggtgtggcggcgattggcgagtggcaagaatcgcggaggcgatgggtgaagggaacgggcgaaaatagcggtgcgagagagaagggggcgcgtgagaacgggagttacgctgtcacaccattaagatctttcccaaacctaaattgaatttataatccatcagagaaaatatcggtgtaagagcaaaataaaaccctaataaattaatgtaaataataatcggatttgttatgtggaatttttattgagttctacatgtagaaattcgctaacaagatttttagtggaattctcagagctctagaaataattttaaccaattaaaattgagcacaagcaatatttaatcctagaaaaatccatttccttctttttcccttttttttcttttctctttttctttcaattgggccgccggcccattctctcttccccccccccctctttccgctgggccggccgacaggccgaggcccagccgagccggccgcctcccttctctcccccggggtcaccgacaggtggggcccacctgtcgggcctgtccccttcctccagccggcgccgccgcgctccgcaaccgccgccgcgcccacgttcccgcctcctccgggccacgtcggccacgcccgcgcatgcgccgcgtctcccgcacccactccccctccctctcgcccgcgcccgcgctcgagacggccgggattcgaaattcgaatcccgcctctctctcctcctccacctccccacatcggccggcgattcccgcctttaccggccacgtccgggctccccctcctctatttaagcaccaccgccaccccctctctctttttccccatctcgccgagccctcccgagccctctaacgccctagagccgtcgccctccccttcgccgccgctagccgccgagccgacgacgccgtcgcgttcgccatcgtgcgggccaccgcgtccacccctcttccgttggccgccggaacccactccgcgccgttcgccggtgagcaccgccatggccgccgccttcggccggcgtcctcgccctcttccaattccctctccctctctaaccccttccaccgtgttcgctaggtggttccagagatcgtcccgctgtcgccgccgccctccgtcgctagccgtcgtcggtcgtcgtcggtgaggtccctcctccccttcctctctctctcccgcgccgccgcttagccgcttcgccgcccgcgtcgccgcgacgccgtcgccctccgccgccggccggtcgccgtctcgcgccgccgcgcgccatggccgccgggccggcttgagccgtgcccgcgcacgccggccgcgagccacacccgccgtccgatctacccaggtagatcggggccgtccgttcggccgcccacgtggctgccgcgtggccgctgcgtcggcgccacgtcagcgccacgtggtgcgccgtcctttcccggtccgtggactcggtccaccgcggaccgccctcctcgagtcactgccatgtggggcccgcatgtcggcgccgccccatctctctcccgggatttatttattgcgcaataattcaattaaggatttttctgtttatagtaaaaacacagtgaatcttctaaaattcatatctaattcacccgagctccatttaagcccattcaagtatcagtaaatcaagaaaaatgtgtagaatccattgaaaatggttttgttctctgtttcagtagtattatagcctatttgtattgtttgctttgtatgtcgcttagattttggctctcccgacgctccggtgtaccttaaaatagtcgccgaagttcctccagctgcagagcaaggcaagtcatgcttgccacttgaacatgttgatcctatattgcaaatgctccattgtttttcttcaaatactgcattgttttataatatcaccatgggatgtttacctactgtcatagccatactatcttgtaccatgttcctttgttagcttgggatataacatgactagagattggactagggaatgcttagctttgcttagttcaactagcacacaatggggaactacattaaatgcatagatatcagattctaggattgatgttggttaatgctcaccactccggtgttggttaattaattaatattaaatggtgggccgtgggtgcatggttttgatggtcgcgcacagggcaattaaggaccggttcgcgggaaaccctggaagaattcctcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcatgagaggggactgcccgctgccttgcgaggagtgggggtgaaacctgaggtgtggtgtacttggttagagggggttatgcgaagggtcctgtcacggcctctttccggtatgtcgtggtggcatgtcggcgcgcggaaacgtgtcgtggggctgtgtcttgtgggtatagttgtacacctctgatcagagtaaaactattcgaatagccgtgcccgcggttatgggcggtcaaccaaattcaccgtgattagactcaccctagactagtctaatggaattgaatagtataggtggatggttgggcctgttgcaacggggtatagcgttggacagtggatgattaatattgattaattattacaactgttttactgctttcaacttctgtttataaatgcccgctttatgcaaatgaaccattatagctatcccttgataattccctgcatcatacccctattccggtatgacttgctgagtacagtgggtagtactcagtcttgctctattttccccaaaccccagaatttgagtatgcgtcagatggtggtttctctgaggagtaggcttcgtccgtgccgtcgaggatgcctgtggagtggtgttcccgctgcagtccaagtcaaggcttagctccagttatcctttaagttttccgctgcatttatgtaagacttttataatatttgtaagacgtggatctgtatgtcaactttgtcgtttgtgtaccccggccggtcctggacggggactttaatgcacattctgcttggaattctattcgggaatttctgggcgtgacaagcgcggagggaagggggtctcatctggcacgttcgattagagttagatgaatatgagccattggatttgatgaatgagtaatgtaggtgtaagagtgagttagtgaattatagggtagaagatagatgggaacttattaattcatccaattgttgtaacataatcgcaaatcaaaatctatatatttatggagctagaaaacctatctccatgcaatctttagtccaaaaatgtgctaaacaggatccaaatatatggcatagttgccttctttttatcagacttagataaacaatatctatttaattacaaagtaaagtgaaaggagtatctctaagttgtcatcgaaccttatttgcacaaatattactagagaatataaatagtcaaacaaaatttaaaattcaacttcgttatatgtttagaaatagtaatagcatattagaaataaggatttgtagaatatttaaagattgatacgcttatatttttatcgtatccttcattacatctttatccttaagaagcatcagaacgtcacaattttataaccagtgatatagtgtcgggatacaaaaggaaggtgagaggctaagaataaaacgagaagctcatctacatcaattgtatgaagtagtatgagatagaggagtggcaacaaggacgatattgtgcatcttacgcaagatttaaagtgcaacccgaaagaaaatcgaggttagtgaatggacctactagcgatggtgatgatctattgatggtgttgtttggggtttgttggtggctatattttagggcatattacacgcttgcttgaaagtgaagaagcatggccagcttcacatattgaccgcacatacaagtctaaggcaaaagacaactatattccgcgctctaccttgtttttctagggctcaaaccgtaaacacaagttgctatgggtttagggaaaccactccagttttcatcctaatcgacatctttaacacaaatgagaacttgatcgattcctcgtattgttcaactcacaatcatacaacatgagagagtgtgaaagtcatttggaatagatatatgggatgttgagaaagacagtataaaaatgatgtaataggtataatcatcatttttatcatgatttgccgacattctaagataccaaacaatcagcctcatcggatgagcatatgaaaaaaaaaaacgccaactgacgtattagccaaaaaaaatatataatttgtgattagaacttttacaatttcgtggcagggggaggatggtaaggccccgtttagttccccaaaattttttccccaaaaacatcacatcgaatctttagatgcatgcatgaatcattaaatatatataaatgaaaaaactaattgcacagttagggagaaaatcgcgagatgaatcttttgagcctatttagtccatgattagctataagtgctacagtaacccacatgtgctagtaacggattaattaggctcaaaagattcgtctcgcggtttccaggcgagttatgaaattattttttttattcgtgtccgaaaagcccttccgatatccggtcaaacatccgatgtgacatccaaaatttttttttcacgataaatgaaaaaaaaaaaggccatactgcccggctccaattatccatgaccgtctcgttctcctttcctcactccgatgcacctgccctcgccgactcgccgttaaatgccaccgacacactccactcctcgctgccgccgccgccgcatctgaccacccggcgatggcgagaccggcggcgacggcggcggcgccgaaggcgccccctccgaagcacctgattgcgctcgccgtcgtcgccatcctcggcctcgtccttgtcgccgacttcctctgggcctcctcctcccccgccgcccccgcctggtcctccaggatcgatctccccggccgcccggccgccctcgtgccaccctcggggaagaaggtgatgctcctagttcccatctcgcagcgcgcacacacactcttcgattgctgcctccggtgccttctagtgttctgtgtggtagtacggagtcgcgcgcgattagtgagatctggttggaattaggtatgcctctgtggtttggttggactagtagaacacatctgggttgattggtatcttcccctcgacaccaaatgccttgctctctagttgcacttatgagctatagtttaggcatcacctttgatagtactagcaggttgattgcttcctgaagggtcttgatgtgccggttgtgaaatttgcaacagtatttttgcttcttaggagaggaagaaattaatcatgcattcatgcctgcaacttctggttgagatttcagagtgaagagctgtttgcgaacagtaatctttaggagaacccgcaaaatctatactcatgctaatgtttatgaactgtaatctctgtgtttttgaattaacataggcatggaagcagcaaacacatgctaaatcatgtccgtttcaccatttgtttgagctagaagcagcaaaaagccatctgattttcattccgatcccatgccggattaaattaagactacttattttgctgtaactgccagtttttgtttatctaggcatatacagtcctaccatctaatctaatatcttggtcctacacatcagagtaaacacttaattatgtttgatatcttatttctgtgtatactgcatgaatttggcaagtgttgtaaaaaatgtaaaaactcatgtatctcacttcgatatttcttccccttcccattagttttattatataatgacttatgctatgaggactgttggcgtgatctataattttgtatggcattttcaagttgacttgttttttaagtagtcgtttttttttaattttcttgtgcagcaaacaaaggaaaaaatatctataggttccacggacataaatgcaacctttgcagatttgccagcaccagaactacaatgggaggagatggctgaagcacctgtgccacgtttggatggtgctgctatgcaaattaagaatctcttatatgtgtttgctggatatggtaccattaaccatgtgaggaagcttccctgttatctctcgcatccagtcatactttgtgctctttttcttgtatttataaaatctcttgctgaagaacaacatatagcatgcaacatatttaattggtgagttggggttacagcaacacattatacttgttccctttcagcaatcaatgacctagatgtgtaattggacttatcgttttggatcactcaagttggctacctgcaccattgtttttaatgaaatataaattcacataatattgtcaagttgtatagatgacctgtgttccctagcttgtttaaacatgatcttccttactaaaacacaattgaagtacttgtgcttttggttagcgtgatcccattataatcatttttggctgaaagtttaatattaatggtgtgtgtatatatggcttagtattgccagattgtgaattaacccagtaattccttgccctgctgattttgttggtacttttaagtttaccataagttaattcaagatgccatcaagttatttaaccttttctaatgttttccatgtataggtgcattctcatgtggatatttacaatttctcagataatacatggggtgggaggtttgatatgccaaaggaaatggctcattcacatttggggatggttacagatggaagatatgtttatgtggtaacaggacagtatggtccgcaatgtagggggcccacagcacgaaattttgtgctggacactgaaacaaaagaatggcacgatttgcctccattgccagttcctaggtacaaacagtgttgtatttaggcattattgtacttgtatggtcatgcactcccgttaatcttaatactacttttgaagtttggatatttggtctgttgtatgctgtcaaggaaaaacaaatattgttttgagcccttatttgtttctttctttatcccaaatctattgttcagatatgctccagccacacaactttggagaggcaggcttcatgtgatgggtggcagcaaggaggataggcatgaacctgggcttgaacattggagcattgcagtaaaggatgggaaagccctggaaaacgagtggaggagtgaggtaccaatcccacgtggaggccctcataggtctataactccccctccacatgatttctattgttgccatttttgttggaaagtaatgttgctatacacctgaatggtcttgatgtttagcatctgttgtattcagatttttatgatgccgcccacaatatgtatgcttctaggctatttctttgatcaagtatctaaattaaaattagttctgggccagaaatatgtttgtacgccatacaaagttcttatgtggcatataagtatataacctgtttccgagaatggtcctgttgttagcttagcagcttaatcatgatttttctcttttgataccagggcttgtgttgttgctaatgataagctacttgttattggtggccaagaaggagattttatggcgaaacctggatcacctatatttaaatgtgttagaagaagtgaggtatgctgatctgtagctcaatcactatatatgctaatttctgcatattgtataggaatttgttttgtacattttgaagttcgacatggatcacttttgacaatgaatagtggaaagtctggttccactgaaggcacaaaatgtataatgtgttacccagtagatggtgatttaacttttgagctgtccgcttaacctgttttagcactttgtgaaattttacacctcctagagacctatgttcattgttttcttgtaataacttttagattttgttctatagtcattttgatcttctgcctatgcaggtggtctacagcaatgtctacatgcttgatgatggaatgaagtggaaagaatttccacctatgccaaagccagattcacatatagagtttgcttgggtgaatgttaacaattctctcattattgctggaggaaccacagaaaagcacccaataaccaaaaaaatggttttagttggtgaagtgtttcggttcaacttgaacacactggtacatgcctttccttgctccatattttagataaaacacttaaagtgataagaaatgatggatataacatgaaacatcacctatcaactgcctgttgtttgtttgtcgtgtggtggtttagatacttcttgttttgcatcattcttctgtttataagcacataaacccagtacaactcatcatcataaaatctatccacagaacaatatgaagccaagaaaaaatgtaaatcagtaaatggcaaacactacgaaaggaaactttggaaagtgcactgcatgtcagtaatttcctcagcttgtcaactttgtattgctactaaaactattttggcatacaggaatggactgtgattgggcggttacctttccgaatcaagaccactctggtaggatactgggatggctggctgtatttcacttctgggcaacgagacaaaggaccgaaagacccttctcctaagaaggttgtcggatgcatgtggagaactaagttgcacctgtgagatttttagaaggaaaactgatatgaccattgactaagcccattctttatgcattcttttgggtacataactgttccattcccctatggtgggcgagttgtttattatcatacgaattgttggctttgttgtgcattgtcacatcatgccactaatctgttgtatgcttacctttttggttatatcatagaatgaccgacttttacgcaattttgtacagagaatcagagataattgatcttctgttcagtgattggagtgtgacagatacatttgcacttgagttactctaggttagcaatactggtatccagtgggtaagcattcttactgttacttataaactgcttacatagttcaacataaataaccaccatcaggagactctgcagtaacttctcaactggatttgagcccatattcagtatcctaaaaacatcaacttggtatttgactcttgagttattctggcagttgacttcagctctatcaacttaacacctgtcacatgctctctgtggatgtaagtgcatgttctctgatacctggtactttatacccgtgttaagctttattaaagtacgctggatggttcgctcattatgatttatgacctaatgtttctgttagattccacgtcttggtgttctccaagacttggtttgtgccacagattgttttcaacttgttactgttgatgaccacaaaaccccattcccatgaatatttttgcacaggaccatggtcattggcaaagcaggccatatcgggaggaaagctattgctgatcgtgtagcgctttctggcttcctgccttttgccaatcttttcatctcttattaattcccctttgttttgatgtgcatcaacattttttaggctctcatcgaactgcactcctgctgcatccagcttttcctgatgtttcagcttttcacaaggccacacacaatggcgctattagcgtgtaaaacaaccatatatccctatactaagtagtgtctgtatagtgctttcgttatctatccaaaatgtagtctaaatcatgcaacgaagtgtcgttgttgggatcacaaatagtctattgtttatatagtcctttcatcatccagcctaatgtaagtcataatcattcaacaaagtgtcattgttgggctcactttttcttctctataaaaagccctaggcatacacaaagcttatatacagttaatcacagcatcacacacatcaattggcaatagtctcctccagaaaaaaaaatcaatgggtaatagtttcatggtaattactacttagtcccttgccgtgccatttggggtccccttctcttccggtctaatgaagctgcaattagcacatgtgggagactttgcactttgccggtcatctactggcgctgtaggccatccaaaagcaacatctcagtcggacggagaaaaaatccccatcaaatcgcagagatttcacgtgaccagtccattgcaggatggtgatatctctttcctcggccgcatgctcatgatagacgcatggcacatcgctggtgcctggatttctaaacctgattagatatttgaagtgaagaagcttctttaatctttagtttggccctcttcctcgcttataagctgtataagaattggtccttggactctgattagggggctaggggccaaaggtaggataccggccgtgttcttgttcagctgttctccttttctcggtagaatagtcgacatgtcttagacaatgaacaccctttagtaaataactgggtctttttgtttgagctgcggcttacaagctacaataaaatttgaattttccggtgtcaattagtctcaaatattgaaatatcaagactagaggtgtaaaagtctaaccataaaattattttctgtttagtcacgtgtctacggtttaaaagtaatactctgtgtccaaagatacacaagatttttactataccggtatccatatacatataagggattttagctatataccagcggagggagtaacagataaaaaaaaacattgcctcagcaaaagtctctagtagttaagctaaactgctagtaccatttttataccaaaggaagctaaactagaacggtagaacctataaaccactgctgctccaactttggtgaacacccacggagttgtgccaaaaaagttagtgggggcgaagggcccaatttggccattttcctagtctagttgcaaggcttggagagagtagtcaccgccttcaccagccgaaaaatcgtgtagtacaggagaggtcgccgcggacgacgcgtgcgtggacgggcgcagcagcgagtttgcatcggcggcatcgcacgcacccactctcccttggcccttggatacatggggcaatcgggcacgcagccacgcaccacgcgcattttgggattcgattgcaaaaaaaaaaaaggagtccaccgaaatggacgaatttcggaaaatttggatgaattttaatcaaatttaaaccaaatttgataaaaattggtaaaaatgaaccatatttaggtgaaatagaagtgaattgttgtcttggaccttaccgaaatgggtgaaattcaccgacattcggacctttcggaccgaatcccagaatcttgaattggtgaacgggacatcagccgctgtcgtctagcttggttttcccgttaccagctcgtcggcttgattcagctattgcgtttgcatcatctaaaacgaggcggtcgagaggatggggaatcgggatagtagcgtaggttggtggcttcaattttattttcctcctccgcgtgttgtgggtgactgggtgatgggctcggtagacttggcccgatacgatggcaagcacgtggctgggcgggggatcgaacggggcagatttttgggcgacatggccgcgcgggtgagtgagcagtaacagcgtgaggattataatattttatatgataagctattgcatttgcattattgcatagtatctggcttgcccacaaataaatcacgctgttaagaggggttagtcgctgtaaccaaaaacatggtttatactactctataggttggcaaagtttggtttgtgaaggttttttttttttttgcaagattttttaaggattttagctcggttgtgcaagggcgtggagctcagtggctgcatttacttaaacaaattatttacatcctcagtttactatgtaaaggatcacataaataagaaattaagtttttgaaaaataataaatgaaaccaattgagaataataatatatatggaccctcttcctcctatgtcgtctctttcgagaatgacggcaatcagaaattaattcaaacgaatatcagttggtgttatcgataaacgaatgtctctatggcaatctgcatttggatcgagggttatgcttaattggcacctgcaacgagcgtatttcaattattgctatctcacgtagagcacacaaccaatgattcctaagaattgaggtgacggtgcactcctatatgtccctcaaatatgggacaagaaaaaatcaagtagagaaaaattagtcctcaattgtactagtgatagagcaagttgaaaccgtgcagtatgccatgtggttagagctcacaaaacttaaaccgtggtaatccatagatgagcacacaaaatgaccatccaatccaatgagttgattcactctcacaacggcttctatttggatagcatatattttatagattttccacatgaaatagttccatttctctaaatttttcagaaaattcctcctatttaaataggctcttaagcttaggcttacgtgccacagctatagttataattttcaaacttaattttagaacatattttatttttacacacttggatttaaactgctaaaatagaagtgtaaaatctgtactgtaaaattatttttgttgcatcaatcatcttttttcctctcacaagacacaacccaaacaatatcttatgaaccatcacaaattcatgatgaagatatatcttacattaatgacatttataaacggctagagacagattttcacccagcccccgaactcaattcaatggcacaacaaccggactacaggagacgaatccacgacgatatgtaagctacgcaactcctaaaactctctttaaaagacggtagtcctacattgaaaacactccttaaactccttaacaccgtacaccacagttacaaaagcacacgtgtcgtggagcccgaaaatcgaccgagagggaaggaaccaggccaaaaaaaccgcaccactccgcgcgcactgtcactgacgaccacggggacagtagtcaccaccaccaccaccactgtggctcggtcacttcttcccaatctcattctcatctccctcttttttttccaccaaaaaccaacccctccccctccccgtcgcagcgcggcgcagcccaacccaaccccaccaaaacccgcaccaccccccatcatccgctccaaccccccgcagtttggtctccccacctggttaaancactcccccccacccccaccaccatgcctcccttgccgcctcccctcctcctcctccttgcggtcctccttgcaaccgcgccggcggcggcgcagtcggcgacgccccgggaggacgacgtgcggtgcctcaaggaggtgaaggccgagctccgggacccggacgggcgcctctcggcgtggagcttcggcaacacctcggcgggagccctgtcctgctgtcgggggtgtcgtgctggaacccgcaggagtcgcgcatcatcggcctctcgctctccgggttcggcctccagggcgggatcccctccgcgctgcagttttgcagcgccgccaccacgctcgacctctccaacaacgcgctggtgggggttatcccgcccgcgctctgcgactggatcccgttcgtcgtcaacctcgacctctccgggaaccagctctccggccagctccccagcgagctcgccaactgccgcttcctcaactcgctcaagctctccggcaactccttctccggccagatccccgactccctcggccgcctcgaccgcctcaagtcgctcgacctctccgacaacaggctcgacggccagatcccgccccagctcgccacgttcgggaaggactccttcgccggtaacaagggcctgtgcggccgccccgtgtcctcgcgatgcggccgcgcgctgagcggcgcgggcctcggcatcgtcatcgccgcgggggtgttcggagccgccgcgtcgctgctcctcgccttcttcttctggcgttgcaccgggaagagcaagggcggtcgccgccgccgccgcggagggagcgagtccggcggcggctccgcggaggacgggagctggtgggcggagcggctgcgggcggcgcacaaccggctggcgcccgtctcgctgttccagaagccgatcgtcaaggtcaagctcgccgacctgatggcggccacccaggacttcagcacgagccacatcgtggtggccgggagctcgcgggcggggacggcgtaccgagccgtgctgcgcgacggctccgctctgacggtgaagcggctccactcgtgcccgttgtcggagaaggcgttccgggcagagatgggacgggttgggcagctgcggcaccctaacatcgtgccgctgctggggttctgtgtcgttgaggatgagcggctgcttgtgtacaagcatatggagagtggagctctttcttcggtgatgaaggagccaggggaggcaccgctggattgggcgacacggcttcggattgctgtcggggcggcacgcggtcttgcttggctgcaccatgggttccaagttccgcaaattcaccagaatttgagctcaagtgcagtgcttctggatgaggactatgaagctcggttcacagatgttgggcttacaaggctggtccgaatggcaccaggcgagggtggagatacaagccccttcctgaatggggacttcggggagtatgggtatgtcgccccagagtgtgctagcaatccagttgctaccatgaagggtgatgtgtatgcatttggtgtgatactgctcgagctcgtgagtgggcaggaggctgccactgtaacgggtgatgcggcaggtgaaggattcaaggggacattggtggattgggtaaatcagcttaaggcctccggccggatcggtgatgctgttcataaatcattgcgtgggaatggccatgattcagagattgatgagtttgtgaagatagcttttgcgtgtatcatggttcacccgagggagaggttctcaatgtaccgggtttaccactctctgaagagcattggacagggtcgtgatgtctcagagcaatttgatgagttcccgctggcctataacaaggatgaatcagataccatgtaactaatggtggtggtcttgcttgggattgtgaaccgccctcggtcaggctcaatggatgcttctttgtgtagtcctgctacttgaattgatgaagagcatgctgaggcaaccatattggcatgataattattgctggatgatcaattcgatgcttgcctcatctcctgtcgagataatcgtgtaagctgtaagattttagtctgtattgtctttttacattattgctagcgcttgtagtatctcgctttatgcctaaattctgatatgaccttccttcttggaacaacttgcctccttccccaatctcctaagaacaatattggcagtgaacaaaattaatcttgaccaatttatctaaagtttacaggaatgtttcgctctgtcatgtactcatgtccttgaaacctttttcaagtagcatgttatatcatttgccatcttctctttgtgaattttcttgatgataccatgtaccttattcacatccacttaaacaatgctgtataaacatgatttatcatagttactattaagtgcgcccttatcagttcataatttttcagttttgatgtcaaaatctgtatagctataaactgggtgttatacttgtcaaccttggaccatctacctgtggtcactgctctatattctgaccatacatttgaagcatcacgattggaaaatgtcaccttcagcctcgcttttagccattgttttctaatttggttgtgtaccggtatcttgagtgttatctagttgtcttacttgatgtattgtatgctttctttgatttcaaagtcagctcttggtggcaaagaacaattatcaattccctttgcacatgccgttccacaataattgtcaccatcattgaacaatcgtaaatttgacttacctgcggtagcgaatgttacctttagactacttcctgttaagattttcttcacagttaacaagatgatgcgtgaagtgactctacatagataagtataaatcgagaggtgaaaaaacgggccgtaccttttgcaaccctgttcgaatcatgtgcttagctggtgcctgcagttattgtactatactgctagtggctgctttgtccagatttgcatgagcatatgctgcacagagaaaatgcggtgagatcaagacaaaaaaaaaaacgcggctgcaccatataaatcttttctactactcccaatgttgcttccaccaatcaagcgaacatgtcttagcctaattacccaactccctcccaatccagttcgacttactcactgtcagtctctggatcaattgacagcgctcatttaccgcggttacatttcgcaaaagtttggtctgtgtgttgctgtgtgcttcggagttacagcatcgatttgctggatgtgggctcaatggacaacggttggcatctgcagatcggctgatgctgggatgatgatcggggccttgtctctgaatgataatgatagtcaaggacgaggggacaacggagatttttcctcaattatccgtgcgactgtgcgagtacaaacggtgaacgcggccgtggattatctcgtttttccccccctccaacccctcggcttcgtttccacggcgaccagtcgcgtgccgtgtaattatcgcctcatttttccggcggtttagctgtttttccccccggcggatgttcggaccaacgacgttgaacacccctcggcacgatatgcctttggcggcttggcctcgggctggcacgatgtggtaagctggcagcgcgaagcagcagcagctctcgttgcgatctgtacacgcggatagtctccgcgccagatcggaggttggaagttttgcggggaaggggtggattgcagatttggaggctttggacgacgcgagtggtgtggtgctcggcaacaacggccgtgaccggtccaagtcgctgggcgcatgtcgccgtcgcacgctcaggttcccatcgttgaccgacttggccgagctgcgagcgagtcagtaggattttacggcctcatcaacagccacaaggtgacaaggggggaagagtccttccaattcttgacgtgcggtgcccgcaaccaaacagaactgcagaaatgttaaaatgctgtagatttccatgtactcccatcagagatgactttgagaaggctgaaactttcatatcactcttttctccgcaggtaggatgcagcttaagctactggtctcgaatacagatgcgatgacgatggcaactcccttgggagttgaaactttgcgggcattggcctaactagttcgcctgatgcaataaggttgaaggctgaaacacagattgctcagcttgatgttagccatctaaaatccgtccacccgacaagaaatccacactacagatgtgtgcacatcccatgttccctcgtgcttttatctcagctgccctgttgcacatgactacatgaggcaaacgatggtcccggaaggcattcttatgccattttcaatcaaacaaacatcatacaggcaggcacgaaagatgaaatagacccacccaatcaaacacatttctgatagccacaaatgatttggtagggtgaaatggaacacggatacagaaacctacgtctagtgctaacaccgctatgccaaacaagctcaacaaagagaaacaaggcaccccagcacttctgttacttgctgacgagtgtttctactacaggaaatgaattagcaacagagtgattttcactggtaatattcgtcgcataggccaagcgtgaaatgtagtgaagatcacaccacataacggtacgtcacatatcttccagcggtctcactagcacggatgatctttacaacttgcccacgcttcatgccgtaatatcttgctattgggtccgtaatttgaatccgggggagctgcattcataatacaaattcaatgtcatcagaacagaatgtgctactgcagtaaagtttacagaaacatctgcatgtggagtccattcaattagttatctaataaggtttgaagttatcttgataattgcgaagacacttatattttagaatgaggtgtcaaaattgggggatgtaaaaaacgtaaaaaggaaacagaggtgactggtactcattgaatttcttctattcccttcagaaattatgtatcaaactaaacagattgcaaattaacaaagaaatagaatgttagaacatgaaaacaaagagcttctcagatcaacatccccagcacatcgggtgccttatattcttcccattatccaacatgacacatgccatagtaaagaatcacatgcaactgagtaagtcaatgccattagagtatttatcatggtaactttgtaacaagacaagctcgtcagcgttaagatctgaaagtgtcgcattcgaagcatataaataaacagaaccttgatatcctattgtattaggttatgctgctaccacctcatataacattaaaactgcattatcacattgctcaactagcagctttgactctaaaacaagaaccagattgtcatttatcgtgattgtctactgaagtgatatagaaaccttgacaccttgttctgttaaactatgacctaacacattttatagaaccagttatcttaaaactaacatgaacaatgcaagttcgcattgtaaacaggacataataaacaacaataagttaaaagttcacaaaacaagattactttttttaaaaaaaactcgaccaacctaggaggaactaggtggcatttttaaataagaacttgggtggtctgggcttacattcacacacttgaccaactgagttaggctcagtatctaaaacaagatgacttaaaacaacaacaacattatgaacagccctggtttccactgccagacaaagttcaacagcacataaacctgaatttacttctcttaacaattagaaaaaaaagatcgataaaaagagcattcagggaatgtggttaaaacttaaaatgtatgcccccactactatcaattatattcattctaacaaattttattcatttgcagcactgaatgtcagagagaactgttgatttattagtttattagatggtttacagcaaggagttaggttacctgagctgcgatgtgttaactagagtgcagcagataccaaacttcgaatgcagtacaggtaatgaaggggagtttatgtaaacaagccacaatgtctcgaaaagtatcaaggctatgaggctatttcctcatagcctcatactttcctatgaggctactagtaattactagtcactagtctatttcctatgaggctatgataagtatcaggaaatatgtgacatgtttaatggcgacacaaacaatacgtatgtatgcaagcctcctggaaaattgtcatgattcaccaatagttgtccaaaaatgctgcccacaaaaccttttactgttgtgcagatatcaacacatgaatgaaacatcgatgacattatgctcaaatcaattcaaatactacacctatgagaaaataaaaaatgtctatttccagacctgagtctctttcacggtataccgctccagcagcgtcttcttctgctcaggcgtcaggagctcgtgctctggcacaagggtatgatccttaatgttcacaagcagttccgcttcctgcacaaacaagtgctacctcaaaccactgctctccacggtgccagtaataaatggggagtacacgagtacagaggcgaatggatgtggcaagagggcggacctggaagacctcgaggtggaacttctgggagacctcctgcacggcgctgcgggcgaacgcgctgagcgcctgctgcacgacgaggatgccgttgaacacgctctcctgcttcatcctctccacgtagctcctgatcgtcttcaccccgggcttcgcgtccttggggaagaagacgtagatctgcgaagaggggaagaagaggaaaaaaaacaaattcgcggcgaccgctcgtcacaactcacacggtgtgcggcgcccgcccagtcggaaaacagaggcggcggcggcggcggcggcggaggaggaggagccgtacctggtcggcgccgttgtccttcttgtggcggctgaagacgagatggtcgcggtcgacgggatccccgaagcgtgcgacgaagtcgcccctcgggaggtcgatgtccaactccgtcacgaggtagcccctgtcccgcagcatctgcatcaccgtgcggcggatgcggaaaagccggctcgtctcctcctccgacgccatctatctcctctcccttccgccgccgccgcggggtttcgctagggttttgtggggggagcgtccgcgccgacaagggggaaggcgggagcgggaggaggatggcggcaggtagggtttcgattgttttgggggagaaaaggctaagctcgccggcgccgaggtaagtttgggttaagtcggtcggtcggactcgcacccgagttgggttcggtggatttgggccgagcaaagcattggtgctgggccgaattcagggaggcaaccaaacgagagagagcaaacccccgatcacaggtgaagtaaaagagaaacagatgcaggttttggcacagccttgttttattcgtgaaaagaaaacttttaggagttacattagacgtttgattagatgttaaaagaggttttcagacacgaatgaaaaaactaattttataactctcttagaaaccgcgaggcaaatttattaagcctaattaatccgtcattagcacatgtagatgtagattattgtaacacttatgactaatcatggattaattaggctcaaaagattcgtctcatgatttccatgtaaaatgtgtaattagttttttattttatctatatttaatattctatgcatgtatcaaaagattcgatgtgatatttttgggaaagaaattttgggaactaaacaagcctaaaatggtcgaggttttactgtaacttactgtaaaatttctcgcagaacaatcatcacaaaaaaaaatctaaaaagcagaacggctgcagttaatattgcagcaattttcagacacaggatgcaacatccaacgatagcttcaataattcaccaaaagcaatcatctctgcttgaaatgtttcaggtttttactccatcaaaatccgagcgaactaaacaagcactgaccatagatcattccaagtaatgctgcaagaaattactgcaacctaaagaacttacaggatcacagcaacatggcagaaaatgagtcaatgacttattcagagtagttcatcgatagtcaagcactgactcgaaaatgacttatactcatctcattccgaacttattcagagtagttcatcgatagtcaagcaactcgagtcacaaattctgacggaaaggcaaagaggatgaacgcgatactacgaccgcctaacgaactgaacagaaatctccaaggaacccgagttacaatttctcccgggaagaaaggcggacgaatgcgatactactgcaaccacctaaagaatcgaattgaaatcttcgaggaacatatctgacaccgatcaactcgaagaagactggaccaagaacacacaacactagaaagagaactgccatcaaaaacagaaaacgacgaaaccaaacaacctacgcctgcacatcgtcgatggccttgacccctccgagctccgtgatgagtgatgaccaccgccgccgccgccacccgccgccaccgccgcgtagatcagccgcgatcagccgtgtcggcggcgccctccggttttccagggcagcacgcagctagcggtacggcggcaaagtcggcaggccatgccgtgctcgcggagccacacgtcgatgcacgccttgtggaagacgtggtcgcaggagagcgtgcggacgacggctccggcatccttgtcgtactggcacatcgagcagtcgtcgccgcccagctcccggtccagcgtggtgacgccggggagcatccacacccgcgcagccggtacggaggcgttcacggcgacgacgacccccacgatgcctccccaggagacaccggaggtgacgaagagaaactggaggaggtcggcctcgccctcgtccatgggttccgcgctcgtcgccgaactcgacgccgtcttgtggcgcctcgcgcagcccttgtcgttccgggcagaacccggcggcgcgcggtggaggaacccgcgcaagccgccgccgactccgctcaccggaaagtgagcaggacgtggtacgtagccaagacggcggcggcaatcagaacgcgaggtatggcgtcctccccctcgccgaagacgacgacgaaggcccccaactgggtgagggtcaagacaaagaccgaaacccagagcagaagccgacaactccatcgaaccatgtcgcggactctgtctctcgccttggactgcttctgcttttggaatgtggcggtggcgatggcgcggtggcaatggtgatggcgaggtaggcctcgctggctggcctacctggctgcttatcaaacgtgggtggtgagcaccgccgccgtcgatcacagatcggacggtggaagacggtggttctggaagatgccaaccagttagttccatgtagtttggaggtggaagaagagggatgccttgccttgccttgcgttgcgggatgaaacggtattgcactggaccccacttggaaggccaccggcgagcttagcgtggtccccgcgcgcgcaccgatgccgttgatcgcagatcggaaggcggggagtgttcggctagttcgttaacgagttcttgttcttagtgagcaatatgatttggccgagcaagaaacaggaggcttatgcggctgcctgtgacggattgggtatttgggttttggaatggtaattgtggttttcagtttcctgcgaagctaagcaatgccaagcaaaaacatgcagtaggctatagtacaaccacttcagtacttcactactgtattgcatccttgaacttgttcagttcagttcagttagtttctgctgtagcaagttatctctgaaaatgaactaacacactactgcatgttgcatctgtgataaactttctaaatttctaatcaaatgaacttgcaaagtgcactccatagctacgggatacaaactagtgttagaactaagaaccaagatggcaaacccacacaaaattcagatagttcagatagcattgcagaattttagaccctcaatggcatgccgtctctctccactgaatttagctggtcatttctgttaaactgtatgatcaaaaaaagacttacagagttaacagtgtactgatcaattactgtaaaaatcggcaatgccgccgaacgatttctgaaccaatatgtagttctcaacacaagacaacatatcgattaatcagtactaattcaggactagttattggcttctgccttcttgcatcgacaaattcaagaattggcatccccaaaaacttcagatgttcatattccatatccagatattcagacttcaccttgttacaggggaagcaacatgggacacagttctggccaaagtgaatcagaaggaactaaggcaatactactaccgaagaaatctaacataaatcctaagaagaatctaacaaaaatcctaagaagcgcctcaaaaatcatgtggcgagtggcggcgacagcaaaaaaaactaccagcagcagagggaactatccaaggaccagccatccaggtcagacatgatcacacacatcagagtggagaagaaagcgttagaatcctaagaaccgccctcgaagatcagatcggtggtggcggcgccggcgatagggtctcgtcgttgtctccgctctccaggcctcgaagcagcgatggtggtatgtctccccgcagcaggacatggtgatgacctcctcgcggcgcttcatgccctcgcggcaactggtctccttccgcagccacgggaggcagccctctcgtctcgtgcgttctgtgtcgattcgaacttcgaactttcgaaggacggcagtggcgcggaggagtaggaagcacgaggttaaggtggggcccagtacaaccgccggcttatctagaccgttgatcggagaacaaacgttagatcacttgccgtgacgaagtagagctcctaactaattcgcaggggttaacggaagtgcattaggattcgtgcttcttttgttctcggagatgacttctcgtcgcgagatcatacacagctctacgtcgactcggcacgcgagtcctaaaccgaaccgacttccgatgcatgccgactctctgtttcttctaccagtataagtatcgcccccgtcgacgaccggctgcaacaaagatagtaccacacaatcgtcgcttgccacacaatgacagaatccacaaagatcaagtattgtcgcgcagattccggctccggctccaagcccttgtcagcagaaacaaagacacgtttgatggcagacgggaagaagattgacgaagaaaagaaagacggcactgcagttcgtcgtgtcctcttctggttcgccgtcttggtcatccggttcgcgctcctgatggcgatgcactactaccacgtacggatgatggcgaaacttgaaggaactaataatgatggttttggcctttttcttacatgtagccactatgttttaatggctggctttattataaccagctgcatgggttactagctagctacatgggtgcctagccgttttgatggctttgttccaataatatcgttagtgtaagctatacctttttagtatgtcccttcttctgaatttaaagctttactgtaatgaatatttctcatatttatatatatattgtttcatccgatagtactgttaatgcacctttgtattgttttccattgggaagtctatctattttagattttcgttatgctttgtgcggttgtcctttcctgtactatcatcgtggaagatttacataattgcacaggctgttccgttactgaacaatgagatgggttggaacaattggctagggtctagttaggggattagggttttttttttgggtggggtaaacacaagttcggtacgggcgaggagagcgcaagaacaagatgatgatgatgggtgagggcgcgcatgaacatgtggcggcggtgagcggcgtggagggaggaggaagcggtagcgacagtgagatggccgcgcgccatataccaccagctcgacgcgacgcggcattacctgccgtcgaacgaggcggcggcggtggacgcgtacgcgtgtgatgggcttaggatgtaacgagttcaaggtgcgacggtgcgcgcgcgggcggagccaggactggacggagtgccctttcacgcgtccgagggagaaggcgcggaggagggacaccggacacgaggccgtactgcgactctggcacggcgtgcctggacttccgcaagggcgggtgcaatcacggcgacgcgtgcgagttcgcgcacggggtgttcgacaattcgagtgctgatctcgcgtaactgccaggatgagaaggcctcggcctttttctccttcccatcaggccgaacaggcataaatccttccatccaatggatttaggaaaaagtatacttcgactccctcactatgacccgagtatgatttatatcctccaaccacaaaaccagatatatcgatccaactatcaaaaccggtgcaaacaatgcctctgtgtggttttagaggtggttttggctgacatggcgcctacgtggcggtcttgaccgggtctttgtcctacatgacgcttatgtggcattagaataaaaaacattaaaaaaatatgggacccgttgacatcctccctctccttcccttcttcctcctccctccctctctcccttatctccctttctctcccccggcctggtggcgtcgtggtcgtcgttgcccatggccaccggacgccggcgccgaccgccgccgctcccgaccaccggcgagctccagatcctcccccgtgcgcggacggacggcgagctcctccccgcacgcgcacccccaccgcaccgccgctgctcctgaccaccggcgagctccagctcctcccccgcgcgaggacggcatgcgagctcctccccgcgcatggacggccggcgagctcctccccgtgcgcggatggcctgtgagctcctccccgcacgcggacagctgtcgccgtcgccgtcgttagctccctccgccatccacggctagctgtacgtcgaagcaaaatcaaaggctagctcgccgacgccctgggaagcagcatttgactgcagcacggcggcggcgcagccggggggatggaccctatcctcacctctaccagcacgacgccctcactgggtggacgagctccctctgccgcctcccgccatccgcaatcctgcttccgccacccagacccgtcgccggcctccaccacgctcgaactcagctgtcgccgaggggacgggacccacggaagccggcggcgcaccgatggccttcgtcggccttccgcctccgtcggcttgtcccaccgggcaccggcgcacgagatgacatgtggggcccacatgacagtgggtcccactattttctgtgtgaatgacatgtcggtcccacgtatttttttttgtttttactctaaaatgccacataagcgacacgttaacgacacgtgggacgaagattgggtcaacagtgccacgtaggcgccacgtcagccaaaatcgcttccaaaactactcagggatatattttacaccggttttgatagttggaggagtcaatatacctggttttatggttggaggttatgaatcatactcggaccatagttgagggagtcaaagtatactttttccatggatttaaggcttgttttatttccctcccgggcctcattcccatttgtgctaaagcccagattccctggtcctttttcacccctccctaaaaccaaaatctattgatctcccctccctccctcagcccaaggaatgtttccttcttgggaaatattctatgtttagctgctaatttgctgtgatgcatctcggttgaccggaggtaacagcaattgtgtcccaggactggtactgagttccgcaacgtgaaattgacatatgctgacatgcctaaaagaacagcatcatagattcagagagaagcaaggtgacactgacaaaacatatcccactgaaagaaactgcattacaaaaacaccatttacaggtaatactaatactgaagctccaatcacagtctccaactgctgaagctctagccacactaccggaaacatcacatattcagatagtagcaaggcggagattaaactgtgaatctaagtatctgacagaacaggtactgtgaaagactacagtgagatacacatatcagcctaagcaccgtgtccgttatggcataaaaatccaatgagagctcataggatccagtacactgaaggagctcaacgtttgtcaaattaatcatcaacacctcgaacaccacctcaaactaaagattagcattcaacttattagtaggccgaatgaacaaataatccatcatcaaatttgtcagccatctgaacggctgcagataccatcttaaagatcttcaggaatacactaacacgcaactatccaaaatatactgaggaacttacacaaactaaccatcttcattcaggtctctagtccatcagaccccaaatcacacgagagatacatcattgaacatcataacaatagtacaaatagcacaacggcctgccctaaatagatcacaggaatcacagctaacaagaatgagtaactgttattgatcatttattcagatattcagatagcaaaaaaaaagaaagatattcagatagcagcatcaaaaagccaagcagatgatggaaagaagaagcggttgaatgcaacactatatatgacaacttaaagaacaaactagaatcaaagtgagtgacaaactttaattctttatttaagtcattgacgtgatcagtacaaaatcagactgagtggatgtccagtgttcagtctacctcccctatgtgttaaactaataaggattctaagaaaagcgtgacaataaatcaaaaatatgctccaagcttccatctgttgagactatcgtatgataaaagaagcatttcgaagagcgagatggtatacttcagttcagattggcttatatcaaaaacagaaggacatatatcaaagatcatcagctagtcatcaaggcattcaacaccacatcaaactggagataattccatcagcaaccaagttacaaactctgacagaatgagcatgactccaaaggccgtactgacatcgatcggcttctagaacctaacgagaagagccccatgaatcttgcgtggctgctaagaaatctaccaacagaaacagagagagaacctggccaggaactgatccaaactaaactcgaggtgtcggacgtgccccgttccgtgattccgtctaaccctgatcatggcgacgcagatggccgcagaagtggctcctccaaactcgaggtgtcggcggagctcgacgacgtcgccgccgccggccgcggtgggtgctgctcctccgggcccttgggcgaacctgtcgccgggggcggtagcagctggtcctgagcctccaggtcgaggtcgcccggctcctccggagcaatcctgacgtgtgtcgatgacgacgacgacgacgacgcagacgtctcctgtggcggcgggttctgctcctccggcaacggctgctgcggccgcgctctccacggcagcacgcgaacgctgcgagccttcttgcggcattccgggcaggacaggccgtgctcgcggagccatttgtcgacgctgtagtcgcagtccttgtggaagacgtggccgcaggagagcgtgcggacgacgtcgccggccaccatgccgtaccggcacatcgagcagtcgcccagcgcgcggtccagcgtggtgacgccgccgagcatccacaccaaccaccccggcgccctctcgtacaagtgcaagccgaggttgatgagcccaaaggcgacgaatattgcgatgaatccccccttctccatgcctctccttccccgatcctctcctctccccccctcgcgctctcctcgctttgcgtttcgtagagtttggaggtggaagaagaggccggagccttgcgggatgaaacggtattgcactggaccccacttggaaggccggcttatatagcgtggaccgcgcgcaccgatgccgttgatcgcagatcggagggcgggtagtgatcggctagttcgttaacgaattcttgttcttggtgggcgtatgatttggccgagcaggacacacgaggcgtatatgcggctgcctgtatcagattgggttttggaatggtaatcgtggttttcaggtttctgcagagctaggcaaaaacatgcagtagtacaactcgatctgtacaagtgcacaaccacttttgaaaagagaagtgtacgaccacttcactactgcacattgctttgcatccttgaagttgttaagttcagtaaagtcagcttctgctgtagcaagttatttctgaaaaatgagctaacatactactacatattgcaggtttgataaactttctaatcagatgaacttacataatgcactccgtgggatacaaattggtgttagaattaagggaggacaaagatggcaagcccacacaaagttcaggtagttcagataacattgcagaattagacccacaatagtatgccggacattaatacgattctctgtacactgaatatttagcaggcgatttcagctaagctgtatgataaaaaaaaaagacttagagaattcctgcagtatacataacaaacaacattgtacttgtcaagatcaatagttcagtatgcagttatcatcgcaaaatagcatatcgcttagtcagtactaattcaggaccacttcttggcttatgccttctttcattgacaaattgaagaattgacatctcccaaaatcttcagatcttcatattccatatccaaatattcagacttcagtttgttacatgggaagcaacaagggcaacaattctggccgaaaagaatcagaattcagaaggaactctaacagaaatcagaaatcctaagaactctaacataaatcctaagaagcgccccaataatcatgtggcgagtagcggcgacaagaaaactaccagcagaggaaactattgaagaaccagacatccaggccagacacaatcacatgacgcatcagagtggagaagaaagcgttagaatcctaagaaccctaaacccgaagatcacatcggcggcggcggcggcggcgacagggggtccaggtcgtagcagcccgggcacgggcagacttgaaatctcgttgttgtctccgctctccaagcctcgaagcagcgttggtggcacgtcttcccgcagcaggacatggtgacggcctcctcgcggcccttcatcccctcgcggcagatgatgcaggccgcgcagccggtctccttccgcaaccacagccacgggaggcagccgtgtaggagctccctccacggaacgcagatggggcgcgaggacgcgagccggcggcgtgctacgtccctctccgccattgctgccccgcccaccctctcctctctgctccttccttgcttctccctcccctcctctctcgtctcgtgagttctctgtgtcgattcgaaggatggcaatggtgcggaggaggagggagcccgagatttaaggtggagtcggtggagtcagcaccgcgccggcttatctagaccgctgatcagagatccgacggtagatcacttgccgtgacgaagtagaactcctaactaattcgccctaattcgcaggagttagttagcaagtggtgatgattagtgctaatcgtctgtaccctcgccgtccgatctgcgatcgacggcacgggtgctcgcggccgacgctttataactagccaagtgggccatccagccttccaatttgcaaaccagccactgcgccaccgccaccttctcttccaaggcagagcagagcaagagagcgaggaggcgatcagcgcagcaaccatggacctcgtcggcgccatggcctcgctcgtcttccttcaccttctgtgtgcggggtggcggatgctgaggatgtggacggcggcggggtggccgtggccgtacctggcggcggggtgagagacgctgagtatgtggtataggcggcggatttggacgctcggcggtgtcaggaccctggatcaggcgctgcgaccacagtgcaagctgtgtaaacagaagatgatggccggcgccgtggtccgcgcgctttcctgcgaccacgttttccacaaggcctgggtcgacgagggcctccgcaaccgcaagccggcatgagatgcagaatatgcaaccgtgtcgcccgctgcatgctgccgtggaaggcgtcgccggcgaacctgatagaccccaacgctcagaggtttcagcacatccgtgctcgcggcggcgtcaggacactggaccgggcgctgaacgacgcatgcccgatctgcagcacaggatggtggcccgcgacgatgtccgcacgctctccggtgggcatgacttccatgaggattgcgacatcgcgaagtggctccgcgacaacaagaaggcctgacaggatgaggccctcgatcgacgatgtggaggcgcaggttctctgtttcatcgttaagttttttgtttctgatggcagttttctgttactagtctcgcgtgttcttaggcattttcttgcataggtttctcgtttattggagccgatcagtgttagttaggtacttaggttcctcggagatttctgttcaattcttagggtggtcatagactcatagtagtatcacattcatccgcctttctatccgtcagaaatcgtaactcgggttccattgaagagttctgttcagttctttaggtggtcgtagtatcacattcatctgttttgtgttaccatcagaaattgtaactcaagacttttgatgaacaactctgaatatatacttttctgctatgttgttgcggttctgtaagttctttaggatggagtaaaaacttgaacatttcaagcagagatgattgctttcggagttttggtgaattcctgaacttattgttggatgctgcatcatgatttctgaaattgcaatgagaaatgaatattcctgcaatattaactgcatccgttctgttgttttagacttttggtgatgattgatctgctcttgtcaatgccaataaggctcattgcactggcataattctgcttgtaatattcagtttgatgtggtgttgaatacttcattgactaattgacgagctttgagatactgatgtttattggatcttgtgactgtcccaatgtattcattatttagtaatggttcaagtaaaaaaaaatggtgcatagtgctgaactactagtagtatcattgtgttgaccatgccagtgttgtgcattttttgtgtgcaactgtgatggagtgagatgagtccaggcaatttgaatcgaaacatgtcatcttgctcctgcatcataaaacaggttattttgcttctgaaagagtgaaactgataaatctgataacctggtcacatgagattttgcactttcggagttttgcccatatggaaattgccattcagtcagagctgtaattcaggatttgttttatgaaacatctgacagaatttgaaatatcaatattctagcgctctgaatcatcggtacatggctcctttcctttgctcatatgggagtagctaagagctcaattgccactgaatcgagtttttttttttcagtcataggacaatgtctactgatgcgggcttagaacattttgattcactctttgctgcagagtccctggtctactggcgcgtttatgataaagcatttacaatgtctgaaaactgaactagtctatcaatgaagtgaaccttaggataacacttgttacatgcaaagcttgtaaactactccgttcagtaaagcatctgttagtccattcagttcgactatcaagtagcaattctgaatttcacagtagtctttgacagtatgtactttgttcgatactcgcttactcagattcacagttaaatcttcacactgctgctctctgaatacgtgatgcatcttgctgtatggttagagcttgcagttgaagattaactgtcaatagagctttattattacctggaaaatgcttttctttttttttttgaacgaaaacaatttggaatactaagaagtaacttaggctgtgtttgcaaccccatgttcccaacctctctccctcgttttccgcacgcacgtttttcaaactactaaacagtgtgttttttgcaaaaaaaattatatacgaaagttgcttaaaaaatcaggagacgatgccaaggcacttcaggagatgatgccggaaaagatggatgctgacaagtgggatgagatgaaggcgcaggcagctgcaacaatacgcttgagtctcttggattctgtcatgtaccaggtcatggatgaaaaaacgccgaaggaaatttgggacaagttggcaagcctgtatatgtccaagtcgctgacgagtaagttgtatctcaaacaacagtcgtatggtttgcaaatgcaagaggagtcagatcttaggaagcacgtggacatcttcaatcagttggttgtggatctaagaaagttagatgtgaaactggatgatgaagacaaggccataattcttctgtgctcgcttccaccgtcttatgaacgtgactaccctgacgcacggcaaggataatgtcaaaactgaggagataatttcgtcgttgcttgcacgagacttgagaagatcaaagaaaaatgaggcaacggaggcttctcaggctgagagtttgctggtcaaggcaaagcatgattatgaagcgggggtgtcgaagagcaaggagaagggggcacggtgctataagtgtcatgagtttggacatataaggaggatttgcccgttactaaagaagaggaaaggtggcattgcaagtttagcagctcgtggtgatgattcagatagcagcagtcatgagattctcacagtgtctaacgagaagtctggagaagcgtggatgttagactcagctagttcctatcatgtgacatcgaagcgggagtggttctcttcatacaaatctggtgattttggtgttgtttacttgggcgatgacacgagttatcgtgttgttggagtgggcgatgtcaagttcaagatgtatgatggaaacgaggtgctactttcggatgtgagacacatgccgggactaaggaagagtttgatttcgcttgggagcctacatgagacgggttggttgtatcaggtggattctgataggaagaccatgaatatcatgaaggacggcaagactgttatgacttgtgagatgacgagctcatgtttgtacaagttacaagggagtgttgttgcaggtggagtcatggaagatgggtatgttggtgttgcggtacacgatcctgaaggcggcgagcctggcgtaggctcgtcgggcggctcggcatgagctgcggcagaaccaactcaagtcctggtacacggagattcgagcaagtaacaaatttaggttggcgtggcatattcgccaaggtggagtttgttagagtttgtgtcgaatatgtgtacgtagtcggttacagtttaggacttggagttgtaataggtattaggactagagtaagagtgtagcgcccgttccgtcgtggcgcctagcgggaaaactatttcttaaaaatcctaattgcgaaatctgtttctttgcttgttgtctagtgtccgtgccatctcagatctcgaatccccgatctatcgtcaagttcaatcccgaatccaaatccttcccaaatcaaatccctccgcaaaagtctatttagcctccctcgagttcgatgggccgaactcctctcggcccatctccccctccctcctcggctctctctctctctctctctccccgctctgcccgtgagccgcgtcgagctctccctctccactctcgtggccgttcccgccgatgccgcccaaatcgccgcgccgcccgcgcacgcgcgcgccgtggtggccgaccggccagtcgccgccgccgtcagcgcctgccgcgcctgccccgcgtctgccgcccgtgtcgccgctccactccaaaccgccccgccgtcatcgccgtcgtcatcgactcggccccgcctctccccgcgcgtgcctccaagggacggaggcagagctccccccctctgccgcgtcgccctctctccctcctccttttccccaaagcggcaaggaggcaagccccctttcttcctccctttttcctttttcccttcctccgccggcgtcattcccctcctccctgtcgccgatttggccgctagccggagcgccagctcgctggcttgaccgtcaaaagtcggttcccctctcccaaaccgacattgtcgcccatataaacccaaccttcccccctttcctttcctctcccattcgcctccactccattgtcgccgcctcccgtgctttgttcgctgtcgccgttcgccgtcgcgcgtgtcggaggagccggcacgagcgattcaaaggcggcgtattttgtggcatatggctgaacaaagcctagggcgaatagaccggcatccagtagcggttcaaccttggagaggctttggttcaacctgtttttccctctagcagacaggaagaaaacgccataggagatacaaaacaatgacgacactgagacacgatatttggtaacggagttcagccgtagcctacatctccggggcactgattacgtgtgctcctccccgatccatcatatacagcgtatcagagttacaacgactcacggccacttaattaatcatgtgttaaaaggtcgcaccgttttacgtgcaggagggatgggttcccatcctgcacttgcgaacacacccttagcattcaatattgatagagaagaaattggcgagagaacctgcgttcgaagggattcgaacccaggccagcatgttgctcctggcagctccctgccagccaagctaggtgccgttcttgaaaatgcttttctcaatgcagtctttttctgttgagggtgtgtttagttcacgccaaaattagaagtttggttgaaattggaatgatgtgatggaaaagttgaaagtttatgtgtgtagaaaagttttgatgtgatggaaaagttgaaagtttgaaaaaaaagtttggaactaaactcggccagagtgggatatgttttttcagtttcacagtcaaatcatcacaatgctcctgtctgattctgttacatgtcttgcttggccagagcttcatcagttggggattagctgcgattagagcttcagtagtacctggtaaatgctgtacctggcaaggtagagagacggctagcttagactttagagtacctgtaatctgtgagattcttgccttcgataggcccaggggtgtcctaagttaaaatggcccagcccaactctgccgcctcacacagccgcaagcatgtgattaccagagttgctggcacgatgggcccacccgtcatccacacgagggccacgccttgctaggagcgcgcggatttcccggctcgacaagaagggaaaggcagaagccgactcgaaacaacgcgaagcggcgcctctgactcgcttccgttcccatctcttcctctccctacctcgctccgccgccgccgctcccctcccgacccgcctcgcttcctccctccgccgccgccgccgccgccacggcccggccggatcccacccggccgctcgattcgaggtcagatccaaaccccagccctcccaggtccgaatcgcgccgaatttttttctaggttttggtacggatctagggtttggcttgccgtgggaaattttcgtggggggaattctgtcgaatttctctcggcttccacggtctggttggattcctgctcatggccgctgggcgccacggaggatacagggactacgaggcaagggagcgggagctcgacgcggaggcttccaggaggagcaaggagcagcagcaccaccaccacccgagcggccgacaccaacgcggcgactccgacccccgctgcgaagctgaccggcgccgtgacggcggtcgcagcaggggcggcagggagttgtcgaacgggtacggccaccgccgctctccgcctcccaggagtcgcctctcagcgaggctcggggatcgcgagcctggcgaagttctgagcggtagtgcgtcagatgactctggtgggaggccgcatagagcgagggagaatggtgtatcaagttctagtagggatggtgaatcggtggtggctgcatcggcctcatcacctagcaagaaaaggaaattctcaccgataatatgggatagggatagcccaaagccaatgcattctgatgtggcgaagggcaagaaggcggtggactctgtgcctaccgagcttcctctccctccccctccccctctgcctccgcaggatcacatccctgagaggttggctgtggagaagtcgccgatggatgtggagcctgctgttgcttccgagagtcctgagcagttacaggagcatgcggagagtagagtgatggaggaggaagaagagtactcaacaatgaggaacatatcaacttcaaggtgggctggtgctaatgatgacgaggaagagggggcaccacacaggaagaagaaaagtgcatcgcctgcagactctgctgagttggggcagaggaagaaggctcttagcccagaacttggtgaggttgtggccagtgatatctctggagggaggaccatgtcaaggtcgtctgattcagggaggttgggtgctgatgagaatgaggatttggaagttgataaagatgattatatggacgttgacagagatgatgatggtaacagtgatattgcaaatcatcagtcaggtatggactcagagtatgaagtgcgccggtctgaaacaccagaaccagtgaagccaccgcacagatgtataaatatgcttcaaggttgcagaagtgttgatgaatttgagaggctcaacaagattaatgaaggcacctatggtgttgtatacagggcaagggataagaagactggtgagattgttgcgttgaagaaggtcaagatggagaaggagagagaaggtttcccattaacatctcttagggagataaacatccttttgtcttttcaccatccctcaattgttgatgttaaggaagtagtggttggtagtagcctagatagtatttttatggtgatggagtacatggaacatgatcttaaaggtgtcatggaggcaatgaagcagccatatagccaaagtgaggtcaaatgcctgatgctccagctgttggagggtgtgaagtatcttcatgataattgggtacttcataggtaactgttgatttgacgctctatttttgtttgccaagtatcctcaaacctatcctgatgcctgtatactgatatgcattttccatataccagggatctgaagacctcaaatcttttgctgaataaccgtggtgagttgaaaatatgtgattttggactatctcgtcaatatggaagcccgctaaaaccttacactcaattggttgtgactttgtggtacaggtaggtctttggtcaacatcagattcatccccagtgttttggcttgccattaatttttccattgtgagctctgtttatcaatctgacctgcctttttgctccttctcagggcgccagaactattattaggaacgaaggaatattctaccgccattgatatgtggtctgtgggctgcataatggcagagcttttggccaaagaaccattatttaatgggaaaactgagtttgaacagctagataaggtatttcgtttgacttgtgattttgcatccttgcaattactatatttttttcagaggtctcatgttggatttcctttcctgttgcagatacctataaaccttgatatatattatatttgatcatatctcatggtgaagctacttttattgcagatatttagaacacttggcacacctaacgagaagatatggcctggctatgccaaattgccgggtgtaaaagtcaattttgtcaaacaaccgtaagtgtctcctggataatgcatacctaatcgtgttggtctgatgagtgtctatatgccattgtgatgaaatttctgttcttttatcttgtcaggtacaaccgattaagagataagttcccagctgcatctttttctggtcgtccaattctgtctgaagcaggttttgatctgttaaataatcttctaacatacgatcctgagaaggtaatgtgctactgctattttttttttcatgatttatatcatgcattcatatttaaatacttcaatctgagcacacctgttttggctttacagcggttatcagcagatgctgctttgcagcatgagtggttccgtgaagttcctctacctaaatcaaaggatttcatgccaacattccctgctctaaatgaattagacaggtacttcttcgcaaccatttaatctacttgtagtgttgcttaaatatctttgtttcatgtagtgaaatttattttcctaaaattccacaggcgtaccaaacggtatttgaagagtcctgatcctctagaagagcaacgattgaaagaactacaagggaacattggcaaccgtggtctttttggctgagctattagcaacttgtttgggctctattgatcctgactgtcatgcatcattctgaatctatgaggtcagatacactctgaggtgagatgtgccatggacatgaagtatcacgcatcttggtgtctaccagcaactgatagtgttctttagcaggcatggtgctggtttaagttgataggtacctggcccatcatagaaattttgttgcaggattaactccaaccagattgatcataaaagcagtctaatctgcctgcatcgtaaggtgtggcatgttggcttttattggttaacagcagtttcacctttggaacttctgtatgtaaaatattccagattggtacgttgtaaacaatgttcagtgcgttggatttaaaataagaatattccatcattttttttctatattctcctagtgccttttcttttgatctttccattttgtttgcaagagacaagagaagcgaaggggaaggatgccttttgcttttcaccaggaaatcaatggacagtaatacaacttgaaaggtaaatatattcaaaaaccatttacctcaagtgatgtattgctgactaaaactgatgagtgcacgtgcaaaagatcatttgtgatgaaaggtcgtggttgaaggttatctgtgttttcataggtctttttaaatgttgtctggaatctggacagacacatgttcccatatatctaaaaaagaaatgaaaaaaaggggttactgattaaaggaaaatggaacagaaaaatgaaaaacggaggatactgttctgtaggtattctccttggcatcttaacaatttgtgcaaaacaatgcttgtaagtaacagtaactgatgtttctgtatccaccactcaacagtgctgttcagcactatattttcactcccatcccatctggctatgcaccaatcaactgtaggatgcaatgagggaagaatgaaatgtttctttgtagttactgttcataagctatctaattgtgaatttggaagtgaatgtttggtcttttttttttctttcctgttcggcagccaactttcattttcacttatataaataaatctttaaaagagagaaacttcagtatcttgttactcattatacgtggtggactcttccatgtatttgatcgcttgctcccttgatgttctatttcatggactatttatctattcagggataatgttcaccaaccgtttacaaataatatttggttcttctgttgtatccttctaatctgaatggttttcaactcactgggaaacaagtttgtcttgcatcgattgatgctttcgttctctgtataccacatttttaggatattattagtaactgtctaatgtattgtgactcttgcaacctggaaaaaggtctttttcctttatctaaatgataatgaggttgaattaatcagctaagcatatctgtaaatattaaccattagctaagttatagtcatgcgaggtagaagtggtgagatcaaaagtcaagatgtctttatttttatgcaacatgttgactacttcgaagatatgctagttaactccttttatgcgacaagtgttttgcgtaaactgcctttatgctttgtgaactggtggaagaccatatgctcagtcattttgtgctttgcattttggtggtaacttaaatgctgcttaagtgcttggagagttatttgaactcactacagctgttgtctgtgacacgtctgcagcttaagctgtggctgcttcaagataggaagcttgatggccctcagcttgttgtacctaagtgactaaattttgtggaaggtcttcaagagagttcacctgttactttagtgaaccatagtggtcactggtcagtctacttatcctatcctgtctattaatatacatcatacttctgactgattgtggggaccgctcgtccatttctttgggatggttgaggtgtaacgccttctcttaaatgacattatcttcatgaacaacattttagttttctccctacaactttttccctcttgacattacctgtaaactttgaaaactagtacatggacacctgaaatggtactgcgaactttaaactactagtggagcgggttactcacaaaactactttaatctgattagttttagatgggatcacacaacttgaaaggcaagacttctactgttttagcttgctctgcatagttttagcagcttgtgctgcaatagggtgagggttgctcaactgcgcaaatcctcccctgatgcaagaccacattaacttggacaagaatatgctttaaaattttaatcatatatgatgcttgcatgacccgcttgagtgatatttgggtctctttttgtaatcgtgcttctctctaacttgtcttcccatgccttgccgatatgagttttgggatatatcgatatctgttcattggtttgattattcgttgtcgttattttgttctaacgtggcctcgaagagcctctataattcagccggcattgcctgttcgaatggccatccgaggcctgtctgcattgctatgggggtggcagctgattctatgtacgaaagaggaagcacacgcatgtatcattttgtcaagtactgttgtgtagtgcattgttcgctatgtgtactttgtgtttttctctcccccttttgtactttcctatatcaatgcttgtaaacatggaggactattgctttacagtagtaggtactgagctagtattacatgtaagtctgtctcatttacaagagaggagaagttgccgtgtgtgcaaatgctcaaattcggctccaggaaaccaagagcgttcgcgaatccgcagaccgggcaccgttgctgaggtgagtgagctggtcatgtccgtagcctacgtgtaaaccaagtgatggtccttgctggaaggtgacgggcggtaataaataaactataccccctggtcactttgatcggtcggtacgaggaatggttatccttcgggaaagcacgactgcattcagtagcggcctcgggtgagcatcggtgtccgagttctcttcctcgtcgatttcatcctcatccgcgaggtgaaattaccttccagggttcggttgcaaaatgtacatacgcaaacggctgggatttaatttattattaagaaaatagattcactagatgattagaggttataatacccgctgttcaaactatgtgtgtatgttcaacaacaatcggaaagggcatgtgaactagtggtggaataagtggattgggaacttgatttgtaatacaaattatttgtttagttgctataaataaagagaggggagggaattcatgctatttgtttcgtatgtggattttgaggtagggtgtgtttagttcacgctaaaattggaagtttgattgaaatttgaacgatgtgatgaaaaagtttataagtttgtgtgtgtagggaagttttgatgtgatagaaaagttgaaagtttgaagaaaaagtttagaactaaacttggccgtactagaaaattattatctcaatagttagtcactagggctaagctcgagcattcccttcttccgtaggaactgatcggactcatgtttccttctcaccaattaccctcaatcttgtgttactaaaatattacgtggatttctaatctctctgtctatctacagtagttaatacctccgttctagaatataagcatttttagagttggacacggttattaagaagttagaagtaaatgatggatggttgtgattgaatgaatagtggaggtaggtgggaaaagtgaatagtatagggttatgattggttgggaagagaatgttggtgtagaaattgttatattttaggataaatcttgagggctacaagttgttatattttaggatagagggagtagtcaacatgtctagctcgaccgctccttttatttgcgatattgattcgcatcttaatatgctaaatccatattatgttgttttaatccaccaacatttatgttgataaaaccaactacacctaccatataagtagaaaaccaagtaaaagaataataaatgcagctttactacctgataagaaataccgtggaagttgataataaatgcagtaagcaaataaattatattatttatacatttgcaagaggttgtaggaggcagggggttagccactttgtaggtggattttaccttatttttctctgtacaaataacacattgtgatatctctggtaactactatcttctgatcctataatccactatgcttataaaaaagtgtgaagtttgtaatggcagagacgtattaacttgattttttttgaagtggtgtattaagatgacaacaatcttatctctcaacagtagagatttaatcaactttttgcttattatgccgttgtcacgggatattttccatcatataattctctcattgtcattcaaaaaggagaaaggagtaacagaaataaatccaaaacaaatcagaaaaaggcaaatttccaacttaggctatacaaattaaacggcaacctccatttttgcaagatattgttcacaatcacttacctcccttttatagtatatagtctcccacaacggtataaatttatcccttctagaaaaaccaacagcacaaatccaaaacaaatcaccaaaaaagaagcaaattcccatccttacacacgcctgcaacctccacacaaaaacggaaacttttttcaaacacgcgaaaccaccggaggaggagttgtgaaaatactctcaaaacggagcaaattaccaacgttcaattctcaaaacgcgagggcatctccgccatttcgcccatcgccccaaccgtttctccttctcctccttccccttgaagcctctcctcttcttcctcctcctcctctgctctcccttcgcctcgcctcgcctctcctccaagagcgcaaccgtaaaaaaagaaaaagaaaaaaaaaacccgaggcggcgagctctcgggctgcttccggctccgtccgtagcggcgaggagggggcggagggccattggcgcggcggcccgcgcgaggcgcgcttgcattgttggtggcggcggcggggggtcgacggggtggagggcgtgtttttttgttggcttggggtggaggcgggggatgtcttgctcgaaggtgcttctgtcgaagaagggggtgctggggacggtgtgggtggcggcggtcagcggcgtggcggcgctcagccgggaccaggtggttcgcaccaacgtcgtcgcctgcgtcggtaagcgatgcgatgcccactcctcggcctcagcgcgcgcgcgcgagagagagaaaaaagtgcgtatttttcgtgggtttttatgtcgaatttgcggtctaggtgggaggcagtggaacagtgtgggaggcggtgtgcggaagaggggtttatccggggctttaggttatagaaatgaagcgaatcatgtgatgagaatctggtaaaaaaagaagaagaaagggaatggaatttgagaggagttgtttgctgtcatggcctcggtacccttctatactgtattgtggtaatcgttgtggcaatttgattttccatgtgaaatctcgaggtgaaaggaaaaggtagcaccttgggtgtaataacatggacctgtgggtatgggtttttggatggtgaagagttttgtactttgtagatggcatcggtttggggtttggggtttagggtcattgtacgacgacggttctacgtatggttctattaataaggcccaagcatatacccaagattcgggcgccaactaggaataccttgtaatccctaaatttaatagcattgaacaaatctagtagtcctgtaaatattgtttggtctgactcgtaacggaaatacaggtgtcaaaagtgtggaactaataagaagggaaatgctatatccaaagcatatgaaacaaattagaacagtaaatgcgggttgtgacattttataacgctttccttttctagatcgatttatttttagcattctttccctaatatgctcgtaacgcttgcacatttcctctttcccctggcagataagattttgcctgatgacaacgacaaaaccacatacagagtattgggactgcttctgcttggcattgttaggatttattccaagaaagtggaatacctctgccatgaatgcaatgagcttcttggatcatatggatcagcacattgcaatgaactaagtatcccaactggaggagcaacaaatagagtttcaaagcaagcgaagaaacctgttcgcgcaagaagattagttgtaagacaagaaggtgcttacaaggtaaaaatacctatgcaagctgtgcgaacaactagagcagaaacaagagctacttcacagataactgaagttcgagacacacatgctacacctgatcttccaactttcacaatacccaaaagatttgagcttgactcttttgatttggggattcctgaagataggtaacaggttttggtcctatactagttttattagcttgttgcttaaaattgtggtttctgatctatttttaaaactttctttgtagggatgatgatgacgtggatcatcaccaattgccacatcaaggtagaactgctgtgattgatgtttttaccactgctaagaaaccattttatttacgttctgcattcttttgtataggtaccatgttggaagatgagaatcaccatacatcctgtttgtttgaggtacactgctctctcctgtattgtccacaccacttaccgacacatgcatgcacaaaaaaaaaaacttgatcaaggggtaggacgtcgtcgttgacttagctttaaagaaggtgcccactgaaaccttgtgcagcgatgtggacagaactgtggcacccaggatttgagccctgggtgggcgtcaccttactgggtgctctaccactgagctacacactccatccaacacatgcatgcatacacgagctgtatttagtaacatctgaaatgaagaaatggaaaaactaactaatggtatgcatactagataagaaacacctggtattgctaagcattgatatagggtggccaggtgaatgtgttatccagtgatcccaaagtgaggtaggctcccaggtagccgaaagtactactccctccatcccaatggtaggtatttctagcgttcaaatttgtcccaaaatgtagctaattctccacctacctcgtcatttgaaccaagcacagccatatcccgttaaatttctgcacctactttctcttctcaaccgatcacaaccttccaccattcaaccgcacctattttcttaattcccgtgaaaacctctagaactgcttacattttgggacaaagtactgattaggcaagcactgtagtttttgaaaaaaaaaaggactcgagtccgctaatgctttgactggcatataccaagtctgtgaataccagtgtgatgctggctgcagtcctgtaccttgtgctaattattctgttcaacaatttagagaactgctacaggtgccacttgtcagttgctgaggggtttagggggttagttctgtaattgtcttattttttttagaaaatgaaggagagctgcgcttcatttcattaagaaaaaacaaaccacccatacaaccaagggctcacgagcccttcacacatctacaaacagcaccacacaaggtgatacacgaccaaaaaatcaccctacaacagcctagtgcccttgggttagcgaattacacccaggttttcattttttcccgtgttatttataaataataccacataattgctactcctttattaattattatccaataaccatgtcttccttttgtttcgtatattatctgtttgggaaactaaagccttattttggtccaatgaacagtcttataagatgatgacatgctcatacgctgatctagactctgcctgcattatgccagtacgcgtgtaagtatagagattactgtctcaatgatgctaaaaaagattatctgtaccgaatttctgaatgaagcttcaatgcagcactatcccaactgaaatgatgagtgtcattagtgaagtcaacagtctactatgcttgagtagcattgggggtgaacctgaaaatcacaatgctgaatctgcttgctttacaccagtgaaggagtaagtatatatggtgtcacatttctctctttacagtgcgcatacttttcctctgttgccgatgaccttttttttttttctggaacagtattcttccacctgagatggtggatatgatggctgaagtaaatgatccttcagataaaagcacaagggggaaaaaacctcaaagagaattgaatagggatgagaatgggaattctgcttgccacatccctttgtcagggtaagtaaatgttacttttgtggttttaccatattatgattttaatgtcacatcaatttttttttacttaaacatttttgtgaaaaaatagtgcattgatgctgaccatatttattggtacagaagtaaggaagtgcaaatacctgaaaatattgtggagaatgtgacttttccaagtcgtgatgcaaattgtcccacaattgaagaatcagaaaatgggtcactgcatggaactaacacaaatccatcatgtgatggttttgaggaacccgggtctcttgaacaaccaactttgcgctgtaagacaaagctaatcaatgagctgtcaccttccactccggagcccatgacagagggtggcacaggtttaatttttgtgataaaaattcctcttctatttgtggtcattattatgcttaatttgtgatgtgtgggtttcactgatttattcagggctaccctgctctcctaaatttatggttactacaccagctaaaaaggagaagcaccgggtgactagaaaacgaagaaggggattatacaataaagattatataccaacagatagaggagacaaacggaaggttagaagaagaggaacatgggtattgtatgatgaaaatattgttctaccaaatgagtaagtagagcttctagcttagaagctcttccatctgttgcactacctattcctgtttgatcttttaggtatcctaggagctggtttggcaaacttaggctcatcttatcagcttaagcagggatttgggattctttgatgaatctaagttctcagcttcttcttcttccttttttttttttgctaagatatttaaggctcaaggcaaggtactgtaagttatgaagcctatagcctcataaagaattataagctgagaaccaagatgcttggttggctggccctgaggatgtttgtgttgtccactgggattcaaatccttaaaacatgtgctctcattggttctacctgtttgcagtgggaaccagcgatcatggctggggtgctagcctcttgttcccgcactttatttttgtttgggggcttgggttaggtggtaggctgcagtgccatactattttttatgtgatcaatgatcatgtagtataagttggaacattaatttttcaatatgtggtacttctctatttttaattgctaatgctttggatttttttcctccttaatgtagaacattgagaaacacaatagaggatgcaagtgatctagtgcagcagagaaggaaggcacctcatacttgtctttatacctggaaggagggcaaaattcgttctctgccagttactttcatggatccattgattttgtgtaagtcttcatctatactaggtgcaattagtgatggaaacctccataattaactaaagaggggccattttattttcacagatccaacttcggtgtacgttagacacactattacagcagatacaccagaaaattcgtgcagggagtcagtaaaatcaagaaggcgactttcgttggagctttctgaatccaacaatatctgcgatgatgctaaaaatgtagaaggtgaaagcattccagatgaaccaagaaagagaaaattggatgaattgacagatagtgtacaggcaactgttgggtgttacactgaaagtgcacagtatcacaatgatgaagactatagatttaatgacgatacagtcaaagaaaaggatttctcaattggaggacatgaatctcattcaacagaactgcaagaaagattgaatgcattgaaaagtaaaaatccacagctcgacgaggcattggatgctgatatagatagtatggaagaggtaacactgtctacattaaactcttttataaaattcttttgaaaatatctggttttgtgtgcaaaatgccatgcaaacaatgcatttgttaatgtatattttatgcaaatgaatcatatgaaaattgcatctggcaggatactcatatggatgaacaacatgctacagatgaacgcactctctcacaccctatactagtttttatttttcctgtacattagatctttgtttttgccaagttctactgacattgttattttgcacaggtttactgcgttcaacaagaacaaggtggctaatgaacttgtcctgt

SEQ ID NO: 76174 - DNA, 702 bp, Oryza sativa
attcctgcagccccctagatgcttcagtctccctccacctccacgaattagcacttaatcctatatatatattcctctataaatttctatgtacaccctctagaacaattgggttttgtttagttgaattttgccaagtgctattcaccttgtctctagtcctcgctcaattagtcatgatcgactatagattcagagcccccaatagttggtgtgttgatttgccgggtcgattagatctaccacttcaatcgcaactattccttgtgcttattcacctattcgcaatatttagattgcatcttatattgttcttgcagtgttctcttgtctgcattgcaggggtcatcaaccgcacgtcacggttggtacgacatcgtttgtggtgtagcgattgcacggcgtcctggacttgttctggttggtagccacgccgcaaatgtcgcactcgatcaaagcgagagttatccccttaccagaagatcgggccatgagagagagcgtcatcagggtaagtcctacgttccctcggccctggcaatcttatcggctacattggtgttgttcaaggctgcatcgcttcgacctcttgaatcactctggttcagttgatatttttgcctacctatttatcatatatcttagttaatctaagtagatttttcaatttacttgtatcggtcagatctttttctagggttt

SEQ ID NO: 76175 - DNA, 1070 bp, Oryza sativa
aggcgcgcgccaagcacacgcgcggcgcacatgcgcggcagggaggcggctcgggcttggcgcggcttgggccgattggccggcccaagagaatagaagggtaggcggcctgggaaaaagaggaagaagaagggagtggcccgggagggaaagaggggcccaagagaaagagagggaaggaaaaagagagggaggaggaaagaacttcggccacgggccgagggagagagagaggactttgggccagacttggcccaaaggaggaagaggacattttttagatttttttctttttaataaactttgttaattgttgttgttgtttaataattatttccggcgctctgaaaattcaagtaaaatttgagggctccttttagaccaaggagaatttaacaaaaattctccgggccacatttgaatttttcttgcacgtattttagtgtttgccaatttctttccgaattttaattaattctattattccttttagaaaatgaattttatttcgggatgaatttatcaggacgtgacattgggcgtctacgtcttcaccgaccggcttgccttcgccgctgccgactggtgtttccgcctgcatggctggcctttatgccgccgttgttgggcgtctacgtcttcaccgaccggccgcctcgtccgccgccgactggtgttttcgcctgcacggctggcctttatgccgccgttgttgggcgtttacgtcttcaccgaccggccgcctcgtccgccgccgactggtgcttccgcctgcacggctggcctattatgccgccgttgttgggcgtctacgtcgtcaccgaccggccgcctcgtccgccgccgactggtgcttccgcctgtacggctggcctattatgccgccgttgttgggcgtctacgtcgtcaccgaccggcttgccttcgccgctgccgactggtgtttccgcctgcatggctggcctttatgccgccgttgttgggcgtctacgtcttcaccgaccggccgcctcgtccgccgccgactggtgttttcgcctgcacggctggcctttatgccgccgttgttg

SEQ ID NO: 76176 - DNA, 658 bp, Oryza sativa
  unsure (1)..(658): unsure at all n locations
acagggattatactagttcaggcccttggtaggtaatagccctaatccagttgatatgggattatatgatggaaatcacagattacaaagggaacagtggaactcgatgataccgacgagaccgtagtcgagttggttcgactagatcacccggcgacttggctcctgtaggctcgcttcgtaagctatggtgggtgtctcggcggtgaaaatcgatgccttaagtcctcccgggggtcccttttataccgcaggtcaggtggtttcaaagtaggacccagagacatcggaccatcggacctatacgatacagtgacgacccagtcctatccggataggaatctttccatctgtggactccgtgatgaatttccttagcgtatacagagaacgtcggtatacgcgcagatataccatatcgatgtatagcgtataaaagtagggtttgaatttagataaatttaggtccaagtttcactagaatcagatctacggtttaggagatatgggcttctaaagattggaatttgaattaaatctagaaaagacgaaaatgtactgttcatgggcccacctgtcagcctttctttctctttttctttntcttttctccttcttcttccttcttctcgtcttccttttctcggttccagagaga

SEQ ID NO: 76177 - DNA, 1079 bp, Oryza sativa
tcatcatattttacaaagcagtcggtatatcacttggatcatattattcagggattcacaccgcatatgctacatattaatattaagtcgcttggttgactataattatcaaaaccactcggttggttggattatttattccttgactatatgtttggtttgttcgattaaccacattgtcgggggttacacctattaggtgcatctagtcgatgcacctgactatatttttcagccctccacagtcttcagatttggtaaaagtactcgggagaccatgacgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttaggaaacagataccgtattggttaaggtttctatcttgtaatcctgccccccatcctatataaggtggggggaggccctctagggggcatatatatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtaggggttgcgtcgagtttcctatcaacgagcgcgatggaatcaatttcatgaagtcgcggacttcgtttcgctttgggagtcttcactttcttttcggcgaccacttctttaagcttctttttttttacttggaccaaaataatcaaggggaaacttaatctgaattttatcaatatttaacaaaatgaattttaaactcaaaataaactcttgctattttttggtggtggtcgcatataaataccccgcactattgaagggaatgacgcttgtcat

SEQ ID NO: 76178 - DNA, 6507 bp, Oryza sativa
tagatcaaataagtaatttaggagaagaaattgttcaaagtttgctttgcggatgtctgctccatgcatgcagaggcagaggcagtggtattgtttgttcaaagtttgtttgcgatcgaaatttgtttttggctgctgctgtatggatgcacaggtagtgccctggtttttggcatttcatcggcgcaacatgtttcgtccggaatatattcgttcgcagttctgcacgcattgatccaaaatagaagactctcacatacggaaaatatgaccatatgcatttccactgggttggctggagatcttattcaatttcctagtttacatgtgtacattgcttttgatcatgcccacgcgctatctagttattgacccatgcacctgcataggcaagtggtctatatttgttgtagttctacaaaatatgttgatattattaaatctatggatgtttttgaaaacatacacaattttatttaatgatccattattttttatttatatatagtattcccttccaaaacatcattctacgttgcccccataaaaatatttagttatatttattcatcattttcacaactccaaaataattgtctgtgactcactatatatattgtcatgcagttgataattttttagtgcttcggggcaaacaaaatgtttcaacaaaacattaattaataatgcgtgaatttatttgttagttttatgccctaacttccatgtatattatacacacacacatacacacctgcctgtctactggtaaagttaaaccttcggatagaataatacctcaagatgctttacatagttctttttttttcttgagaaacagatttgcagttttgttggttcatgtagatgctagtaataagttggattacatcatttaactatttaattagagagagctatagaaagcattaatattgtcttatgctatctagattgaaacaaaattatcttaattcatctaagccattccagattgaatttctttttaagagcaatattataaaagagctgtatttattgtagtttaactagcttctagtcttgtttgtagaacttttgacagctacaacttatggctactctagaatctctatagctattctaaatagtttagattctcacccgtacgtattcttagagtttgttttggcgagctttagattatgagaagaagtaatctagagaagccgacaaaccagcttttggcttctcattcattattttgtggattctacaacaacagcttctcagaaccaagacaaaagttggatggttgagcgctccacgccccacaccacatctccgcccgcgccacactcgtggagagcgcgggattcggttttcgaatcccagtccccctgtctctctctcctctcccatgtcggagagaaatccggccacctcccggccatgtccgcccctcccgagcccctataaatctaccccgcattctcctccacctttttccttctttcgccgtcctctcccactctccctaccgccaccgcaccgctctcccctaccgccgcctccggccaccactagtgccactgctgcgtcgcaccgtcaccgccgttggcctcgcgaggttgagggttgccttgtccaccccttcccgaaggccggaacctgctgtagccatcttccccgcgcgcgccgttgagctccgtgttgacggtccttacatcataaatatctgaccgttaatgcttgcatataatgaaataaaatatggtatctaacttagtggtagggattattactaatcatttccactagtgttggtgaaatatgtgtatgcaggtattttaaggataaaatacacccgtcatgcgaggaaacacactttcggccaatcaggcgcaagtacacggattgaagggcccacaagtcaggtgacaccgccatggaatgggtcataatcgccatcagggcccaccggtcagcctcctggccaaaggagagggcaggaggtggggcccagggttcatccgaaccaccaccggcgcctctgatcttggccttccacgtgtgcgttcttgatgacttctcaatgatggttggagggcagtttggacatttcccatagccataaccatcatatggagcctaaaaggaggtctccatccacacttcaacacacacaactttgagctgaattacaagaggctctattgtatcttttgtacattagaaaataagtagagagtgaggggaaactgtggagtagtgcccagaaggttggcctctatccgacttctacctcgatgagtgtagttttctaggaggaattctagaggagtaccagatctgtcggtacactctactctgggttcggagaaacttgttctgtaatataagcattcggaatccttttttttacataaaacagcaggggaggcttctactgcgcatattaaataatataatatagaatatttataggttacaaggatttacaaaaggcaaattaattaaaaatgtctagccatgattgccagctaggtttgtccatctcttttgctctgtccatatgcatgttaaactccctcagaaaatgagtcttccatttatcaaaactgagagcaacattgttaaaaatgaggtcattccttcgtaccagatgtgccagcagctgattaccaaaacttcaaagaagaaagtgtgctgaaaagagatctgagctaaagtgatcatgttcataaattccaaggccaaattccagtaataccaatgtgttgccagcattgttgagcaaatggacgggagaaaaacaaatgtgccatgctttctgtggtcatggagttgcacatcaaacagtttgtgccaccttgtatgttgaattgctttttatgtaacatttcctttgtgttgagtcgattcattagcatgagccaaagaaaaactttaagcttcattgtgcatttgcttttccagagtattgatagaggcctggcaacttgaagatgttcaaaaaacaatgagtaaactttcttgggttggtattgatctgagttccataaatactagttaggtgcccatgcgttgcaatgggaaatatttatataaattcatatatactctatcacttgtctctctctcgccccctctctctcgggccgacggcgcaggtcgagcggcggcggcggcgggtggtcgacgtccgtggccagacagcgtgggtcggctccagcaaaatgctcagcgaggtgtactatgccatcaccaacaaaacctcccgccttaggttccccagaagtgtcggcccgacgttcggcatcggcgggtacctcaacggcggcggcttcgacctgatgctgcggaagcacacagcctcgcctccgaccacgtcctcgacgccaccatggtggacgccaaggggaggctcctcgacagggccaccatggaggaggacctcttctgggccatccgaggcggaggcggcagaaacttcgggatcgtcttgtcctggaagctccggcttgtccccattccggccaccgtcacggtgttcaccgtccaccgctcaagaaaccagtccgccaccaacctcctcatcaagtggcagcatgtggcgtcgtcccttcccaacgacgccttccttcgcgtcgtcgtgcccctgtaccgtgtgccggcctcgtcgccaccatggccgacaccttcctggagctcaacgtgatggcaagcgactgcaccgagataacgtggatccagtccgtgctctacttcgcgttctacagcacggggaagccatcggagatgctcctggacaagggcaacggcatcggagatccatcggggtcatggatgcgactggcgaggtcgtcgtagtggtcgaccgggccgttgtcaatgaaaaagtcgacgccgtcgccgccgccgcctcacttcctccgcagccacgctcttccgctgtcgcctcgcctcctctatcgtgcttgcagagccaacctcaccgccgtagcctcgcctcatcccgagctctgcctccagccgcctccgccaccagccaccaccctcatcccgagcgccatcccgaccagtggcggaggcggagttcgccgctgccgcctctgcttcccgtgtggtcgctgcatctgtgtcccttgccgccgctgctccctcccggaccgcagcaccgaacgccttcctgccgccgcaccgtgcatgccgtcttgagtgccgacgtccgcaccgtcgtcctcgccgaccgcccgtccctacgccatcctcgccgaccgcccacgcccaccgcccgtccttgccgtgcgcgctgcaagagagagaggaagagctagagaggagagagagaggaagaggggaagaagagtatgataggtgggtcccatatttttttattaaataaatgctgaataggtactaagtacatagacttttctataaacttaattaaacttttaagaagtttgactgcagaaaatcaaaacgacttctaatatgaaacgaagagagtattaatttaaatccatagctaactgtagtttttttttctagagcaccatatttacaatctcaattcacaattaaattttacaagcgtgtataaaatatagacaacaaattctccccgggtttccacacatgacaaagaagttcaaccgattgcatcacattgtgccagtaatcaaatcacaaaaatctaacagttcacacatcacactcatattgtacaggacaaaaaatgtgaaccgattccatcacacatccaatcaataccattcaaaatcatagttagtcagtggccaagttcagttggtggaagtccacataaagattcaaagtgcagacctagaaggtgtattaatcagtgaacaactgctatagttacatcacaatatatcccagaaaggtacagaaaattattggacaagagattatatgaatagatgcaaacatattaattccatgagaacaactgtattgccaatacagattactgaaacaccaatagtagcaggaagttccacatcctatctaatttaaaaatatggtataaaataatatttgcagatttaaacagaatttctgcccagaacatgaatcccagggatataaatctgattgttctaattggtcctctgtgccgttatacatgtgaacgcatctttttttgctttcatcccaaatcctagctaagatctgtatctaaagaacaagatacacgggcatattactacgtcgttgaccaggggatcatcctccaagtatatgacttcaatagtccaagatttttaatttgtcacttctaaacctttgagagaaaaatagcccagcagacaacggcacatttttgtgctaatgcactgttatttgaatgcaattttttaaaaaggaactaaagcatggcttgcttaaaataggtcacattttatgagcaaaatgatcacattttaaaaaagaataaataatcgggcgtttgttaatagtaaatcgttaaatttctcaaaaaaaattatatatttgcaagagggcataagaaaggaagacatgggcgaaattagcatgcaaaaagtgcatcattcgagtcaataacatgcacatggctaacctgattttgtacttgatggtgtggagcccccaacaatcttaaccatttctgaaaataaatgagatgatagatcaaatattatgaatttgtgaaacaaccaacagaaatatgcagtgcacacatttcattgatgacgaggctagcatcttattatgcatctgtttgatagatcaaaaatagagagaaaatagtgaacaaaaaagaatattaaactactccccaggtttcctcacgtgacaaaatagttcaaacgattgaatggcatctcattgttctaattgctcctctatttaagtatcttaaaaacaagatgcaatggagtgagacactcaacttttgagtcctgatagtacatctcaagaattttagaacaatagtaaaagctcgaaaattcagcagtgaactttcaagtgtacagggcatctttagaaattcatagtgatgataaaaactcagcataggagcttcatgtattctgggcttcagatgcacaagacttcaaagctcctatttctgtatacatgacaggagatcgacaggcttcctacagcttaaatgctaaattattagtgtgtaattggtgccctcatagacccattgagaaacccttcaaagatgcctgcatgttgccaatgcagattcagaatgttgacctaaaaagagaggtgttctccacttgagttcagagttgtaatcgcaccaagagtcttaagactgaagctaagttcattcaaatgctatatatatgacattccctaatcactcaaggccgatcgaggacttattgttcatgtttagaaggagtttgaagagatcaatttgctaaaggcactttcttacgtatgtttgctgattgcaagaagtggcagatccaacaaagaagtagtagatcctcccaatcaccctcctagtctcct

SEQ ID NO: 76179 - DNA, 8712 bp, Oryza sativa
tttttttttctcaaaaattttaagatttttctataatttataagatgtgaaatgtgtagatatagaggtgttgtaatggacatctaatacatgatgatatgatataggttatcaatttttatataacgttacattgctgtttagttgtcacataaaggatatggatttaggcctaataatatatttatcagatatcaagaaaggcctacatggatcaaagtaaaaactgaatatattaaaaatatatataatcatttagactatgtgacgatcggtcaccaactatgcatgtaatagaggaactcacatcctacagttatatctcaaacggcctatttttttaacccattagatacaagatcattgcagatgacacatcaaatgcctatttctatatcgaaaaacatagtgaatataggacttagctcgttgattaatttaattaaaaatacaattgttcaagcgtatcataaaatcaatgtacagatcatccataaaaatcgttgcacagccagctcattgctccatgcaagaaaatatataaccatttacaataatacattatggagtgtatctcgtaataactaccttaattagaaaaaagaaaaaaaaagagaaaatgaggggaggataggcgcagtggtgtagcccggaattttttcttgggtagtcctacttcataagttgacatcacacatgaaaatttttcaaacaccgcaaacaccatatataagtacaaatttggtcaaaagacgatgcaaatatagcaataatatcttatgacatcaataatcgactaatttaacaaacaagtccaaaatgtgcacaagcaagttcagaaagtgcaaatattacattatgccaataccaatccccattcctcttcatatttcacccaataaaacaataccaatctaacagaagcgatttattcacattcaatcattcacaaatcacaaatccgcatcctaagctatgagctaattaactagccatcaatatgatcaatgaggcaaactaatcaataatcaataatcacaaattgcatatttacatgttcactaatcacacattgacaatataacattatgatagcactctagtaacaatcacatattgcattacgaagctatgagcaagaggattagaactgtaaagcctagaagtagaggaacctcatcagcaaaagaaggttagaaggcggcaatgcgacgccggcacggacgcacggcagggaaacagagccaacgagccagccaaccacgggtcttggtatctccatctcgggctctcagctggcatctccggttcccgcgccgacggccggtggcggcatcatgacagcgagcgggagcggatttgtgcagcgtgagccatgggctatgacagcaggtggcggcgaccagcgatccaacgatgagaggtggagcggtggacagccagacaagcagagaggagccgcccgacgatctggcattgctggctctatggctcgccgttgaccaccgaggcgatgaaggaacggcgtcccacgttcgctcggcacggtgcggactcacgggtgccaggcgttggcggtgcacaggtgaatgccgaagggagttgcggctcctccccaatccctcaaccctagcgcctgctgcctactcacgccggagttttgggcttttcttgttgggcctgattttttaggggggtttggtctctgggccaaaattgggggtagtcccgagcccactgggactaccccctagctacgcctctggataggcgtacgtacagatgttgggaagtgcacgtgtggggcccaggagagaaaggtgaggagggattttattttgatatgatggttaaaatcactaggtccaccgttttaaattaaaatctatggtcatatatttttggtttttcttataatttctataatttattggagtgccacttggcggcttaagagcatttgtaggaagtttaatagacttttagtatataatagatagatagataatagataagttcactttaggtctctcatctttgatgttgagtttgaattacgtgctcaaaccatagtaccagatataacgcatgtctcaacttgcaaaaccagtgtacccaagattcaagatagtatagtgtccaatttagctgatgtggcaagtgagaccaatgtaagccccatatatcagggctatttcttcttcctccaacctcctctctccatcaccgactctactcacgctcctcctcatctgtgccgcagcagctgcaaccatggccttgccggagtaagggagtcttcctccatctccccacctcgggccaccccgtcaccacctagcagcttcctagctctggcaccgacggcctcatcccatccctagcacggttatagttggattagattaatcttaccgcatacaacggccccacctctcccgtaggtctgtacatatgaagtacatacttacgtacgaagccgctcacccgatcaagttcgtttttctctcctttcccttttatagtttctaacgataattgagataacattcattattagaaataaaaaattataactttgtgtagactgcatcatcctatacgtccataatgtttgaagaaagtttcactggtggagaaaccctttgtagtcccggtttgtaacccccctttagtcccggtttccaaaccgggagtaccaatccgggactaaagattgctatctttagtctcgggtgaaataaccgggactaaagacacccgggactaaagatcgagctgacctttttttttgcatggccctgtagctgcatggtttatatatatatatatatataaaccatgcatatatatgtttcaatacatatatatgcatacatatatatattatacatatatatatatattatattatattatattatatgtatatatggttcagtacatatgtacatgcataatatatatgtatttatacatatatatgttatgcaaatgcatatgtgtgtgtgtctatatatatatatatatatatatatatatatatatatatatatatatatatatatatatatatatatgaccaaaatatatttacgttatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcaagctctcttgtggtgatgatttggtctgcaaggcagtggcaatactcgcacacgtagtagccgcacaagttagttccctgcttttgctttgcgtactacaaataaatgacaaattaacggcgtgagatctaattaatatacacttgtatgtattaatttgaatcggagaaatataaatgtagagcatgtgtactcacaggaaatttgaacctccgcctaagtctttctctccagttgccgcggaccaaatgacggaaccgataccaagccctacatggagtttaaagatatgattcgtagtagaaataattaacataacaagaatttcttaattaacagaggaacttataccagtacctgtctataagttcgaaaaccttgtcaaacgtagactctattttatccattgagtcatatacattgacggtgcaggccgacaggtcaaagagtaaaagcacccagtggaatctgcaatgtgcgtgggatgcattacatatgaaacacttagcaagttcgtacgggaatgaaatttggtatgtgggaagacagtaaaattaaactaactctgtgttgtacggcaacagtatgaacatcttgtaatgctgcgccttcaggagatggacgagattgtcctctgtttcttgtggatattggtcgagcattgcgacgtttactctccgagggtcgatgaatccagtatcgaaaaccctccgccttcgggccctttgaatctctattctataacgataaaagggagtattttattttatatagtttacttatatagaagaacctaattaattaaaggagacgtagtaattaagaaatataactgaacgatatacttacaaaatccagcaactcataatagagacgtcgagggcgtccagctggtatacttcgtagattcccttgaaattgatccagagaatatcatctccttgcaagaagtccgggtgcctgatcctcgctccgatcatctctctaccggtggcgctcatctctatgtacagctgatggaacttgtacatttgtgtgggtaaggactgcaccagctcgggcttgacaagcggtttactgagttcgtacatgtatttcaattccgcctttactattggttcaactcctagcaattgatctgtagttagaccggtgtcaataataaattcttctatcgtcatgtcttccccggtcaccaatggctcgatctcctagtttggtttctctccaagctgagggactggtttggactttctagaagattctttcttcagcgttcgctcatagtccgatagcttgatggcctccttgacaggtgcagacatacccctgaagaagttcctgacactggggtctataggaatcttcttttctagacttcgaggtttgaattgtctcttgacttctgatgcaacgtaagtgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcggaggagtaggtgtaggagcccgaggaggagtcggtgcaggatcctgaggaggagtcggtgctggagcctgaggtggagacggtgctggcggagcatgaggaggatacggtgcaggatcctgaggaggagatggcggagccggaggagatggtgcacgagacgtcgcttgtcgcccagggaggatgatgtaccgcctgcgccatagaataatggcatggcttgtgtctcgtagatgcgtctcactatctcctccagggtaatccagctcgaggtcctcgtatgcgccttcgaccaactcaacttcgaccttcgagtatcctgctggaatcggcctgcagtggtaagtacctgaagggtccgttgggatggccatgcccgacaccaccttcatgttgtgagagattatttattagtaatcaacatatataagcagcaactagcggaatggctaaatctaaaatatataaactacgagcttacctttattgataagttcttgtaaggaatatgcagctcacatggtgtttgctgagtgatgtcatcaacgggacaggtcgattcgtcctgtgtttgcatggcgtccatgctctgtgtcctacctaccccgttgtggcgcagttgctacggtttcctgacgggctcaccattgcaggaggaatggtcggctggggatcatgggaccgatgtgcggccatgtgttcatcaaccttccttgccacctcctcttgcattctgagttcgtggctcgatacccggaactctagatctgcaatcttcgtctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctttgtccggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccgaccaattggtggttgccggttcgatacccctctcaatcaagctagcctccatctcctcccactttggcatcgcgacgctatagcctcctgaccccaagtggtgatggtacttcttcttggcggcattttctttgtttatttccatcatcgcttgcccttgttcacctgtcttatatgcaatgaactcgtcccagtgatcccttagctttgggaatgtgtcaaagttcggtgtctgcccctttaggatatacttctggtacagatctcccttgaagctctgaaactgttctgccattttcttcagagtccaccttttcactttgtcctctgtacccgtaggaagggtgaatgtctcgagcattgtggtccacagcatctctttctctgaatctgggacaaagctctcatgatctccgcgtgcccttgttcttcgccagtacaccgtactgacaggcacgttatcccgcacaacccaaccgctgtgacatacatagttcttggcggcttcggccggggcactaggatgtccatcttcttccacttccgttatgatgtgccgacccttaagcttcttcgctgcaccttgttgcccgcgtgccctcttctgtccaacggagggttgactaccactagcctcctcctcctggttcccctccacatccctttccacgtgcccctgctggttcccctccgcatccctctccatgttcccttcctcgttcaagtactggtttagatcctcgttcccctctttttcattccagtactggctgattccctccgcgattgtatcgtacaatatctgttccacatcgcggtcagccatctgttgatacaagaaacatttgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctaggagtcgcaccaattccgtagtcaataattacatactaagtctaattacaaataaagtaatcttatattaaaactcaaataatattacatgctaagactgaaagagtcatgtatgctaagtgtaactgtcgtatatgctaagtctaattaagactaaaattgtcaattgctaggagtcgcaccaattctgtagtcaataattatatagtaagtctaattacaaataaaataattttatattaaaactcaaataatattacatgctaagactaaaatagtcatgtatgctaagtgtttcgtgcgtatatgctaagtctaattaagactacaatagtcaattgctaggagttgcaccaatttcatagtcaataattacatactaagtctaatttgcaataaaataatcttatattaaaactcaaataatattagaacactacacaaccttatatgctaagtctaattacaagtctaatattcttaattgcattacaaatataacaatcatttatattattacgtcacttgcctgcacgaattccttctagggctagctcttccactccggcttgagggacgactccgacaacacgtcttttctgcaagatacaaaaaatatgtattaggataaatgcgaagtaacatatatatactgcatttcacgttcacgttcgttcgctctttcacgttccttagctcgttcacatttgttcgctcgttctcattcacgttcgttctcgttcacgttcgttgtcgttctcgttcacgttaattcgttcgatcgttctcgttctcgctctcgttcgttcgatcgttgtcgttcttgttcacgttctcgcggcaacgtacgttgacgtgttcgttctcgctcttgttcgttcgatcgttctcgttcacgttctcgcggcaacgtacgttgacgtgttcgttctcgttcacgtgttcgttaacggcggtgtggcggcatcgggccagcgcttggcgcggcggtgtggcggcggcggcgtggcgcggcggcgaatgcggcggcgtggcgtggcgtaggcggcgttgcgcgcgtggcggcgaaggcggcggcgtggcgcggtgtcggcgtggcgcggcgtctcgtggcgggcggcgcgacggagagagagatcgagatcagagatcgatgaagggagaggcggcggtggctctcaccccaaaaatgcggcggcggaggaggaggcggaggcggcggcgaggacgactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtatgtattgatctgacgatcaggttgtctcatatatatgccccctagagggcctcctgcccaccttatataggatggggggcaggatt

SEQ ID NO: 76180 - DNA, 2346 bp, Oryza sativa
gtaataacaaagaaaacgtaacacccaagtcatgatctgttacatattacatagatataagtaatcccctataactagtcggataaccatccggtgtgggtatggggtacccataatctccacagtagcccctgagaccttacagtcgaaaagataatcttctctcgaactagattactccaaagctgagtgcttcaatcatcttcgccatggtctccgaagtacttttaccaaatatgaagactgtggagggctgaaaaataaagtcaggtgcaccggctagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagttataaagaagcttgtatattgtgaataaagaaatttccaaagtattgggcatacgccatgcgcacactgctttaacaaatgtgcttaagtccctagaagacacatggtttcaccacacctggaaatatatggcatatgtggtgtaaaatccgagtaaataaactcataaatgatttaccaaccgcctagaaaatgaccacaatatataatcagcctaagccataatattggtcaataaaaatgcacacttacgtggcgaaaagcaataatattgtatccaatcaattgcttaaaaacccaaacagcaccttgacttatatataaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggttgcagacatattaggcctaggccaaaaaatatgccttcgacaccctttaaaggatgacgcatgtaacatgctcccgagtaataaatcttccaggtattatagaccaaatgtagctcatatgaatagcttctgatctgagtggttacgtaacaattgaatcccgactggcgcaagtattcagttgataacccttacggggaataataaatagtccagtctttgagcatagaaaatagacccatgatcacgaattcatattgcatatatccagagcaagtctaaattggagatataatcctcacgcttgagttgatgagcaaaccgacgatgaagacgtagacgcgcatcaacggtgatggcgaaatccaccgatcatgaagatgaagaaaataatcggcgacgacaaacgcaaccgacatgatgaagatgacgatgtcggtgatccagccaatagcagtgtagcaaccaatgataatgacaaaggcgctcatcagcatttgcatagtaggtcaaccgtgaaggtgaaatatttggaggagagttgatgctgttgttcaactcgtccaaaccgaaatatttgaagttgttgaagtagaatgtctgctccgaagcaaagatgaagataatgactcctggagctgactcattggctgattaattgatttcttcagcttttgagccttgtatttgtgtagcccccgactctttggttagttgggaaacaactgaacatagagtcgagaattatagcttcttgtcgtcgagtagtcattgcttgattgaagatatgtgttgaagatgtccaagtagaaatccatgatgacaaagttgcatcgccgtgatgaagtgaacacgagtcggcggcaacagaagcaaactggtagtgaagacgcgcagttgtgaagatgaaagcaccagtcggcggcggcataaccagtcggcgacggaagacgatgatgtccatcagtagtggtagcggtataaaccagacgtagaggcgagggcactagtcaacagcagacgagatgaccggcggtgaagaagataaggccaaccaacactggtagaatcatgcagccatggaagtgaagaaaccagtcggcagcagacgtaggcaacttgtgttgacgatgctgacgcctattagcggtgacggcgatgtagcagccgtgaagaagatagcatcagttggcgtcataacaggccagccgtgcaggcggtgacaccagtcggcggcggatgaggcggccggtcggtgaagacgtagacgcccaacaacagtggcataataggccagccgtgcaggcggaaacacc

SEQ ID NO: 76181 - DNA, 2338 bp, Oryza sativa
  unsure (1)..(2338): unsure at all n locations
ccgaccattgcctcgccttcatcatcgagtggccatggaggtgctcatcaccatggatagtaatggggactcttatagtgtcacacccaaccttacccaatctactttttaacaacgatggtaccatgctcttttactcctctctctcttctcactcattttctctttttttcaccagattggtgtgcaatgaccaacaagcgataacgttgggcttggctttgatggatccaacacagatccactagggtggcgatggagcatgagctgctgcactagggactcaagggactcgagacccaacagatccactagcacgatgacagaggagagtgagcagcgatggatctggtggccggggctcggtctcccttctcccaggcacacgatattatggcggctcgaccaacagcgaagctcgagtagacaaggagcatattagagaagaagaaatgtagtgtaggtggtaggcagctcacctctgatcaggcactggtgccgtgcaccccttctctaaccatgcgtaaaaacaaaaatagggcccacatgtcagtggcacttacataacattgcatccacaaaaataaaaaaaaaatgtaatagacccacaaggcagttacacgttggcctctcttcttccttcccatatctcctctctctctctgtgtgtggatgtatgtctcaacgatgagatcgatcgatcaggccgtggtggcacccaagcttgacgaggggaaggtgtaccatacgaacaaggggacgggatactgtaccttagtatattaccgttaattaatctcaaacggataagagcaaggtgcctcgtcaaacattactttaaaatccaccattcagtcttattccgtacgaaggtttcagtgaatgtattgatcgtgttgtcacagtcagcttactagtatntgacaactactagtaagttgtttatagtggttggcagcatactaattaaaatatgttggtattaaaagtatcctcagaaatggtagtggagcatgtgctggagaaacattatgtcacccgttaattaattttacaaacatatgattaattggagccaattaattgtacatattgtcttcgtctcaaaatatagtaacttttggctatgatatggacacaaaagtaaatttatagcatatatatgcgcaacaaagtaagagcctaaaatttgctaaatctatgcttacatgttatgcattagggagagtcagaatttgtgtgtattaattagtacagttgtatatatatcttagtttggtgctgaaaatccatggaaaacagataaggcgcgcatgaacgaaaagtttggtttcatatagtccactactgttatctcagaaaagaaaaggggcaagaaaagttactgagacttcaatgtagttttttttccttttttgagatgaagtcaatgtagtttgtttttctttttcagatcgatcagtatgaacagatcaaagaatgaattttcaactaacaccaagaaatatcttttaaaaaatcgaccagaatatataactgaaaaggtcccactaaaggcatgatacgatcgtacccaaaatcttacccacaattgtattttttggcatgtcatgatggatgtgcaatcagtagtgagatgatgaaacaattaccctacatatacattttgcatgcatatagatgtcaaacaagacccatttgttgccctataaagtctaaactagcaacatctcatatatatggaagcaaccacgaaaaggcatgtagtctagtggttgcagtgacctgagtagtaccccaaggtactgagtttaaatctccatatgagcgaatttcagattgggttgtttgtggagctaagttccctatttcagattgggttgtttgtggggctaagttccctatttcaatgattatatatatccagttagatgtagaggctgggtaaaaaatacccttctctaaaataaaaaaatatagaagcaactaaacaccagctctcagcgaggtgcgtggattggcaaattttatctcatggcagtaaccaaataacccctaaatccatttaaatgaaactaattagaaacatataacgtacaaataacgtaaacatgcatcgtcgtagggtgtatctattgtgcaagacttttttggttaacgtgtgggtaaaattctcgagacttttttggaataaggatccgttttgataagctagaggtgaaaaggatagagttgctaatcagtcatcatcatatggagtagattcatagtgcatttgcacggccaatcgttggggcgaccagcagcctaatgctttggacccatggaggagccagga

SEQ ID NO: 76182 - DNA, 7808 bp, Oryza sativa
  unsure (1)..(7808): unsure at all n locations
ctgcacccctttgaaatgaaggagccgcttgcccctactctgttaattaatggtaacggtgttaaatgtgtggtgaatagacaaatatacccctggacatgttttggtatacacactggatatgtttcaagttattttgtgcgaatttcatataaacgatgacagaacacagtttataaagtagtacatacttattacatatgattgcaacattgcacaagatcaaggtcctttatattgggtagctacagaaacaagattgaatcacaagcatggcgtagcaaatcaagaaccccaacttcattatctagaaaagaaaaaaaaatcaagaaccccaacctgcgttcggttctgggtccgcggatgtggatgaactaaggtggcgggctccggcttggaggaggaggaggcctccaccgctgcctgtatggcgccgacggtgacatctctgagccacctgacgttgcctcggagggtgaagccgtggagctccggtcgacgaacgccggaagccacaggagaaggcccgcgcccgcggctccgtcggctggacgacgtgctccccggcggtgttgtcgatgagggagggagtagcggtcgcgacgtcgtcaagcttcctttaacagcgccatcccgccgccaagcttcctgctcgctgcttgctggctcgctggccgacggagccgccgctcctctccgccgtgcgctggccgcggggccgccggccgccgcgcctccctgcgcgtggcagccgcgtcgcgcatccctgcgcgctggccgcggggggcgccacgcctccctgccccgcgcgcccgccgatccgccgccgcgcctccctgcccgcgcccgactccaccgactccgccgcgcgctggcccgcggcagctgccccgcgctgccgccgccgcttgtcgcgtgcgccgccgccaccgcttgcaacttagctatagcgtttggagtggaaatcgggagttcgggacagggattggggatttgcctctttcattgaagggtagaatggtcattcacaaatgataataacattttgtttcatcatttaattctaaaatttcgggcccaccatacttctgtcaaaaccaggggcagacgactgcttcatttcaaaaaagcaggggcaaaatcacaaaccctaaaaaacaagggtaaaatcacaattgaattgtaaagcaagggcagaaacacaattgcccctaattttatttatctgcgtgaacaaaatatctgaattgctaaaagagagttcaaacagtttttctcctctcgagacttttactccggcgcccctaatgactcatttactcctcgagacaaaacaatcaagagaattgcttagactctgtttagttcgtgaaataaaaattattgggtatcataccggacgtttgactagaagtcggaggggttttcggacacgaatgaaaaaactaagttcataactcgcctggaaaccacgagacgaatcttttgatcctaattaatccgtcattagcacatgtgggttactgtagcacttatagctaatcatggactaattaggctcagaagattcgtctcgcggtttcacccctaactgtgcaattagtttttatttttatctatatttaatgctccatatatatgtcaaaagatttgatgtgacgtttttgggaaaaaaaattaggaactaatcatagtgaatatgtttaaatgcataatatttatataaattatattaatgtatgatatccacaaaagttatcaatatatgtctagatttattaacatctatatgaatatgagcaatactagaaagtcttacattatgaaacggagggagtatttattactccctccatttcaaattgatttcctaaatgatctacatatttgtgttcatttattaggtctattcgttatttatgcattggagtaaatggacattgatacatgcatccgtgaacacatgtatttataacccatatgcaatattttgatttgctattggctaggaaatagtggggatggtgcatgtattgagtttgttgctagagtaaatatagtatgagagagttattagcttttcttggtcttggtataactatgaaatatgtagatcaatttgaaatggagggagtaacatggtaaccgcctcagccatgttgtacttgtacatgcctagagtgggcttttcaagttactccataggaagcttccaatgaaaacatacagtattgactgtactatcacagcgttcatagtattacttgacatactctacatgtattttaaattttagtggttgacattattatctattaaaatatgctatagttttacgtggtaaaataataattatgctatagtttcaaaagtatcggtaaaaaaataattatgctatagtttaaaaactatcattagatattgggaattaacgtggcaggagaaacatagtttcaccacttaatttttcaaacaataaatacatagcaatttttatagctgcccattcgcattatcattacaaggcactacgtttgcgcaaagattattgcatgcatgctatgaattatggagagtacaatttttcatcaactttggtggagaaatccactgaattaatagataatatcccaaccaaaaagtcatgttcctaggacatgtcatccacccccactatctccataaaaaactgaaaagaatgggaaaaattgtacggtaaagtcaatgcagtttgtttgcttgtctgaagtatgaacacaagaatgattcttcaacaaaaacataagaatctctccgcaaagctggcatgtggacctatacaatatagataaatcagataaggattgtatcttttggcacattcctaaccagcaatgtatattaataaaacacctaaaacacataaaaataagagaattaaggagtagtatatattttcagaggagaatacgcatacgtataaaattccctaaaacacatgcacaaattaaatgaggctaaaaacatactccatggagttagcatgcccacagcacgaacacacgtacatttccctggacatttttgtgcaatttggatatgcataagtcatcctaattaaggtagattaattagatacattatattacattctacatatatagaaatgttccttcttagctagttcactttgaattcaacgatgaaaggcactaaagatgtcaatgttgaaaggaacggatcaaagggctggaaagtctcggtcatcggcttccacgctctaccaccaactaacaagatgacaaacaaaaatgtcacagtacacatcagctaatttacgtgctgtcaatacttgtgagtttgtccacgtttcaatttactcatgcaaccctattcgagtacagttattgctaatatcttaattagtaacaaaaagaagttacgtcgcctaatcaagatgaacatataaaaccatccaagattaaccacatgctgcatgtggaagtggataatgacttggataattactctacacccatggagttaattagacaagagtagtatagtactaggaatttccactagttttacttcattaaagagagctagcagcacaattaatcggtcttatagtaaatggccaaagtggcgcagcacaaatggtacgtgacatgttaatactacagtagaatgaacacgtagtatgaacggcctttttgactttctaccctaacacacggctttaccttcatctctgtgactctgtcctcttgcacggttctgtttttgaaaggaaaaaaaaaccaaaacccatacatatcgtccagaacattcgtcccactgacatgtgggacccagacactgaccctctcccctctccgacagtatctggactggatcgtcatcctacggccacgattcacgcagccgccgccgcttccgtcaccatccccacgttggcgcggggcccgcacccccacccactgacgtcagcggcgccagagcagcggcgtgcagtggcaggcggctgaaaataacggtgaactcgcggttccagacacgtcttttcttaaaccgtggttaagctgctaattgtgggcgggtttaggcgaccgccctaaaccacacggcttacggtttaaccccgcacgcgcccctcgatgacagcgtggccccaccgtgatgcgaccccacttgtcagcgacggtcgcgtgggagggggctggaggcggcgcgctcaccgcggatggcgcggcggcaggccactcctgtcacgacacgtgggatggtacccaccggtggcccacctgtcagtgaggggagggggcagtgacaccagtgagagacgaggagtaattctataaaacggatttggcgcacgcggcacgcccacccgctcgcgcaattcgcacgctctcctcgcctcgcctcgccttctcttctctcctcacctcgcccgcgtcgtcgtcgtcgtcgtctccgcggcggcgggggaagcagcgggaggcggaggcggagcancaacagcaccaccaccccggggcggggccgcggcgcggtgctcgcgcgcgtcgactccgtgtggtgcgccgatggtcctccccgcttcactccggggttcgtcatttcggtgggcggatgcgggtgggttggattcggtgtggttcgtggggggtggggattcggatcgggggtgattttgagagggggggatcgggttcttgattcgaggtgcgattcgggaatcgggagttggagcgggggagggggaggaatatttcgtgtggggtttgtgcgcgattctccccgtcgcttttggggtaccatccaggggacgagggagtcgtttgatatggtcgcgttcatgcttctatttttgggtggcgatctcctgtaaaatttggacccggatcggggtggttctgtttgtggtcgagttttcctcgatttgattgctgagcggaatattttgttgggtgttcttgaatttttttttttgcgtcttatgtggttgattggtttgcgattcttcattagtttatcttcgccgcgtttgtgtaaatgtgggtaatgtaaagaacaaaaaaaaaattcagggactaaaattagtgtgttctgttatggcttcagcgttgctggtctgcagctgctgcggaagtagtaatagatgaggaaatgcccaccgatttttccagattgtttgatttcttcttgccctgttgttgtggccttgataagatccggttatggctacttattttattcttttatgccgtttaaatcaattagttcatgtatctttgctgtacaaattgtgtgttatcattttgagttgtggcattttgtcagtccaagattccctgagacaacgaaccttactaatgatggcggtgagcagctactgagctctgcgtttgctttacctgatagtgcttaatttggcaattgttagctctgcatagtgctactgtacacgtggtagtgttcagttttggtaggaagagcactaaatttaagtactgctatgtatcagttatttctttcagattgtttgaccacagaacagatacgttttcatgttatcaatgcacatccttttagaaatatgccttggtatttgtatgtcaactaaagaagcttgtcgtttacaattggttctatttttttcaggacaatcatgtgttctaaaggtattgggttagcatcatttaacaccagcataagcaaattttggagcgatgaggagcttgtccgattcttagcagagaggaaagaagcacactctctgccagagaatgtatttgtgggaatgaacatttctctcattgatccacgtaactcaggtttgcatccaatctatacacaggataattaatggtattttccaacaagattatggcatatgtggaatttgtggtctgactttcataattcagtcattatggaccctgaaggcttctttgttttgtcctttttgatttgttatatacttactttacagcattgtattgtatggttgagcagtattgcaacattttaattctcaatagacaactaaagaaaatgaattctgcatagaattgataactatttagggttgaaaggcataaacaatattttatgcaatgccagaaagaaatattttgagctctgatgaaagtgccatgttaagtgcaggaacacatacttctgccccattgattatggcacaaattgccagcatgaagtgctcataaactatagcaggatgttatatgagaaatagtttggcacttcacattaaattgagcattttgtttttcatttttcttagcttgtgcaccaattgcttgcctgcttttgctggaaaagtatgaagtacactctttgatgattaaattctgttcactgtgttgcttggctagaacttactctgccatccttactagattctccaattatgcaaaatcattgtttccaagtgaaaattaagttttcgaagatgtcagaattcagtatatgcaattaattatcaacttttgtttttagttggagtcactatacaagcagatcatgtgcttagattttggggcttcagttcactttccacactaaaatgtgcacctaagttgttgatatgtgtctctgcactcttcagtatcccacatcataacacatagtacataaatctactggaatcatatattaataacattcttgcatgttttaaattggtaactggtgcctggtttcaataaagatttgattgcaaattttctgaggtatcagaactaaagtttactcttttttgcatagcacaagtccacagttcactgtgaccagcggtgctatatcctagagttaagctattcctacaatgaaaaccacaatggtgcttaatggcttattatcttgttaaacctcaataaaagataatctgacagagataacttttcttgcagaggacatatggtacatgaatttttcagatgatccacaatcccctaagaatggagaaaatgctattataaagtcaaaaaccggatactggaaagttgttggcactgttagaataccgacaagtactgttattgtgggtatgaaagtttctctggaccattataaggcgaagcaccatctggtaagagaactgggtgggtgatggatgaatatctgattgaacagaatgacgaagctaatctaccacaggtaacccatggtggttgattgatatcatttttttttctatagcatataagctttttttccagggttgttgattgatatcttttgtatttttgacaggactacaagaatttgtgtacaatattctttcagggagacgacatattaaatgctggagataagcagatatgtctgaatgcaaatgttcctaatgaacgcaaggaattttaccttcaatatcttgctgaactagaagagcaaaatgctgcatggagcaaccaggtttgtattgttttctttattatgtaaggcatccttagcaataccctggatcttttagttttgcacatattttttctcattttagtgtaaagtataccttgatccatgattgtctgtcatgtaaaattaagaaatactccagcaatcctgtcattgtaattcacttttttattttgattttgaagtatttaaggttttctccttcataaccatacaaaatctgttgtttgtgagagcatgctcctatccgatcatcatttactacttattgctttcttctgcattacaaactgtgaatatttagatgtgtgataatactaatgaatatccaatctacatatgccaggctgtatctgtaaacgagcaagatgtctcttccagca

SEQ ID NO: 76183 - DNA, 2446 bp, Oryza sativa
ataaattggacaagatgttagaggaccacagaacttcgttgtacccaggttgcgagcacgggtacaaaaagttggataccactctggagttcttgcaatggaaggcaaaaaatggggttagtgacaaggcatttggcgatttattgacactagtcaagaacattcttccggggggaaaaaaattgcacgagacaacgtacgaggctaagaagatagtctgcccgttaggactggaagttcataagattcacgcatgtccgaacgattgtatcttatatcgcggtgaggagtatgagaacctagaagcatgccctgtttgcaaagcactaggatacaagattagacgagacgatccaggagaagttgacgggcagctaacaaagaagagaattcctgctaaggtgatgtggtatttccctataataccacggctaaggcgtttgtttaggaacaaggggaatgctagaatgttgcgatggcacgctgaagagcgtcaacaggacgggatgctgagacaccctgctgatggttcgcagtggcgaaacatcgacagaaaatttaaagaatttggaaaggacgcacgaaacatacggtttggtttgagtacggatgacatgaatccttttggagagatgagcagcggccatagcacttggcccgttacgatgtgtatctacaacctcccccctggctatgcatgaagaggaagtacataatgatgccaattattattcaaggccccaagcaacctggtaacgacatcgatgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccaccccgtacggaagaaaggcaagcacttcgaacataaggccgaccactgtacgaagcctaaacatcgcagcgagaaaacagtgtttactatggttaaagatcttaaagtagtgttcagaaaggggcctggaagccagcctatagagagcgaagatggtcacgcggcgatgtggaaaaagaaccctatattttgggagttaccatattgggaattcttggacgtacgccacgcaatcgacgtgatgcacctcactaagaacctttgcataaaccttcttggcttcctaggtgtatacggaaagtcgaaagatacactggaagcacgtaatgatctgaagcatatggaacaacgcggcgaccttcacccggaaccaaaggagaaaggaagccattacttgagtccagcaagctacactcttagcaaggcagagaaggaaagtatgtttgaatgcttggagagcataaaggtaccgtctggatacttcacgaatatcaagcgaattataagcacgaaagagaagaagttcacaaacctaaagtctcatgattgtcacgtgttgatgacacaactgctaccagttgtaataagggctatcctttcagacaatgtccgggcaacaataacaaagctacgtgcattcatgaacgcaatttcgcagaaagtcatcgatccggatagattagaagcccttcagaatgaaatggtgcaatgtcttgtcagctttgagttgatatttccaccttcatttttcaatataatgacgcatctgctttgtcacctagtgaaagatatcggtattctcgggcctgtgttcctacgcaacatgtttcctttcgagaggtacatgggcgttctgaagaagtatgttcgtaaccgtactcgtccagaggcaagcatcgccaaggggtatggaacataggaggtcattgaattctgcgtagaatttattgaagaccttcgcccaatcggggtacctgaatcacgccatgaagggagactacggggaaaggggactctcggaaggaaagcaataatgacggtagacaacaatttattccgtaaatcccatttcacggttttacaacaatcttcattggtggctccttacatcgaggagcacttggctctagttcacgccagaaacatcgataagtccgatgcatggattacacggcatcacattgttactttccccgcatggctgcgacaacatctcatgggtaacgagacgattaaccagcaactagccttccttgcaaggggtccatttggctcgatcgtgacattccagggatatgggaaccagaacacattctacacaagagcccaagacatgaagagcacgaaccagaacagtgctgttcgtatcgatgccatggaacacgatggtacaacttgcacatattac

SEQ ID NO: 76184 - DNA, 2683 bp, Oryza sativa
accgaccggccgcctcgtacgccgccgactggtgttttcgcctgcacggctggcctttatgccacctgttgttttttttatacgtcttgaccgaccggcttgcctgcaccgccgacgactggtgtttccgcctgcacggctggcctttataccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcatggctggcctttatgccgccgttgttgggcgtatacgtcttcaccgaccggctcgcctcgtccgccgccgactggtgttttcgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggctcgcctcgtccgccgccgactggtgcttccgcctgcacggctggcctattatgccgccgttgttgggcgtctacgtcgtcaccgaccggccgcctcgtccgccgccgactggtgcttccgcctgtacggctggcctattatgccgccgttgttgggcgtctacgtcgtcaccgaccggccacctcgaccgccgccgactggtgtttccgcctgcacggctggcctattatgctgccgttgttgggcgtctacgtcttcaccggccggccgccgcatccgccactgactgatgtcaccgctagcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgccgctgttgttgggcatctacatcttcatcgccggtcgtctcgtctgctgctgactagtgccctcacctctacgtctggtttagacagctaccactactgatggacagcatcatcttccgtcgccgactgattatgctgccgtcgattggtgcttttatcttcacaactacgcgtcttcactaccggtttgcttctgttgccgccgacttgtgttcacttcattacggcaataccactttgtcatcatggtggagcgacttcatctttattatcttcggcaccggcaaactctattgctgctacttcgcaagttttactacttcaccaaccacgacgtctttgtgaacctcgacatctcggcatgcaatgccatgatattttactacaacaagtgattctccaatattcaggatttctacttggacgccttcaacacatatcttcaatcaagcaatgactactcgacgacaagaagctatagttctcgactctatgttcagttgtttctcaactaaccaaagagtcgggggctacacaaatataaggctcaaaatcaattaatcagccaatgagtcaactccaggagtcattatcttcatctttgcttcggagcagatgttctacttcagcaacttcaattatttcaccgacaattttggcttctcagcgctgccataatctactccaaaattctcaagtatcaagttcaagatttaatctacatgttcgggagtttggagttatcaaccaatcagctcggtttagacgagttggacaacaacatctactttcctccaagtgaagcatctacaacagctgtaacactaagttctacagtcatcttcgtaaatcaagaagcattgcatcagttttctttatgcacacgctcacatcaaggaaacttctcaagcttcgatagcctactctgctgccgttgatgggcaacttcgtcatcatagccggctatctctgttgccgctaatcatcattaccgtcggatgcgtttgccattgccgactattttcttcatcttcataattggtggatttcgccatcaccgttgatgcgcgtctacgtcttcatcatcggtttgcttttgtcaccaccgactgctctgtcgttgttgttgggggccttcattttcattgatggctgacctgactgctgccgactggtttcatcgcctccacggctgtgcaacttcatcacttttgattagtatcactatcttcactaccactaatatttttgtcacctctagtgggcaatattatctctatattggtcgtcttgtctctatgccaactgcgtcagctactatcaatggacaattgtgactacgacagaaggacaagctatatgctcaggggcttactagttcaaacacaagtatcataccttcaatttggacttgttccggatacatgcaacatgaattcatgatcatgggtctattttctatgctcaaagactggactatttattattcctcgtaagggttatcaaccgaatacttgcgccagtcgggatttaatttttatatttattttggagtatatcataagggataatcactgagatcagaagctattcatatgagctacacttggtatatatcacccagaagatctattactagggagcatgtcacatgcgt

SEQ ID NO: 76185 - DNA, 638 bp, Oryza sativa
aagagctccagtttctggaggaagatgtttacagtgccgcaccaacagccagtctgagttcttcaagaaatacggatgattgccctgatcatgataatcttacaaatgtttgttctgaggtgcgcattcttgttggtgttattacttattagactctcattagttctggttttcgttggtgccaaaatagtatggctgattaggctcactgggagatttcttgtaccaggatgaacaacagcctgaagattggctggacggagcagtgtcttttgcaagtgtgattgtcctggttcacaatatgttaaaaatggattacatgatgcaggttagcaacacaaggatctgcatgtaagtgagtttcatttgattgcttaccttttcttctcacagaagctagagtacactgcaggaaaagattgtaaaggcattttgggttaaaacatcatcgtcggagatagagggctactgtcaaatgtgggatttgcggccatacatcgatgacaatgtgatgcagctggcctggcagcttgttccttagaagctacaaaaacaacggagaagatgaacagcagcacccatgtttgacaggcaggtgagtttcctgctagcactagtcaggaagaagttgcagtagc

SEQ ID NO: 76186 - DNA, 735 bp, Oryza sativa
gaatatgatcgttccatgtaggcggcggaaaggaccatatggaatgattattttcacatgcaactgattaagccgacatcttgcacaaagattatctttccatgcgaccacatgcgggtaccacatcaccatggaggaatatttttctacgcacgctcggatgaatctaggtcaacaacctcagtaccaaaggacatgtttctctctttgtaccgacttgtttcacatgttgggcaaccgtccaagtctgcaaattccttatggtacaatacatagtgatttagacaagcgtgaatcttttggacacctagagataatggaaatatgagtttcttcagttgatacgtgttggatgacaaaaagttaggcttaggaagcaaaactctcaagagactcatcaaatcattaaaactactatcggaccatccatgctttgccttccaagtaagtagtttaagcaccgaacgcaacactgtgatgtccttaccacatccattggattcatcgtaaagaagatcttttgatgacttctttaatgactcccaattctctaaacctcgtgctctacgtagtagtagctctggttcaatgtgccatagcatgtcctccagatcgaaaacggcctcaaaatcatcattaccggtggaaccatctacatccatcctttctcaggagacatatatatccatgattgcaaaattatgtctcatccatctggaaattgaactcttcacc

SEQ ID NO: 76187 - DNA, 10484 bp, Oryza sativa
  unsure (1)..(10484): unsure at all n locations
tggtgttctaagtcatccttgtagtttttttcttttaattggtggaatcacggtggctgcctgtggggaatctgagatcggtggacagaaggcgaagcgccatgcgtgcagagcgtggtggtatggagattttcccttattttcaagcatggcatggtgctcctgaaaatagctgctcttgccttgacacgcttccggtggtaatggttttctggggctcctgaaagacaaccaccaggatatgtcacctgagatatctttagcggtaaacacaaagcaaacaacaacaaatttgtttgaaactagagagatgttcatcatgccgaaagtaaaaaaatgttatgtgacgcagaccattgtgttgttttttttctcccttcgtttggtggggctatgatacggtaaatacggaaacgatcggtataacagcaaaaccatttccattttcatttccatattttttaccatttttatttttgtttcggtcgattaccatttccatatagctcggccggtagaaagtcgaaaacgaacgccggtcggccggtaattatcgttaccgttttcacccctagggctatcactatgtctattggaatccactatctctactacttaaaaaaataagaggtgcttccatcgtccgtcaaaaaaaccgggcgaaaaaaccaaatttgtccgatcaaaaaaactaggtgaaaaaacgtgcggaagaaaagaaaagaaaaaccaaatctgcccaatccagaaaaaagaggcgaaaaaaccggcaaaaaaacccaaaattgtccgatctaaaaaaaccggtgaaagaaaacgtccagaaaaaataggcgaaaaaaaaccaaaattgtctggtccataaaaaccgggcgaaaaaaacgtgcgaataaaagaaaagaaaaaccaaatctgcaaatatgtccgatccgaaaaaagggcggaaaaagaccggacgaaaaaaaaccaaaattatccgatccaaaaaaaccgagcgaaagaaaacgtgtgaaaaaaagaaaagaaaaaccaaatctgacgcggtaaaagaaaaatcgggggaaaaaacgaatatgtcttattcccaaaaataattgtccgatctctactattataaaaattaaagatgcttccgccattcgtcattcgtgtttgagtaggttataaaaattaaagatatttccacgatttgtcatccatgtttgagtctgttttgcaaaaaaaaaaaagcaaaaaaaagtctgtctcccctacgaaagcggcgaaaaaaaagaaaaataataaacgtagattcaattccaaaaggggaaaaactagacaacgaaaagtcgggaaaaaaaagcacggcctttactaccagtccaaataaaaaacaacctagaaaaaaagagagtccgattaaaaagtcagaaaaaagagcacggcaaaaagaaccaattttaatttgttttagtagtatgtatatatctattctctatctctaatataaacaaaaaaaaagaacgagaacaaaaaagggtttccttcatccgtaaaaaagcaaaaaaaaaaacctgcaggggaaaaactatcagaaaaacacaccatttcataaaaaatagtttgaaaaaatcatgcaaaaaaaataccatttataaaaatacaatccgctctgagaaaacggtcattaaaaaaaagctgaattgatggatgcttgggtcggataggatccatcggttttttccatctcctctatgacttttgtttcgtcatttattctcatgtattagagaccctgtgtatctctgtaggcaattatcaacctatttttgttaagtatagctactattcttgataacatattatatgaaaataatattaaaaaataaacatatttttaattgttatttagagaagagtgctcaatgactctattttgtgtagacttggtcatgcgagacagggtaagatttaattggtcctattattggttgcaggaatgagattgaaagagtattttagattatatgcatgttgtcacatgaataatccaattattttagataaagtaaacatcggtaaggttgccatcgtcgaggttggtctattatattgaagatgttccaattttctgattgttttagctacaaacgatccatacaaacattgccattgacatggttatgcatgaaaaatatatattatcattagaaatttttcacccgttgtaatgcacggacatttttctagtcaattaataaaacaaaaaagtttcttttaaagatgtatcatttcaaagatctaatccattgtgagcgaggcacagcagcagcagtagattgaggctctggtggatgcgattgagaagcagcagagatagattcgtcgttcggaaaatgaagtataaaaactagattcctcgaaccagaggcgcatggaggactcaccgtttgacggaggagcgtgaatccatggcgctggctggaaaaccaagcaggcaacccagaaggcgacggttggatggattggaatacgcggtgggtcgagactcgagagagatacgtaccgaggcaggcggctggtggggctatatgggcattgcgtggggaaacttggaaatcggaatcggattccgacgagcggcgccgattccgagactccgccgagagccccagtgagaaagaggggaacgtttcctccgtttaatttttatttatttttggtagaagaggctcacggcgcgaaggttcgatggcgtaaattttcgttcataatattcactctcaactaactataaaagagacgctgctttgccgcgtaatgggccatcgtgtatatactctctctgtcctataaaaaatcaacatagtactaaatgtgacacatcttagtactacgaagaatctggatatatgattcgtttttttggatggagagagtactgtataacatatgtaatggtaatattttatctaataaataggctatttgctcaacgagctttatcgaaagctttggtctttttagttgttgaataacgtacatatattattgagatgttgcttgcatttggtattggtggaaattcctggaacccgaaaataggacaagatcgagtggggtgactaaggaaaccatataaattttagtagtgaatttttaaaagagagatgagagcaacataatcattagttaggggacattttggagaatagctggtgcccggtatcgttcttatcccttctccagtagctattctcttccggtagaataataacaatagaccaaaatatctctaattaatagataagttatattggtggatagataggtaagggtagtgaatgattaaaatttctcgatttgcatattaatggtaggtaagaagttagaaattggtttttaggacaaatttaaactctagaagttgatttattttaaaacaaagaaaatacaactctacgctccacggtagcgcactttggatatacaacaaaaataaaagataattaggtatattttttaaataggatgaatagatccgatatgagtcttggtgtagtatgaggtctgctattgtcaattgtgataggggcttgaggaggaagaagaggggatctcaaaaaaaaaaaaattggatctccttatttatagggaacagggcatgtgacggtttttttttatccactggtgttacttctttatcttctgaaagggtcgggtacgttattctagcacaaaattttataagtactataccatccaaactgacataaatgcttcttagctaccaattccaacgcgtagcactattgcacatggtatcctcttgttttcgtgaaagcatcatacacacttaaaaataatatttcggcatcttgctgggagcgagcaactcagtaactataaacctttgttaacgaaagatggcacaaactgcaattcactctctgaattgaattgacttattatgatcacgttacattggcaaagcagacactgtgccccacacatagtacagggcttagacctggaacttattattaatttaagttactagcatgctgatgcacgcagagacaacactggtcgatggagctataggcagctacctcgatgatcatggcgccgctgcgccaatgccgcagcccctccgctcggcggtgagcatgtgcggtgcctcgtcaatggccagccactgatccaccgcccaccggtgcgtcatcgacgggaggctcccctgcccgagctgcgtcaccatcacgtagctcacgtaccacccgggcttgttgccggacccgtcggaggtgagcaccatgttgcagggctccgacggcatgcaggcgccggcgcccctgaaccggtcgaggttccccttctcgaagtagtcgtggccggcggccatctggccccacgactccaggttggtgatcgtcagcgtcggcccgctggcggcgcgcacctgcagcgagacgcgggcgtcggtgccggcgttcctccggccgtcggtcttgacgaggatctcgaacgtgcactgcgcggaggcggtggtcgccgccgcgaggaagaagaggaagcaggccagggcgatggaaagcttcatggtaagcttcatctttgttgggtgtgtgtgcagtgtggtggtgtatgagtggaggagtggagtgatttgctgtggtattgcatgctcccccaaggcaccgttttatagccggcagagagctaggaaggccaatggcacttgccattttcttaaatgataatgccgtgacctgtggggatgcaaatactatgagctgtgactgggtgtctattctgtgaggaatatatgatggaaaatgctcactgtcatgcgcccaatctcgtcaagaaaaaaaaaatcagacatacccccgctctcagctaactaacacaccacccactaatttctacccatctcctctctctcccatcgagatttccctctcttctgtcttcatggtagtataggagtgcaagtagctagctaagagaagctccacttaacacacttcaaatgacttttttagtctaaatgatgtagctgatatataattaagccggctgtatcattgtattcatggtaattaagctttttcgaaagatctctcgtgattctaactgaaattcgactatattgcatattctttttttttgtttttgcaaatgaagtttttcttataatgtgcccatgcacagtattatttggatatttttccgacgtttcgttacttagtttattgttaaatgttgcacaggctatcttttatattttaacatatatttatgatgtttcaacaattataactagatattttatgtatcataaatatttcaattttggatataatcatttatatttttgtgataaatataatcatgtaatattttaatttaaagattcaatttcaatgaatacagtggttaagtcggatcgtaaatcagataagtaatttaggagaggagagaggtgctgctccatcctccattcatgcagaggcagtggtattgtcttgttcaaagttttgctaaatttgtttggggaagagatagaaggatagaggtgctgatccatcctccatgcatgcagaggcagtggtattgtcttgttgaattgttcactaaatttggtttttggctgctgctgcatggatgcagatgtagctgccctggtttttggcatttcatcggcgcaacatgcatagtttcatccggaatatattcgttcgcaattctgcacgcattgatccaaaatagaagactcccccggcccatacggaaaatatgaccatatgcattccacacactaggttggctggaaatcttattcaaaatttcctagtttatttacatgtacacattgcttttgaattttgatcatgcccacgcgctgatctagttggccactagttatcgacccatgttcttttgctttgcttttttcttcttcttttttttttgcccttttttccttttttcctctccgtttttttttcggttttgctataattatatcgccataaatcttgttagattacagtcagatttgtatccctgggatctcctattagattcatgccggagtacttccgtgtctctaccataatgtgtgttcacacgctagttcataagaatatgattaacaccaaattattacatcaaaataaggtaatcatagaaaaggagacgctatattgttccttgtaaatacatacgtaactttagaactcacattataaatacactaaaattacacatgtaattttgggacttacatatgtaattttgagacttacaatataaatacacgctgactatttttttgataaaaaatatgacggtataaatatagttagacctttttttcgttttgtctttttcccgcgcgccttttttcttagtttttttcagttttttccatccgttgtttcttttactttcttttttattcccttgccttttttccggttttttttccatccggctttttcgctatttttttaccactagtaaaaaaccctcatggagattagctttataggtgccagttcatttaaaaccgacacctataagttttttcccacctccacatgatgaaaaaaaaataagaaccggcgcctttaagatgcataggtgtcggttcttattataggtgttggttttttaaaaataaaaaacaggtaccaatattatagatgtcagtttaatgtattataagggccggttcttttaaacaaccagcacctatacccaatcgagccgaaaggggtgagctgagccggccgcctatatccactcgcacgcgcacacgagaagcgcttatccactcgcctctactcttctcacttctctgtcgcacccctcccccctcgccttctcctctaccgccctccctgtcgccgcccccctcccagccgtcctccccttcctccatctaatcctccctccctccgtccgtcctcctctccgttcattgtcgggagcggcgggcggcgatagagccctccccttccattggatccggcatcccctccgctggatctggtgggaggggaggcggcacccgatgggaggcggcagacggcggcgacgccctcccctctgccagatgtggcgggagggggggagggggcggggggcggtaggctgcggtgcacgagggaaggcggcaggcggcaagtggcggcgcctgaggggaggaggcgggcggcaggtggcggcgctctcccctcccctacgtcaaggaagaaggtggagcagagaaacccagtggccagccctgccctcccctcccctcctctccccagtctccattgtagttttctttagatgtttttgtgaatttctaaatgattttgatgttgactgttcattcgatctgtgatgtcgatgcggggatttaaatttgatttggggatgtcgatctgtgatgtcgatgtggggatttcaatttgatttgggaatgtcaggagaaattaatgtggggcagacgtggtgacgtcgttggtgagttcggcttgattcgagccggctcttttttttttggctcgtgcaaacctatagatgccggttctattttttttcatatatgttggttttcgctattggtgctgactaattggtgccggattaatggacacttacaaaccggcacctatggcatattctgagtgtaccctgcagtttttcacacgcggtaaagatttgtttttttatcttccatatttttttcatcgccgagccgaactctagcgccgccgccacgtcaaactacctccccatgtgttccctcctcaaattgattgaaaaaatcattcaccactattttctcatcattttccccatgattttcccttacaattctagttcaattcaccgaatttaatctcgatttaaaagtcactgttttatcccgaattttgtggattcactctgattttgataataaggaaagaggagatcgggtatatcaaaagagatgagaaagatttcaactggatttgatggagaggatcggttttggcatcgtacagatatgagactgtttttcgaaggttgaagacggtagtcggctatgcaagctagacctagagctctacttctgacttgggtcaaagagaggcatgcaaacaaaggaagggagcaggctgagactaaaaaaagaatgaaggaatgagcttttggtgcaaaaccaactagtaaatgtatagccatccaaaaatatttttacctattacaacgcacgagtattttttttctagtatataggaggaattaacgatcatatatagacaaccaccttactattgatttccgaaaaagaaaaaaagcatactactgttcatgctcccagtttctagtccacgagcacatgtgcatgcattcacccatgactattacgtaccgctccatcaacttgtgcatattttggcagccttgttctcagtgttcggtgcaataacaatgattagacggctattatccatccatcatatctagacaatatattggtcacacgcgcatgtaggttctccattggtctatggcaagttttgctcatttacagcatgcaatttacactccacttataaattaagtcattattacattctatctaaacataattaattagtgcgcgaattgaaagaggaatagttaacacttacaattatttagaaaagggtgaagtatttgatcactattaatttattattacatagtggaggtgcaaacatataatttcaattctatgaacttgagataatatactcccaccgctcattttatattacgtcctagaatccatgacacaccatcctctagaaactttgactaatgcatgtttacgttcaaacctatatcgatcgtgaccgagacatatgaaaaataatttgagttttgttagctttgcctatgaaactacttccacaatacattgtacaattttatatatatacacggcatctctcattatatcacgttataacaagttatcaaaggcaaatctcttaaaaaaaacatcgcataaaaatacggagagaatatataacaatttctaatattgaaattaattaaacgatgttccgtagttatatattcgtgcttacacgtgtgaattactgtatatattttttcacgaagcacaatacaaatgcattactttgggcggtttattcgtaaactacatcaccaataattacatgtaattaagtgctaaaaaatcatgggcttattatcttacaaaaatttgaaccaactttagtatagcaaaatgtaggacgaagctgggcggcaaagcgagtccgtcaagataatcaacgatgttgacgagtctttgaagcgtgcgcataggattattcccgtggtccgggcgtttgactgtagatatatgtagctatagctagttagctagctacgagagataatataccacagctcattttgatcgatgcaaaccatgagctgtgcacggtcactaggacacagagaactgctcatttgtgagggggtgctaatgggcgggtgatcgctccccctctcccctctatactctactctttcnttcctcctcacttttttctcttcccagtacaccataaattttaaaaaaaaataaaaaaacaaagttgaaaaattttatgcatagaaaatactatatataaaaatatttgaatttaaatttaaatttcaaacgggtatgtaaacgggtctataaactaatatttgaattcaaattcaaatttgaatcgggtatgtaaacttttgacaaaaaatatttgggtctataaatttgaattgatataatttaaattcaaatttgaatctggtatataaacttttgaattataaactttgggtctataaactttaggtgtataaactttagatgtatataaatactatatataaaaaatatttgaattcaaattcaaatttgaatcggatatataaacttttgacttataaactttgggtctctaaactttaggtgtataaactttagatgtgaaaacttgaggtgtacaacaaaaaaaaagaacccacgtggaggagtggggagggggatcggatcatctgatcgctggcatttccgcatttgtgatggcctgtccgtgtcggggtttacacgaaccgtcgcaccgtccaattttcatttcaacaggttgtttatattctactaaagattccatttgatgaatagattatacaaaatgatgaggactaggtcccgatcgatcttcctgtgaggtcacgatcgatcttcctgtgaggtatgttgatatgttccactgttctttattttcttatgctgcatgattttactaggttgtatgctccagtggtagaattgcaatttcctggggaggggcatccttgtcctcactttcatgaaaaccaaactctaacggtgttagtctatgctgtgagtttgatggtaggtatgctgggttccaatcgtttttggtggcaaatatgtaattatgttt

SEQ ID NO: 76188 - DNA, 5343 bp, Oryza sativa
tggagctcagcaatggtggtggtgcaaggagaagggagaggtagtggctagcttatatacagtggcgacgaagaagacggctgctactgttcggattcgtgtccagggcgatcggctaaggtggggcccagcgggtggtgtcattgggaatgggtagtgtggggcccggggaatcacagcgcctccaaccatagaacatcggtggaacattccaagagaaggggagccttgggccatccgatcagcgagccgacggcgctggagatgccctcgtgtcagagaagaaaaaaaaagtcgaggatgatgagcttgacctttcgtctggtcagaaggaggggtgcaaaaaggtggctaaaagtggagcaattagctaattaattaattaactgttagttttaggtcactcctatctcatgtgattaagggaaattcactgtgtatgtacagcaaataggctgcagtttttttcagtgatattgtttactggccatagttcacaaaaatgttattttgaattgaagtttgaaattataaacgcctttttcaagtgattaggtacttttgtgcaatgtctgtataatccttgtaattattggtgtgatatatcagaactaattcctagaaattaagctatgcgtataagatcttgctttgtgttaacgatttttcattacttcttaatacgattaaaacggattagagagacaagcctagagctgttagggcttgagcatataggattgcactctatccctaactggtcatggtcctcttgatgccactttccctaaaccataaaaggatgaggtaccagttcagctgtggaggaggttgtggagatgaattctcataatccacaagtaattaaaattggtaaaaatttgcgtggggataggtaccatttcatctttttttaatgaacaccatttcattcttattattgtgttgttctatatatggatggttgggttgaagttacatttgcaattaatatattagtcaaatcacttcacaatccaactcaatttatttataatagtagtttgtttgggaggtgatacatatataggtcattcaatataatctaaggtattttaatttgtttgaagcaatctagagggccggcccattcagctctacttttcatatataggtcattcaatataatctaagatagtctaaataagttttccgaaagggcaaatatgtcaaaattttcatatcatttaacctctgaaatctacacacacaaagaaacagtaaaaaataaaattattaccttcattttttaatagataacacgattgacttttaaaattattaccttcataattaaagtttctttaatgataagacagttcaaaacaaaataaatcaaatttattttttttaatacgacatatggtcaaacgtcatgtccaaagtcaacggtatcatctattaaaaaccggagagagtatttaatgtcaggtgaatttgaatatttattttctaaaattggtggtccggtaccatgcatgatgccccttttcattgtcctcttgcaaaaccacatcaaactaacaatttgatgatggtgtggatgaattttaatttagcactttggttttgctaatttcactagtacggtaacctccatagttgccggttgggaactggccttaggtgtcggtttcccaaccgacaccgatatattggcacctatgtccggtatatgtgccagttttggaatcgacaccgatagagattatacgtgccggttcttaccccacaaccgaaacctgtagtattcaatgtataaaaaaaaggagaaaatctattctataccactgagtttgttcgagttcaacaatttaccattgacattgtccctttttataatataccggcgattttatcaattgttctataatacaacattgggttgagccttctttccaaaaatacccaaaataacctttatctcactagaagtttcaaaaaaacataaaaacttttatgtggcctccttacacaacatggaaatttgtatagaacttttatgtggccaacataggaagatgcgcgtctggatcctcaccgcgatggtcgccaccgtgttcgccatcttcatcacgctcgccgttgccctcatctcccgccgcggcagacggcggcggtggagtgggggcggcggcgaggggaagaggagctcgccgcctcctcatcccccaccgccgccgcagcctccgcgtcacccgccgccgccgccgacccgtgagagagagagaggaagagtgagagagaagagagaggaatagtggaaaagaagtatgacaggtgggtcccacatttttttataaatagaatgctgactggactgccacgcgtacgccacgtagaccaaaaccactgcggattgggtcgaggggggtaatttatccggtttgcatagttgggggtgaagaatgtctggttttgtggtttagaggggtaatttggtcgaccgcgattgttgggggggggggtaattcgtactttttcctttcttttaacatatctgtgttatctcattcgtgactaactacaccatcaattccttaccatgtagcaaccattacatatgtttcattatcaacccaaagcacggctccgtggcagtccttgacccccttgattataatcacaagacatacaaacaatttccaacaatctgttattctgatactattgcatgtctaattattaatgcattacaattaaatctcctccttaatacgaaacggtaaaaaatccatactgtgcatacaactactacaagaagggtggagagcggattcaaacaagggagaagctgctagtacatacatattggccggtaatagtctacacagtttatgtattccaattattttactaattagaaaatttaactttttccttctatgatatgtcatcaagtatcacaagcaacctagaggctcggtcctctgtgggtattactcatgtgaattcctcagggttaatgggagatacagggttaacgcagaggatgtaagtctctcgactcaacgtataagtgcattggagaactgcacatctataacctactaatatatatattgtgcttctttcatgcatgcagcttcctagaatagaacatcgaataagcattgacgatacaactattacaaatgtgcagcgcgatctctgttacttcatccaccgtgagtgttttcatgtcaaaggacggttcttcgacctagagagtatcctggatacaagcgaagaatacaagaatcttccggagtggaacaacacgatgcgataatgcaactagatagtgtattcgaagtgacaatgttataaatattgtaacatcttgacgacacttttcacttatacaatatatttatatttgtcagtatcaaatgtttttctagttactaatattttttatgcataaattaattaattaattggaacattatttatcacaaattattattgtaaaatttttttttcaaattcttgtacctaattaaataggcggctctgtcaaattttcttagacgcactggtcctatcttcgcaggcggacgcctttagctctagtccgcctgggaaaataatcttcccaggcggacctcccgaccgtgttgatcttcgcaggtgttggggtccaggtggagcgggcatctgcctgggaaggccattttcccccgcctgggaaaatggtttttctagtagtgatagttaaaaaaggtgcacatgctttggaaagtgacttgagtttggacttgcgaataatagaacaagataagttgataaatgggaccatatatgttccgctcacatcctgttgcagcttgtgcacactgataggcgactagctaattggcgccggtgtttttggcccacaactaaactgaaggattctatagctaggagtccaggactaatatgcatgcaagtggtgaatgggatagaggaatatatattgttctgccaagcatatgaacagatatcacctttgtttttcgaaaacaaaattaaagaactttgtttgaaattgtttaccatacataactaagaaataagtagtgtgcacgagagggatatgctagggactgtgcacgacgttgatttgtcctaaactcagtaggggcaagtaagatgtctctaacagtgtagaggcaagagacaacgagtaagacatgaatgaaaaatgataaataagagatagatgtaggggtaatagattaattttaacgatttatggatggttcaaacatttctggaacttcgttaattaaacagagcctaattaatgcatttcctattaggctgtgatgtattagactcgaaaaacccaggcctctaagcaagtaaacacgaaaatacctaaattgtgatcaaatgtctcactatttcgaattaatacctgcagtcagatagcagttaattgcccattctgacctctgaacacaccagcctttacacgaagactttaaccctttccaaattttcttcaaatttattccaaatctaaagtaaggccaaatttggtcgtcacactaactagcagaagttcaaatcaagctaccatatccagcagtatataattaaagaagttcatctctaggaaaataaaatataatgaaacccatccttaagttagttctaaaatcatcttttttgcaatgtcattttttttggtgtttttcgtgcattttcattctttctgccacaaatatcgtatagcgtgatacatataaaccagatatcatcaaataaaaagatttttgcagacaaggctccctagtcccaataggttgcaggcaggtattaactgctcctgcatgaaaaaattactcccctcgggattggttatagggccgcctgcgaaatgcactatcacggacggccgcttaagaccattgcaggcctctgcgaaaatcgccgttgtcatcacaggcctaaaaccacgaatagcaggttgacaacggcggcggtagactatggcaagcacgatgacactagtggtggtggtctagggtagccgatttggtgttttgaaattattttcacaagcggtcggtataggtgaccacatgtctcacatgtggttacgctagctgcatgcaaaaaaatgggattttcgcatacacgtacacctggtgtaggtggaccgtctggtcatctgcgaaaatcgattttgatcttatgcaaaaattgattttgtagtattgattgttactcgtcataaaatttaggcaattatgtttgttttggtgacacttagcccgtctactacttaattggatcattatgttgtcgtatatgtttgcatgtacaaacagt

SEQ ID NO: 76189 - DNA, 8182 bp, Oryza sativa
ttcctgcagccccttgagtgaagatatgtgttgaatatgtccaagtagaaaacttgaaaattggagcaccactttttggtgtagtttagtgcggcgtcgaatctcgtggcaaatgtcgagatgttgaagttcttgtagacgtcgtggttggtgaagtaacaaactggtagcgaagacgcgtaattgtgaagattaaaacaccagtcatcggcggcataaccagtcggcgatggaagaagcagaatgatgacgaaaacgaagacgtccttgaacggcagcataataggcctgttgtgaaagcgaacacaacataggtggcggaggaggcaagccagcggtgaagacgatgtcgcccattgacggcggtgtgaccaaccagccgaggagacaaagccaccagtcgacggcgacgaaggcaagccgatggtgaagacgtaaatgcccatcaacggcggtgtgaccaactagccatgtaggcgaaaacaccagtcagcggcgacgaaggcaagccagcggtgaaaatgtagacgcccaacaacggtggtgtgaccaaccaactatgtaggcgcggcgatggcaagccagtggtgatgttctgaatgatccattcctgaagagtaggaaataagcttaaagccatgaatccctactatgcacatctggatttggatcctgtagaacaaacatgtaggatatgagtagtatctgatgtaaatatagtacttgaggaaaattcaagtatttaaaatgtttataaatatgtatttctcctcttgtcaattttaatttccctgagcagatgactccctacgtttaaacactctactcgactagtcatagcccccaagcaccgggaatcggccaaggcacttcccaaacatgcatatgagtggcatgagttcgtcattaatggaacaaagtttcacgggtctgaatttactacttgggtacttttgcaattgttaagagcagaaaataaattatcttatctctatacttttgatttcttccgagtaatatttagcacattgcgttatacactccatccaacgatcccccaggtgctagcaatcggcccaaaggcaactatccatcgacaaaccaaatggaaagcatagggaaaaagagctccataactcgataggcactttatttttactcggattattttgcaagcaatcaagataaatattatgaaaattattgaaaaaatatgatataacatctgtaacccccgactcactactcaatggagaaccaattgatatagtgaggcagaggaaaagaaaaatatcatataaggaataaatgatgacttagcttttagtattccccttggtaatgccagatgaagccgatgtgaggagaaagtcgtccatcaatgccaatgaaaacaccagtcggcggcgttgtcacgaccggaaataaccaacgggcgttccttacgtgcgtgtattattccttgtccaaggaggcaaggtacaccaaaagttgatacatttcagagtttatcaagcggaagcgtaaatagttactttattacatgggcggcgaaggcccagcacacacaaagacaaacgggaaacagcggaagactagggcgacgaccacaggcgcttgacggtaggcacgagctagacaccaaagacttcatcatccagtggctcctcttctgggtttgggaaaaattgagcaagactgagtacaaccaccgtactcaacaagacacacccataagtgcagaataaatgcaagggagtacaagggggttataatataaggggttagggtttgcagtaaacagcattaaaagacacttagttgctcaaagctattttgtaaatacggtcctagagctatacaatattattaatcaaggccgtgaacccacatgaacctgccttaacccaaggcctatgatgattcagatcgaactgcaacccgaccctgggtcccagcccgtcccaagccaacccaggccaaccattccacattttagttgttaagcaggttttaagaattaaaacactaacttgggtacattgctcggcttgtccataaccgagggcgcggctattcgaataggttatactctgatcagaggtgtacatctttacccacaagacacatcttcctcacgtgtaaccacgtgccacataccaccacggcatacggacggaagacatgacatagtttccaacccatcctagccatagacaagagtaccgacccaaccccacctacggccggaacccccgggacaggtaggcaggactgagcccctagcagcaggacaccggccctgtgccgtgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagttctttgcaatagaggcccgaagaccggtccttatatggccgagatgctactatcaaaaccatacaccccgagcccagcctaaaaccattttgaggattttgaatagagggggaggtgtgaatccaattccacaataatccatccattccatagtgtccaggtgatatgaatattcccaaattctagagttgtaaaaccacctaatgttacctaattaaccagcgaagcatctacctaaattcatactagtggtaccatgagtagagtgtccactagttggggttttgtttaatctagggtgaacaaggtaatattaacagtaacaatcataaggtcataacaaaggtaaataggcatggctagataaaacagtgataacgcgggaatttaagtaaagcgataatgcaataatttaaatcaaaataattttataaactgggattcaatatgttcaaggatgatgtgacttgccttgctcgctttcccaaacgtcggcttcaacctccacgaagagcggatcttccaaagctgcagcgtctacacgaccaacggaaaagaaaaggcttttactctaataaactccatataaaaagcaggaacaaagcacaaaaatgggttcttgacttcttaagaaaaaattagagacttgaacggtccaattccgagttcaaatggccaagttatggccatttgaagtttatatgctctttaaataaatatttgcgaatttcttcatttaaattttaatttaaaacgggtttattgcgtcagtcgagggggaggggcgcgcggaccgggtccacgggagtggggcccacgcggcagcctcacggtccacggtggaccgggtgcacccgggctcacaccggccggcgccgtgggtcccacgcgtcagccgcacccgagggcacgggcggctgacggccgggccccacgcggcagccactcggcgcgcccgagggcggccatgccggcacggtcggcgggagacggcgcgcccgcgccccgatggtcgccgccggcgaccaccggcgcggcggagcagcggccgagagaggggagggaagggggaaaggaggcgacggtccacggctcaccccggggcgacggcggcgacggaggaggcggccgaagcggagggaggcggtggcgcggctcgggtcgacggggacgacggcgctccggcggtcggcgaccgaaacggagaggtggacgaagtcggcgaggatgcggcgaagccgaaggaggcggcgcctaagtgggaagcggtcccgggcgaccgcggcggccgaccggaactcggcggcgactgcggaaaaagaaccacctggccaacttcaattccgcgaagaagaaaggccgctaaaagccgaacccgaccgaagagtgccgggagggtttaaataaggtttgaaaggggaaagaaccgcctgggaggaagaaaaccggcgcgggaggtcggccgccattaattgtcccggccagatttgcgggggccaatcttgccatttgaactcgagagagagagggaaaaaatgggggaaaagggagaggggatcacggggaatatttccccccactttattgcatgcggggacgacgggaggcggcgggattcgcggcggcggcggcgctagggcacgggcgaggcggcgggagcggcgggaggtcggggatgacgggtgggccccacccgtcagcgagggtggcgggcgggcccgcccgtcagcagcgcgcgcagggagaggctgagtgggccgcggggagaggagagagagagggggggtgggaggagagatgggccgggctggcccaagggagggaagggggacttttagggtttttctttttataaaactttttcaactttgtttatttcttaataattattatttgtgctctgaaaattccactaaaatttatttacacattttaggtttttaggaaatatacaaaaatcctctaagccttatttgacttttaactttgcacattttaattgttggaggctttcacatggattttaattattctaggcataatttaaaggatatattttagagtcgttttgggacgtgacaggcgttgacgacagccgatagtgaggacatggtcaccatcagcaatggcggcggaatacaccaaccgtgtggaggcgaagaaaccggtcggcggtgatgacggcgggcggcggtaaaggtgtagatgcccaacaatggtggtgtgacgaactaaccatgtaagcgaggaaactggttggcggcggtgaaggcagtcgatggtcaaagcgtagacgcccatcaatggcggtgtgactaaccaaccgtataggcgaggacaccaatcgacggcgacaaaggcaagccggcagtgaaagcaaatacgtccatcaacggtggtgtgaccatccaacggtatagacgaggacactagtcggcggtggcgaggcatgccggcggtgatgatgaagatgcctatcaatggtgctgtgaccaaccaaccatataggcgaggacagcagtcggcggcggtgaagaccaaccatgagtgcaaaggcaccagtcggcaataatagtgccgcggcattacattgaacaatagaaaatgccaagagattaatcttatatttagatatcaatatgataaatgatgctagattggaaggtaaaaactctggtgatgtcggcgttctaactcccgcgagcaaccagaaactccgtagaactcgggtgaccatgtgcacgacgatcgaaacgcggccgacgacagcgacaaacacggccgacgcggggatgagatcgccgcctagcatcatggaggcggccgccggccggtgagcacgtcgcccctggtggtacatgcaaaacaaacaacagaataatctaatttattagcaccgtagaaaacagatgcatatatagagatgggaaaatgctaagcatatgatttttttcttccgatttttgtacgatcaaacataacgacgcggacggtaggggaacctaacgcgagcgcacggcgcacgcacacgcggaaggagcgcttatgggcccgaaagcccaattaacctctttgcagcatctgacttgagattatatctatacttgagattatattagaataatctaccatgtagtattcaatctaactaaatttactgtctaatctgaagggaaaagaagatattttgggccttctgtctcatgactaaaagagtgcaatatgtttgaaagaagttctgcttcgtcaccatgtgacatcaattaatatgttgagcagcactatactttggctttaagtttgtctctaggaagtctctctgtatctaaacatatgcaaaccttgtttaacattggttcatatatatatatgaactttttctgcatccaattctgattgtggccattagattctacttccaactatggttgatgctatccaggaatcctaattggcgcgtacgcgccggcggcgcgcacgcgccagcccacacggcccaataggcggcaagacacggttagtttttcttttttccgaatttttctatatatgtgtaaacattcaacccagatttgaatactttcaacaccgacttgaaaactttcaactcatatttgaaaactttcaactcagatttaaaaattttcaactcaagattcaaaaactttcaactcaagatttgaaaactttcaaatcggatttgaaaactttcaagtacggatttaaaattttttaagttaagatttgaaaaatatgaaaactttcgactcagatttaaaaactttcatcccatatttgaaaactttcgactccgattcgaaaactttcgactcgagatttgaaaacttttaactcagatttaaaaattttcaactcaaaacatttttttaaaaaataagcgtgctaaagattaaaaaaagtaataaaaaagcgaaaaaaaagcgaaaaagaaaaacgaaaaaaaaatcgtgaaaaaaagaaaaagagggctgatgggcttatgggccgggagcagctggcgcgcgcgcgccagctagcaacccctgatgttatccatgtccaaggtgtaaggaacatatatgtatgagtaatttgcttcacctgccacataacaaatgagcgctaagtacaattactatataagatataattagaacgaaaattgcttaatatataattagaaagaagattgctttggttggctacgcaagcatgccaacgagagagcagactagcacgatagagcttgggctttggatatgggctcaacagggagcgatccgtttcatcgctaaaaaacattagaagttaggagagaaacgtttcatcgtacaaacgtcgtacaaaaacaatcgtatatatagcagtgctgataaacatgttagcagtatcaaagcacgaaggtgtatagatgagcatttatatatccgcagccatcacgcgggtgaatcgatctaatctgcttgcacacgaacggacttgctcctgcatcataaccagaagatctgaggaccatgcgagagcacaagtactgctagcacatggctgaacggccttgcggcggagatgacatcatgaagctgaacaggctgcccacggtggtccgtcagtgaaagctccaatctgcaccgatccgagaagcccgggtccgaccggcccccacgggtgaagattccggggtggattgcccccgcaggaaaatcgcagggagacaccggtgatgatcggcatggagatcgcgggcggcgcagcgtggttgatggctgttgcgttgccttttttctcctggtaggctgtgaccagcgatggccaccacaaatccgtcgtctcccgcgatattgcaaattggtttcatcgcacttctggataggaaactcgacgcactcctacctagcacgctaactgtcaaaactgtttggggatttgaatccgccggatgtagtattgatctgacgatctagttgtgaatcctttgccctagagggcctcctgcccacaatagagggcaggattataagataaaaaccttaaccaataggtatcggtttcttaaatctactttacaatattatcaaatcaggactttaggccgttctgttatatacaaggaaacgtaatacccaagtcatgatccatacatattccatagatataagttatcccctataactagttggataaccatgccgtgtgggtatggggtacccataatctccataatgtgacctagcaaagatcatttctccagtagtactagttaattagtacccaacgggcatgggcatgggcacgaggttttgcctaatagactttgcggacatgggttagacacgggtgcgtgggtctggggccgagcatggattcgctctgcccgtgcccgatccggtccattgtcatcctagtaaatacgttgctagctaagaaaggaggaaaaatacgtgggcttattggatgtatgtaggagtaaaaatgggatgggtacttcccgaggctcgcgagaggaatatgagagaaaaaattagatacccgattatccgagttcgaatctaaattcgttaaaaaatataggttaggatacaggaagacatgtatctgctcatatatcccatattataaaatatgtatgaaaatttattataaatccatctaaaaacatgataaaagattggttaatcattattttaagtgctcataggtaatattgtatattt

SEQ ID NO: 76190 - DNA, 79489 bp, Oryza sativa
ggaagccttggggtaattgatcaccacacagtgctgaataagttgagattcagaagactattctttacactaaaaccttgcatagatggttatcgagaaggttgcaggccatatgtagcaatagatagcacttttttgaccggcaagttcaaggacagctatcaactgcttgtgctgttgatgggcatactggatgtacccagtagcctttggagtgatggactcacagaccaatgaaaactacaaatggttcatggaaagactttagggatgctattgctaatacagaaggtctcacaatttgtacagatgcaaggaaaggagtacattctgcagtacataacatttttcgtgatgtagaacatagagaatgcatgctacatttggtgaataatttcaaaaagaggtttcatggaaaggtgtttgatgataacctctggcctgcagcatactcatataatccatattttttccagaagcacattgagaaaatggatgaagcaaagccagaggctatggcttatttaaggaaaaaccatgttaggctttggactagaagccaattctctgggcaatgcaaggttgattatgttacaaataatttggctgaatgtttcaatagctggatcaggccacataaaggattgcacttggtggatttcatggacaagattaggcacaagttaatggtgaagtggaacaggagaagatcaatttcaaaaaagctagaagggaatatactaccacacattatgaatgaattgaatgaaaagagcaggggtttgaaccatgaggttacaagaagtgatgatgcattagcagaggtggagtgcaagggaggaagtggccacaggttagtttttttttatgttcattgcaacttaattgccaagtttgtgcacttcctaagtataccatgtttgttcttttgttctggtggtaggtttgttgtcaatcttacagataggacatgtagctgtagagagtggcaggtttcaggcaaaccatgcacacatgctatagcttttatcacatccatccgaggctgcaaacttgagaattttgtagatgagtgctactctgttagtaggttccaaatggcttattcaaaagtaatccctcctttggttgacaaatctcaatggcccaatcctacccatgacttcttgcatccaccggttctaaaaaggtagcaggcaggccaaaaaggacaagatatagaggttgtagtgaaaagggcaacccaggaggagttaacaagggcaagcattagtgcccgttgtgtaagggttatggtcatcattggcatagttgcagagagggtgatcctgctgattaccaagcaatgctagctgaaaggtaacctttttaattgataataatgtgatatattttatgtttaccctcattgtaaattctgttatacaacctactactcgtttgcaggggacctccaaaaaaaaggcaaaagtctagtaatgcacatgctgaaactagcattgtacatgttcctagtgcatcttctgctcaaaatgcaatattgtctgcaacaatgacatatccaccaagcaaaagttgtcaaaccgggaaaaaaggacaggacctcagtaatacttcatcagggtcagttaggtatattagttccatctaccattgcaataatgacttcctcatatgcttacattttcctttaccatttatgtcaatgtcagatcaaggtcagtgacaggatccaaccaacctgaacctttgagtgtgttgatgccactagcagcgcctggagagaactctaaggccaaggctaagacagaccaaaactaaagccaagatagctcctaggaagaatacaaaggatagcgctgctactacgcctttggcacaagtcaaacaaaaaggcaacttcattcctgtgtctcctgatagtccagccatgagtacaaggagcaaaaagaaatctctaaattttaattagggatcctttttaattaacatgtgctcacatattttggtactgtgatctctggttgcacggtacttatgtagtactccagttaatctagcgttttggtactatggtgctgatgcattttagtcatgtatatggtgatggtactgtatgtggtgagatggcacttctatggcactgcaagacatgcatatgtgatggtactgtatgtggcacttaatgatagtgatgcattttggggttgtatgcaaatctgtgatgagagatgatgcactgtatgtgctgatttcaacatttatgtcatgaccatgttatttcagctgtatgtggcttttggtggaaaattggatttttcatgcttttgttacaaattcatatgtgatgatacattggtactgtacgtggaaaatcggatttttcatgcttttgttggaaattcatatgtgatggtactgaatgtggtgatgcaaaaattcatttttcagatccaacagctatattagcactaaaatgtacatacatatacatatcaaccaactttactttgtcatgcaaatatcttgccaaatttcacctaattgttataactggttctatagcaactagtaagggcaaatatgtcattctaacatcctattaacagtgatgagccggaggggtgacggcagtggcatatgagggtggacaatttcaaactagtggcatagagggaaaaagccaattttcagtggcatataagggacaaggctaatttggcatgcatatagagaattctccctaggatatataggtggccgcacgttggcgtcggatggttggccgcgggcgcgctgggcgtcgtcctcctgtctgtcccagtgtccccctctcgcgctcgccaacttgggcagttgggcgttgtttatcgcgaggcttccgtaccaggtgggcataaatctatacgccaacttggagcggccggtagaccacggctagctaggggggatgcatggagactccaaaagcgcggccaagttgcagttgcttgcttcccttcatctctgtccgtgcttggatggcaatgcctgcctgcctgcctgagctggctgcctcgtccactcgtacagtcacagtcatcgtcggaagctagccggtgatctctcaaatagtactagaagttgtacgccgtcgtagcaagtgcggactgcatgtggccgtggtgcggccgggagcagcgctcgtgcgtgacatgaattctgggcccttctgcttttggatgtgcagtatgcatgggggcgattataagcgcatcaagtgcactgtgatagtactgtagtacgactgtacgagagacccgactcctgaggattcttggccaaaactggtactaccacctgaatgcgcagtagcttgtttggaagctgaccgaggaaagagagggaaaaatcacgcgcctgtagttctgaaagttttgggaaagagatagattgaacagaagagagtacacaaacggagagttagcgtaatacacgagaactagcatacaaagtacatacggtctcgagagacgattgaacagaatttcccgtcatgcatgtacggacttggagtgtatatagctaatgctaaacttgccacttgaccagcttgtaccacaggagtacgtacatgctagtgtgctactgtcatcacatcggtcctagatgctcgctggtttgtgattctataaaccgtatctagctcaaacaaagccggccgctaaacacgcacgcgcgtatgtttaattaactagacagagtcacaagacaaggacagaagaccacgggttgcaagtaggagaagacctacttaaacaactcttccattattacaagcttataaatacgataacaacaggtgacgtacaactgagcaactgtcgatccaaatgcaacgaaccctgtgcgcattcgaggcaccgatcgatctcatcccctataacgcccggacccacccgggccccgatggctgatcgattaaccactagctggatcacccaaaccgtcggcgcggttgtgtatagtccgagcagcgcggcgccggtgtggtggtggtggtggtggccgactggccgcggtttcccaaatgcgcagcgcgcgaggggtcccgcacgcctcccgcgtccccgcatgaccgagcgcgcgcgcgcgtcatcgggacgagagagagacgacgtcgtcgtcgtcgcgcgcgcgggccagcgccccagccagttgccgcttacagtaagaggggggagtgtatagtacgatccacttgtcgtccacgtcgtccgcaccgcaccccatctcgctacccatcccccacccgcgcgcgcgcgcacggcgcacggcctccacacgccccggcccccgagaccgtatcacgagcgcgcgcgggcgtccagcttttctcccacgattccacgaagccaccaccaatatttccggtcgtccgatcccccctacccctctccgctgatcagtcgctcgctcgctcgctggctgactgcgcccgcgcccgctttgctgcgctcccccggcacgcgacgacgaaaagaccggcctcaaaagcgacaccacgcagcagacgcagcgcccccgcgcggagaagctagctaggtactcctgtctggttagctagctagctatagctagaagcctagcacatgaacccggcgccgtcgagggcgccgcagcggcagcagcgcggaggggagatgtcggcgcgctacggcggcgggctgcagttcttcgctgacgccccgccggcgggggtggaggggggcgccgcgaccgcgcggacgttcttcccggtgccgggcgggggaggggagcagcagccgccggagcgcgcgatgaggcagcagcactacggcggcggcgggagtggtgcggccgagatctcgctggggcacggccacggccacggcggcaagcaccatttccatcagttcggcgtcgaggcgaaggacggtggcggcggcggcgaccagtcggggtttctgacgcggcacaacagctcgcctcccgggttcttctcgagccccgtcatggacaacggttactgcactctctgctcacttaattacgtgtaccttcgatttgccgtcttgattcgtctcttccattactatcgagtttggaatgttccaattaaccaccgttcttctttctcttgactcattggagtattccaatttatttctctgtctttatttcttttttttcttcttttactgcgattttttttcttatggtgcgatgtttagtcaagtgtgatcttggttattttttctctcattttcttgatatttgagtgcttttgatgaatgtttctgggtctactgcacaggttacacgtacatcagcagctgtgcaatgtagtcatccaatacatttgcaacagcgccttcatttttctgttatatttacgccgcatgcatgttcattagcagccgcccaccgattagtgcaatattctttcgggggcagcaatattttactccattttatgttgaaaaaaaaggctgtatgatcgttttagtaagggtttagactacaaaacggatgttcgatgctaccaggtttgataaattaaaataaagttcactctatatatctgaaggtagaccggcgccataccctttttatttgccgcaggattttttttcgaggggaaatttgccgcaggcttaatttcgttactgtcgctctgtcgttcatctttgtgttcgttttcaaaataaactcaagtttaccatgaataaaatacttatttgaaaccccaagttccttttcggatcaaaataaattacctacctatgcaaagtgaaatatgatcgataaatcttttgtttgtgatgggttacttttgcaacaaaatcacaatatcgtaagcaaattacttcagcaaaaaatatgcaaatactatttttgtgtgtccggtctacaaacacacatgaagatatattgatatataatcaaagtttgtatataagtataggtgactttgtgtaccctaagaatttcactcattgaccaatattgagagtatagtctcctagctaatctgattctgcaatctgctgatttcaccaactatatccaaacttttgtcttcggtttgtttttgtttatatacgtgatatcttatgggttgctttcaaaccgggtggcttggaataattggatggaaaactacgggctgcacagttacggtggttttctggtgggggcaatgagaaatgggtgggtccttaggattgtataaccacatatgtacacatatgtacgcccacatgcttcttgcacatatttatttattccgaaatatttactaaactatctattttaacatgctattaatatttatttgttttgctgacagcctaacatcactaccatggacctagctactttcctcctctttggttttcaagccgttatacattgcctttacgcgtgtcctatcagccatccactagtttcagaactaacaggataagttgtccttatcttattagactctatttggtgtacgtgtagcatctacccttcactagatataaaactaataaattatacgtacaacttgtttataatgtccattatgcacccttcatatataaaactagtaaaactatgcgtacaccttgtttgaattgtgtacatctatcctatggggaaaagtgcgaagaccttttctaaatattattttttattattgtcctattgaacttcttgtccacttgtaacacatttggtctacattttaagagactatttcttctactcacctatcatttttatagcttctttcgtaataaacagcggcacttgaactaataggataacaacgtacagcctcatgtgtgaacatatacaacagtgtgttgaattatatgcaattcaagttaccttaatttccttatccttgaaaaagaacaaagtcgctttttcttagattttcccatgtctcaagttatgtctggccaagacgacggtaagctataacccgaagaaggttaatcgaattggtgccccacacgctgctatacggctgccgtgtgatgtatagactgattaaccaaggggctggacgacggttcttcgcttgatggtgtattatcgaacgcgcgtaattaagctagcttagctaggttaggcccgctaaccttacacatgaaattaagttctgtcatatcccgtctaggttcagttgatcgatctctctcgcgtgcagacatcagcgaaccaaagtagaggtgatgtcacctcctatatatacatgcgagcaccagacgacgacgatcgaggaataattcattctgggttcattctcactcgctggttgcctggctggggtgagtggaagagtgttgcacgcggcgccaaagccatcaacagtttgacatatctgtccatcgccgtgagatcgatcgtaaacggtaaacctggtctactactatactatacgatgggatccggtggcaacttggtagggatggaggtagaacaaaatagagaagggtatcactcgcttggtttactctactttatatcaagtttagactgatatgtatgcttgagtttaaattgagggggtgcacatacggtgaaaattgataaattatagatatttttttttaaccgggttcctagctaggcatccctctcctagttacctagctccacccctgcaacttggcatgttctatttaagaaactgcattttgataaaaaaaaatgtttcttgcacacttgcgaattgggagtactttgtgtgacaatggggggatatatatatatcgatcgtagattaaactacttgtgtgtgatcaccctccaccgtgcatgcgatgttcgacggcagtacgatttagctagaatgtctagcatgacacattagaatgtctttgatgaacatcacgcatgtgcaagttgattaattgcatacactataatattatattaatatggcacaatacatattacacttagaaagaactttcaattttcgtcctaatttttgccacacataactgaaaacaacaatttgcagtggaaaacgcaatgttttaacaaagacccaatcatatttctaatactattaacatcaaattgtgattatatatatatgattccgtggaaagaaaaatccataaaaaaataaaagaactgaacacaagcccagctagcaccttgaatttcaaaactaggcatgtagcctcttttactttgcaatactccatttgcataatctttggagtgatttgccaatcttcgatcgttgaatcgactatacatgacacacatgtaggcattgtgttggttcttagttgtctcaggagaaaaagggtacaatggagagagataatggaaaatatcttgtactatgtcactcagagcaagtataatagtgagctataagcttactatatacttaggtggaggaaagaggaagtaaaaaatcaagggtgttggctctcatgcaagagctaacttatcacaagctccaagataaatacattaaatatataagtgagagatagagagaagaagaaaattatagccaaacttatagttaatctactatatatattagttttaagataagctaatagtagaaagtgggctctactattattcttgctctcgggcatagccatcttaaagggttatgtagataatattgcaaagctcagagggccaggcgacaactggtttaaatgatcacacaatgcttacttcctaggaactatcaagttgggctcctttacgatgcaagttcttcatttgattggtaattaataacagatggttggcttcggatcggctagtctcttccacagccgagtgcatgccatctttgagatcaaagtgatgaaactatacaacacatacaattgtctctcgtgtcttttgcaagctgtgtgtacttcccttctcttggagatggggttgcgctggggttgcatctcagccaacgacagttcatttttcaggttggtggtgtgtaaagccatcaatgaagtttcaaaagagatgcgcaaaggactaaactcattgattattctagtagcataggagatttggaagaaccgtaacaattgtattttcaaagcttctctaaatgttttggtggtagcacgtgcagtggcaaatgacagtatttgtggtgtttagccggaaactcgagcgctctgtaagctttctttgtatgtaggtcaattaatttggacgactaatgatggctttctgggtaacgagtttatgtgagtgtggccattttaatttgttccttatgtttgtaattatttttcccttttttttatttttctcaatgaaacgaagcacaaacctcctttacttttgagaaagaaaagcttgaagtgttaaacatacttttttttttgcgggagtagtatatagagggtttttttttccattgtggaataagttgctgttgtgtttttcttacaacagtatcatcgtctacttcgaaccgtaagtgctactctctgatgaaccttgtgaaacggatttaaaacacatgcatgcatggaacaagttcatttcccagatgtgcggaccactgctgcatgtttagcatttccaaaaaaaaaaaaaaatctgcttagtcaccaactcacgatttatacatcttcttataacaatatttgtggatatagagatcggattaatgaaacatccattatctaaaaaacatcttcttatggcaataggtttctcatcgagtgctagaccagcaggatcatcactcggtgaggttcgccatggcgccatgagcagcagcagcaacaacaacaagaagatgaaggccccactgagcttcgctagcagcaggcagggctccggcggcctctcccagatatccgaggacggcatcccggacctcactgacagcatccatggcgccgctcatcatcatgggcgctccgaggagaacgtctccacccacgaccacgtcgtccgctccttctcctccggtgggttctcgatcgggtcatgggaggactccaactccatcgtgttctccacgtcgacgggcaaatcaggagcgcacggcaacgacgacatcatcgccacccttagcaactacgaatctcaggtgtatatatatatgcgttttatctttatttttcatttttcgtatttatagtttgatttattagtgtgtgtgtgtacaatgtgagggatgatttcatgtctaatttgtatatacatgcatctgcgatgcagcttgttgcgcccagggagatggctggcgtagagaaatacctgcagatgcagcacgaccaggtgccattcagagtacgggccaagcgtggatgcgcgacgcacccacggagcatcgcagagagggtatgtatagacgacattttcccttgctaattctacgccccatcatagtaccaactttttatgtacgtacgtagcgggtcgaactatatactgtaatgtcaactagcatggaagcgtatcctagatacatagacctttaacgtgtatagtatgcaccgtacatcaaattaacaaatatcataaaaaaattagaaaaaaaatcaatatacatgtatttttagtattatatttacacataaagtcatgtcttcaaattcattacatagatagagcaacaaaaatgataaaattctgatatacttattgtcttaaaactataaaaaaattgttacacctatgatataacaaatttgaggttaagattttacacaaaggtgtagcatttttgaaattataatatgtattttttaaagaattttttgtgatatttgtttgttggtgtgtatagaatttgcatgcgaaacttgtgtgcacatgatatgttaccaaataagaatattgataacctttcaagatgttcttcatatgcatgcatctagccagtagcattcttgttgttcctccttggatcgtgcatgccagattaatcttcaggcatatgatcgatcgatgatgacaggagagaagaacgaggatcagcgagaagctcaggaagttgcaggccctggtgcccaacatggacaaggtgtgtgccatacgtgtgttcttttcatgtatataccagtccttgtctgaactttttcgtcagacaacaatcttcaggttattgagttggagttcaattgatgatctttctaatttgttcttcttacaaattaatgtggcagcaaacgagtacttcagacatgctggacttagcagttgatcacatcaagggactgcagagccagctgcaggtataatgacgtatgcgtgttactaatttgcatgttcagaatggcaaaactgaattgaagccactgctgcctaaagaagcctgataggtcgatgtaccagtccagttacaaagacccccgttagcatcagaatatatatagctagatggaataccaatatattgcactgtaaaacagcagctcagtatgagtaatcaagtatccctccatttcaaaataaatcaacttctattacaaacatagacatagctaaaagttgatttattttgggacggatatgagggagtaacatatatatatatatatatatatatatatataaaagcacaacgcaacccggaaacaacactgagtttttccctgtgtgcagactctgaaggaagacaaggagaaatgcacctgcagctgcaagcaagcatcaaggaacagaccagccgactaaaatgggatgtgaagcaaattgcagtgctggctagtttgatgacatttctccttggtcctcaaaacatgtttgcctggcgacaggaaattaaaggtatagcaggcagcatatagcgtgacaagagcaaagtaatggaggtcatcagtctcttccaaacgaaaggtcgaagtcgtctgatcaaacctttaccagtgaatcgatcagtccagtcttttttcttttgtcagtgtgaccaaccccttttgttgagctgtaaaattaattgaaactagactagaattgttccttcctttaacaaggagctctgctgctctggatgttaggcttctagctgtcctgttgctgtggtaaatagtgattggttcacccagcggttagcaaataatctggttgctggtttcagggtattctccggccaacattagacaagattcagtgatgtgttatgattcatacagatcattagacattatccagaaaatttacagtgttggtccggggtagcaacatgcatgggtccttggaaaggacgatttaccactctggctggccgttctgtgctggtccagtcggttctcttctccattccagtccatgaatctatggcgatcggcctcccagtctgggttattaaggccattgacaataagcgtcgcgccttcctgtggacaggtacggactcagcccatggtgggcagtgtcaggtgttttggacgaatgtttgtcgctccaaaaccggtggtgagttggggatcactgacctcaggttggcagggtttgccctacgtgttcgctggctttggcttcagcgctcagggcacccctactaggatggcctaaaggccccagtctagcagaccgtctccgacatgttcgcggcatccactttctttgtgccgggaaatggtgagtctatgctcttctcatctgaccaatggatcgacggccgctcggtggcgtccttggctccagatctcctcttcgtcgttccccaacgtttttgaggttcacgcacagttgcttctgccctagcgaacaactcctgggtctctgatattcgaggtgccctcactatcccagtcatctcccattttctccttatttgggatgcggtgcttcacgtacaactctcgccaggtgtcgaggattgtctcatttggcgctggacagctgaccagcgctactctgcgcgttcggcataccaggcattcttctatggccagcattcctttgcctgtgctgatcttttttggcatgcaaagggtcctgccaaatgcaggttctttctttggtttgcattccagcggcgctgctggacggctgatctcatccagaagcgtggcatcgatagtcacttgggctgccccttttgcgttcaggatcttgacacggcgaaccacatcctcttcgactgcatgttcgctcggtaggtctggcttcgagtattgtcgcctcctggctgggctgccctctctccccccgtgacagctggttccaagactggtggtcgtccttcagggcctgcttacctgagcacctctacgacagcttcgactccctagtgttcctggtctcttggcgtctgtggaaggagcggaattctagggttttcgactccgctctctcttcgatctcagtggttctagagttcatccattcggaggggcatatgtggtctttagctggcgtcgtcgcttttggggatttgttgggagtctagtgtggcttggccccttcccgctgcttggagtctgttttcagccaccatagtttctctaagcttcagtttttttttcttttgctttttcttcctttccctagcattagccggtctggctgattgcgtagagtaactagaactctttttcttctaatatattgacgtgcaatacttttgcgtgttcacgaaaaaaaactgaaatttgccggaacataacatagcgctattggagtcccgaaattgctttctctttgaatttaatccagaacgtagcgtaaattgattcagaacgcgcatgtattgcagtcccaaaaaatgttcaaattttttgttcaacatacttccgtacacatgtatggagatcccaaaattggtatacattttttgaaaataaacttgtattgctgttccaaaattgttcagaatcccaaaaaaaaaatgttgcccaaaattgtacagacgtatgaaggtcccaaaattgtccacattttattttaaagaaataaacttgtattggagtcccattttttgacaataaacttgtattagaggcccaaaattattcaaagatacacttctttttgaaaaaaaatgaataaacttgtattggagtccaaaaaattcattattgaaatataaacttgtgttgggtcccaatattgttcaaaaatccagtttttttccagacttgtattggactgcagaaattattaaaagaaactaaacttctattggggctacgaaatatttcaaaaataaaatccagtttttgataaaatcagaaaaataaattgaaatagctcaaaaccctacttttcaaacttgtattggacttcaaaaaatattttagaaaacaaaatttctattggagtaatgaaattgttcgaatattgcagtttttgagagaaaatcagaaaaataaattgaaatagttcaaaaccctacttttcaaacttgtattattgttaaaaaaatgcagattttgagattttttttaaaaaaattaaatattgctggctgtggggttcgaacccacgcgcacttcagtgcagaagatcttaagtcttcccccttaaccactcgggcaaaccagctgatacgttaattttcgcagcattacggtatttataatcaggccacaaactaacagacaccgtaatcgccagcaaaacctgcaccccgtttctgtactcagccgaagcgcagccatatgtctcacaggaaaacaccatccgtgctctgctccattgctggcccgatcaccccagccagagctcgatctggcaaagaacgaaccaacatttgagccacgcgcgcgcgcggattcactcgccgccctaaatttgcccgacccgcgttcgacgacgacgaggacgacgagaatagtagcgccacgccaaccgccaagcctatgctttggcatggccatacgctattattcggcggctctggacaaattaagccaccgtttttcctcttctccccgtgttatctccacctcctcccgcccccctcgtgcctctcccaaaacaaatcaatttccttcctcccgaccgagcaagggggcgaaaggacgagctacggaccgagccatggaggaattcaaggctcgctccttcgtcgccttgtctccctcgggtacgagtacggacgaacgatctcccgccatatatgattattcctcagcttattcagtagtaacattatggttaatctctgttcttgagttagagtctttttaggcgaacggtgcaaatttgttttctacgttgacattttagctagctgatgttgctctgcctaatttcttttccttccgactctctgcgtctgccttctttgacaccggtggccttcatgtagtatttgaattttttgtgcgagattttatattacatatgtccaaacattagtgttgattacaccatgctacgcaaaagaaagccaggccaccataatagcagcaaaacagaattctacagagtatgcagctacagcccttttctaaaacatattctcatttggtttgcgtcagcataagcgatactgtttatatcttccaattcaactagttttgttcaagcagttcacagtaggttagtattcaatttatttcagtttacacgttgccagcatgtttagcatcagcaattcagcatgaggccttgaacggccagtggatctgggcttggatcgatatcggccgcaatgccgcgttgccaccgggaagcacgcagcccaacctgatgattttttttttgactaaatcaccggcaggggggggagtccccacctgaatatattaagccaaatgagcttacacagggcaggcttcacctatagaaacgcagaagccctggaggataggagaacagaatacacggggaatacaaagaggagagaacagagaaaggaaaacctcctaaaatataacaattgacaaacgacatctacaaaattacccggccaaaaccaaaacctaaagctaacaccctagcttatcaacatccatttcctcacgcagccacaagcatgccggaatagaagaaaggccaaagaaaggttgtagaagtcctaggccacccgcatgaagtcatcaagaagctaacttgatcttattgttgtttggatcaaagcccgccgacgccctctgggggaaggaagccccagaagagggagggcactgaaagatgtggccgaaggccacccacaatgagttttcttcaatcaaactttatcgagttgcttgttagatcaacacactccaacgtccttcaagggaaggaagcctaaaaggagggagaaacgctgaaaggtcttggacggtctcaaggaagggggtgaagatgagcaggagttagacaaaaggaaaatggctaagggggggaattcactgatgaaagatcatcaaccgcaacctcagcggagggcacagagcagaggccagccaaggtgctagaggagcacaaatcccagaacaaacatctggaccaattgtcaagagcaagctgaaaatgagaagattttgaacggggaataacaccagcaaaccaaagaacaatggaataggcccaggtttggagcggggagggaagaaggcacaatatcgagggcactagggagaaggggaagaggtttgttgcaaccaaggggacgtgtcggcagccaaaacgcgcgtaggaggacgtccgggcttccgaagccagcccctccacgcacaaccccggccggcggcggctggagggtagagctacgtcgccggccctcgtagctccacgtgtgccgtcccagacccaacgctgcacgcatggacaacctgtggggggggggacggggacaacgggggaaggagcccgccatcgctaggcgccgccagctgggggcaccgggcccagcccacaccgccggcaccagggggaggggggcgcgacgatgaggatgctgagccgaggccctccgtggtcacatggagctgcaacggcgagggtgccgcaccgcggagagaacccgtcgccgtcgccaagggtccgacgaggtccagccgcgaggacagcggatccaaccgccgccagccggaagcgccgggctcggcctccaccgcctgccaaatccctccgccgccaacctgatgatgggttgataaatctccaaagcgatcccttttaggactccttgccagtggtagcatttccaaattatgcattttggtccctatttaacgccgtgtttaattccaaaataattcttcaaactttcaacttttccatcacattaaaacattcctacacacaaactttcaacttttctgtcacatcgttccaatttcaactaaacttccaatttttgtgtgaactaaacatttaggactgctagcaatgttgttagcggtctgaaaatttccatctaagtccctacgcctttgaattgtatcgcccagcccccactctctcccctctgccaatgccaattcactcgctgtctctagaggcagcccacactgcacccatgccccttccgttgttctcctccactggaatctaggcccccaaacggcttcgccatggcttattgtctcagcgaccgcgcgaaagttgggggtttgggcagttggttgtttgcgattttcactgttcgccgtccatggtgccatggcaatggcagcccgccaccttagcttgaggatggcatcacttggggcgttgatcacggtacgtatgtttgccctccgttggatctggtacaaccaaacaccgctcgacgtccctcaccaccaaaagtcagtgcaaatgagcccttctagtttttgaattcacgaattgataagtatcactatatttggtcttggatttgtggataagtatcaagtcagggatgtccggcgatgaacttactaacaacatcctgtaaaccaatacaaggtatatcatcctgtaaacaatataaccaagtctcttagctatgtaaaggaaaaaatgttggttcagttgaatttcatggcatactttttttctttatttttttgtgactttacatgtcctttaacatgtggtttgattatgccatgccatgcagaataatccctgcggtcgcaacattagtaagaaaataatgtgcacaaaattcattcttgatcaattgatttactatagctatgttttccagggggaaactagttgtcctaacgtatgtttagttgttcgaatgataaaatttgcacttttagttattattccatcttcactttactatgtgttggccccctttttgggttaaggttatcaatcacatctagaggttaaaactctatctattggctccatttgctccttttctagatgtgccaaactgccaataagagcagtgcatggacttttggttcttcatttactgttggggtgtgtgttttgaattgcatgtcaaggtttcatcatttgatttgtgcttcgttgctaatatgctttatttctggctatatgatcaatgtaatttattatataaaggattgtaatttttttatttattaaatgatctttattttttttatagtgataagatatgtaacttatgcactttgcatgtttcaggtgaaatttcatcaatataggaaaatagattataccatcagtttttgcacacggtgagaaatttaaaccctttatttctaatgggggttacttcagttcatgcatgaacacataatgcactatcttgattccgcagcacatacttgaagttgttcatcttgggttgaaagaaaaaggtcaaaccgattgtattaattttgcagcaagccaacaaactaattgactggtggctatgctaatccttagcttaattgaggttttttagtctggttttggttggttccggcggaaccgtggatgatcgcccttgccacatacttgtgccgaaactattctcttctaggactaataacttcttcattctatgacttctcttatttctcagcggatgaaatttgactaggagaggcaccatggagaaagtcgaggtcgatgggaacttcattggtacgggtaattggaaggtaattcacctgacctcatttcactaaaagctaattgttctacaatgttaatatgattaattatgttgatctgagatcattttataatgtagggaactttcagaacaatactattgagtttttgtgatacttgtgtacatattatatagtcaccctttaaaagcaaaggcaaatgcctcctgtaaaagtataaatatcacaatactaccactagttcaacaaaaagttagaagaaatcataacatagttgcatcatatatatatgataattttttatatatgaagatatttgatctcataaagttaccaattattagttggtaaattgtgataaataatagatctcatccaccttctttctttctttttaattttctttagctccgctgtttgatatcataattttgccccccccccccctctttggggaggaatgatttctatttattaataatgtgagtattaggatggtagattaagctggtttgttcctacctctttgtgcagctgcatggagcactatgtaagcaacttcacaaagtagttcttgaagtattggatgttattcctgtccttgaagctacaaggcctggaaacagttctggacttcttgcattgagttccttgcgcatagctgttgagaaggccaagaatctacttcagtattgctcagagtgcagcaagctatacttggtatgcagttttcataagtgcaaacatatttatgtttcctagttttgagaaataaaaatgtgtgaaatatggatacatgtctttgtgctactgtatataattgatggtacttggatatgtttcatcgtatatggatatcaagtactgccaaatttatttgttattatagaaatacaaaatttcatacttacacatcctaactgcatgcaggcctttacagcagaaaatgtcctggcaaaatttgagaaagcaagatatgcgcttctggaaagtcttcaccaattggaagaaacacttccagaagcagccagttctcaggttgccactggttatacaagaatttgtccttgccggctctgtcttaaatagatacctataaaatattgcggaaggatccttctttatcagtgttatatagtttactaaattaatgaatgagtttgacgtattgcagctttcaccctaattgtaatcgcatgatttaatttaaccttttcctctaattcacacttatttgggaaattttcagatactagatatcgcaaaagatctggagaaagcagtttttaccttggatctgattgaaaagcaagctggtgtggatgtgaatcaattagttcagaatgaggcaaaatccaatggctttcttcatgacaatgaacttgaatttttccgacaaactgcatttcgggtcggcgttgcgtcatcggcaacagctcttaccgagagaagagcacttagaaggcttcttgagagggctcatgcagaggaagacataaagaaagaatcagttgcatcttatctactgcacctaatgaggaaatactcaagcatttttaggagcgaaacgacggatttcaccaacacatccatgtgctcaagcccttcttgctcttcccgttcattgtccagctcgattgatctccatggaaatggtcatgttattgaaaagtcgatatctagggttggctccttcaatctcaggcagatcaaaggcttatcaggtagcatgccattgccacctgaggaactaaggtgcccgatctccttgcaactcatgcatgaccctgttattatcgcatctggtcagacatatgagcgggcttgcattgagaaatggtttagcagcggcaacacaacctgcccaaagactcggaatgaattatcccagctctccatgacgcccaactattgcatcaagggtttgatagcttcatggtgcgagcagaacggggttctagttccatcggcgccgcctgattctcccaagctcaagtacctgaggatatcatccttgaatagtagcaaatgtcttgtgaccaatggcgttagcacggtcttgtttgaagacacatgcgcggaggatgatattaaggatggtggtaaagttgcttcggaggagtgcactcggcagaactccggagaggctccatctgagatatgtgaagttgatcaggcctcaccagaaaaacatcctcatgagaactccgagaaggtagcagaggcgacatgtgagctttggctgcgtgtgctgagcaaggacgacgatgagtgtgtcgacgagcaacgtgaggtgatcgagcagattagattccttttgaaggatgacaacgagcttaggaaatacgcgggtgctaatggtattaccgagctactcatccactttgtgaagaaggcagtctgcagagatgatgttcagtgccaggtggttggaacaatggctctgttcaaccttgctgtcagcaatgataggtaaaatgtcacgtatgctttgttccttctaacgatgttgttacaatagtttattacacgtacaacttgcagtaacactctataggtagatgatttaattgatcttagttgccatcatctcacattttccacctctgcatttgattttccaggaacaagaaacaacttctctcaggtggagtcctccccttgatggagcagatgatacagaagcctgaaacctacgaggctgccgtcgcaatgtacctgaacatttcctgcctcgccgaggcgcaggcgatcatcgggcagagcgaggccgcgcctctcctgatcaagggcctgcaaggagacggcttccggatgagcaagacctgctgcctcgacgctctcctgacgctgtacaacctgtcgctgcaatcgtcaaacatcccgaccctcatctcctccggcatcatgcagagcctccacgacgtcctgacgccgtcctccccgacgacggagaaggccctggccgtgctgatcaacttggcgctgacccgcgccggcaagaaggagatcatggccgactcggacatggtgggcgccatcgtcgtcatcctcgagaacggggaccccgccgagaaggagaaggccgtgtcgtgcctgtggatcatctgcagcggcgatgacggcggcagccagatggtgctccaggaaggcgtgatcccggcgctggtgtccctgacggccaacggcacgggcaagacgaaggataaggcgcagaggctgctcctgctgttccgcgggaagcggcagcgggaggtcgagcagctgcagccaagggtgcagctgcacgaggtggtgagccaggcaaccgcgcagcacgagcagcagcagcagcagcaacaagaagaaagcagcgagccaggcagcgacaagatgtcgcggctgcgcaattcaaagtcgaagttgagaaggttcacgagggccctggctaggttgctcaagaaatggggcatccgctgatctgatctactacagaggaaagaaccacgtcggctagtgtgaactttggcaaatgcaatatcaatgttatcttcccgtgtgggttgactcactcgttttcgtctccttcgcattgccgcgatatccatactcgtctcacttatgcgggcattgaccgtctctctgtacctattaaccttgtgctaaggcaaaattagtaaaaagggtttaagcttattgtgttttgccaaaatgtaagccaagatgtgttaacaaggattaagtgcgatcatcaaagtgtgtaacaaggattaattcaggtcataaatctaattatataatacgtaacccaaattaaagatttttaagaaaacccaaattaaagatttttaagaaaagaataggaaacccattttattgaggtcgttttagcctaattctatttggaacatacttcatctgtcaaaaaaaaaaaaccaaatccttactaaacatagggtatgttcaaatacataatcatgatttctttttttttcggatttgctatacaactggcgacagttaacagggggtgaaaactttcaaattttaagctgtctaatatgctttgagatttgtgctagtgagggaaaacagcttaaaaaattcaggggtgaaaactttcaaattttaagctgtctaatatgctttgagatttgtgctagtgagggaaaacggcttaaaaaattcacacgcgtgcagtagggatcaaacccaacacctccaacttggaggcttgttcacctaaccagttctcccatcgggctattttgagttacacttgagttacatattagttatatagtagttatatagtagttacaatgtaattacatagtagtcatatttgaaagtttttcatcccaaaaactgtcgacagttgtatagctactcccgtttttttcgagacgggagtagtcgcgtacgtgtgcgttcgttccaagcacactttctgtttttttaaagaaaaatctttggaaatgttgctttaaaaatattatattaatctattttttaaattttaaataattaatatttaactaataaattataagctaatgacttatctcgttttttatatactacctccgttttttaatagatgacgccattgactttttctcacatgtttgaccattcgtcttattcaaaaattttatgcaaatgtataagatataaatcacacttaaagtactataagtgataaaacaactcataacaaaataaattataattatgtaaatttttcgaataagacgaatggtcaaacatgtgagaaaaagtcaacggcgtcatctattaaaaaccggagggagtatttaatcttctctctcggacaaacagtgcaccctggtatttgagcggaaattcgcatgaaccaaattgtgggccgtatgcacgccaagtctggctgaccagttgggccttggcccgtggagtacaatactaaaaaaaaaggtcaaaactgcgtgcgaagcctgtgggttttgacctcaagcctcctcggcgactagtccacgcctcccactcccagtccacttctcttccttccttccttccccaccggctccgatccgaaggacgaaccccgcacaagacaacaagtaaatccccatccatagctatccaagagccccaaatcagatgctctctcctgccaccaccttctcctcctcctcctcctcctcgtcgccgtcgcgcgcccacgctcgcgctcccacccgcttcgcggtcgcagcatccgcgcgcgccgcacggttccgccccgcgcgcgccatggccgcctccgacgacccccgcggcgggaggtccgtcgccgtcgtcggcgccggcgtcaggtgggtggggagccgcgcgcgctctccgtgggttcagttctgccctaggtttggggtgccgtgtgcgtgtgagtggggaggttgttttttttgatgattgatgaaatggttgcctctctgcagtgggctcgcggcggcgtacaggctgaggaagcgcggcgtgcaggtgacggtgttcgaggcggccgacagggcgggtgggaagatacggaccaactccgagggcgggttcatctgggacgaaggggccaacaccatggtgagcgcgctttggtgtgcctcgctgcttctgtttgatcacaatctcgggctgtgttggtctgcattgctgcaaatgctgcttctgtatgttttggattgtggcgcactggcgctgctgcggctatttgagggctggagcacactagcgagtagtgctccttggtgcgcaggctgaggaaacttgtgtttgtgaacgaaatgcaagctgctcactaatgcagacagttgttcctgcaaatggagaagtgttttcttctgcattcgtatcccacaacagacgtgaaccctttctgctatgagcatcattgaacaccgttatgtaacttatcatagcctgattcgatttcattcaccatgatctataactattatacttaccatattagttactttgtactactcttagtaaaataaataaattattttaatactccactgacaaaataggttaagattgtttcattgcttgggcacatgtgcaatactagtcgcattttttttacctgcgtgcaaatcttatcatgcctgcttgattcaatttgccgttctctctgtaatttaattattttgcctccagacagagagtgaattggaggcaagcaggcttattgacgatcttggcctacaaggcaaacagcagtatgtatgtgctaatgttatctgtgatggttaactgctttgaatgtcttctgtttcataatttacactgatatgtttaatatttcgatatcctttagcctaactcacaacacaagcgttacattgtcaaagatggagcaccaacactggtaaatagacttttcatgatatgatgcattttgttttgttcttcctatagtatgcctcacttttgaatatatttttttgtcacataagattccctcagatcccattgcgctcatgaaaagcactgttctttctacaaaatcaaaggtatgtaagttattgagtgctaattgctacaacatatcatgacctcctgacctatttgcaacaagttgcttgttgtttccacttgtcactgatggattaaaattcactagtgtagaaacaatcatattaaactgatcaccgtgacttgatttacttgttttcagttcactattacaaatttgtacatttcctgatctttcgtgttcaagctgtgtgatcgactgattgcaaccgtcatattatattactgtattgagtttagtaaaacatggtcttatctttgcagctcaagctatttctggaaccatttctctatgagaaatctagcagaaggacctcgggaaaagtgtctgatgaacatttaagtgagaggtgagccttcatactgatgttattttgagttgttgtaaacttgaaccactgataatatagttatatgtttttttcctgtgttcttccttcattctcatgcccttgtgaaatacaaatatatacttcatatcacacactccctttggtcatttttcatgtcaaacttttaaaactttgtacataaaatcagttcaatatttagattgaacgcatgagaaagtattttcataatattatgattttaccatttttttcatatacgttgcaacagaatttagtggtcaaagctacactttgaagaccttattgatgtcaaaaacagcatgttttctgaccagagagaatacatttgcagtgtgatttttctgtgtatatgtagagataatcaggtttctcttttgcagtgttgcaagtttctttgaacgccactttggaaaagaggcaagttcatttttaatgaagaaatttatggattgttaagtgaatacaatcaacactttgcaacttacatgcccattataatcagtagagggtaagaatttataactttattacaggttgttgattatcttattgatccatttgtggctggaacaagcggaggagatcctgagtcattatcagtaagttattataacatgtctcactatttgcattttccatatcagcacctttgcatttctacagtaaattgtagtcataattatttttatgtaaattgtgcgtataaacaacatatgtgcttgactttgtgatgtgttcttggggatgataactgatacggctagaacttttgggggctaatctccttgagccgtatcagtaagtcataacaattctcattcataatgatcaaaacatatcaccttcttgtgtagaactgttctggttttgagtaatattttcttctgtgcagattcgtcatgcatttccagcattatggaatttggagaataagtaagtttgtagtagtttgtttggagaataagtaagtttgtagtttgtgcattgatgttcattcaagatttaccttatcaataattcacttgtccacgtccatatgctcgtgctatatcctgtccattcaaatgtcaacaccgccatgtgaatttactgcatagtgcattttaatgatttcatttatccttgttgcttgcatctcttttttgggctcctgctgttagcttgtttttggttcctgctgttacctatttcttttctatcattttttcattggacagatggtgctctcagtccttactgcttattatttgttaacctgatatgcacctacttgaagttaatgttatgatttttagtattttatagtcatggtatcattaatacttatttttggcaatcgaaattaaaaaaacatgatgtcaaaataaaaaatcatggcagttgaatgcagtgggtatatgtatcaagaatttaagatcttgaacataagtccaattgctatatgttcaattcgttggagcataacatgatctaatttgtaagttaaatttatctgataaacgatggaaggaaattctggtaccactcatgcaactatacaagcttcaaaggcttcttacatgtggaccattggacctagaatagaatctaaatttattcataagtatataattttttttccttcatgggccatgatagttaactatatgagcttgtagagtcaaaataggcataattgcttctttgggtttccacttaatttaccctacaacacttctattgcaataaatatggtcaacaacatttctttacggtccgtttggttggagggagtttttaggagggattgggagtttagagggatggagctattaactgttttgtttggttgggagagatgggaattttggtgggatggagatggggaattgaggaaggaactccctccttttcaatacctgggtagggggtggtaattgggagggaattcctcctttactttgcctaaacaaatctcagccatccgttttcattaatgacctaatctccaactaaacttcctgtcaatttccaccacctctgccaaacaagatattgggattaaaaatcaaattcccatcttaatctcaccatcaattccctcgtgtaaactcccaatccccttccctcaagttgccaaacaagccattagtgcccagttatgttctttggtcatcttcttcataatttgttgctccatgcactttcaatgctcacaggtatggctctgtcattgctggtgccatcttgtccaaactatccactaagggtgattcagtgaagacaggaggtgcttcgccagggaaaggaaggaataaacgtgtgtcattttcatttcatggtggaatgcaggtactccacagatgtcctgtagtttcttttgtcagtgtcaaagatatcaaagacagtgataaaccctgaactttagtttgagcaattctacatgccactaaaaaatgccgaattcatatgttgtgaattgaagacctgttattttcctgcaactaggacatatgtttagtcggtgaaacttcattgctgctttaagaagtcttacaggccagagaaaactgtcttgttttttttttttttgatttgatgtcctgctttatatttatgatccagccaagcttatccatccatctgcaccctgatcctgccataatcattttttttatcagcctgacatgagcttattatgttgcataagttaggttgaagctagatcgaacaaaaaactcaaagctactgataagtacaggatatgcaacagaagtatcacacgagccaaatctgctataagaataaaacataccaagagccttagacaccactaaatagtgtgaatggtagtgatagcgaataatctcagaagatgacattttgggaaatattatcgtgtagtatactttattaattgggagttgcgatacttgccctgcacgctaaacatgctgaaaagtttcacagttatactacataacatctgggtgtgtaaaggttttatgttgttcattgcttttcagtcactaatagatgcacttcacaatgaagttggagatggtaacgtgaagcttggtacagaagtgttgtcattggcatgttgctgtgatggagtctcttcttctggtggttggtcaatttctgttgattcaaaagatgctaaagggaaagatctcagaaagaaccaatctttcgatgctgttataatgactgtaagaaaaaaattatctgtattcatctctttagaagcttgatcatttgacagccacaaattaaaatattttaccgtgtttttctttttgcccctttaggctccattgtctaatgtccagaggatgaagtttacaaaaggtggagttccctttgtgctagactttcttcctaaggtcaggttagaatcactcttttagatttaacaaatgcagtgttgcactagcatgttcttgagaaatttgtgctgggggaaattcctcttaatccttcaaattgcatttaatttcatccattaggtcgatggatccatgtcacagaaaatattttgtttatcttctagatttctattatatatgtaagactgtctcttagtttgtgaatttacaggagtcaatcatcactcccttgaatctgagcatatcagcagttcatcagcaatatggtttatttgagaaggcaacggaaactattgtttccaaaggccacttgtttgaaactttcaccactgttttgaacagtgtattaaagtaacagtcatttgtatagcagcacctggtgatttttaagtaaattttccattcccaatcaaaacaagtaacattatatgttgaacatgtactgaattgaatatggaactttatgctggagatgccagactttattttactggcatgaatacacaattattgtaacaatggtattattgcttggttacttctccgctgtgaagacatacctttcgtcaccttttcttgtttcccatattctgcaccttatgggattgtcttccacatgttaagatgccttgtagtaccagttcccctattatttgaatgtgttcttccttagatatatgtgcatttggaacgtgattggaaatacaacagcaaactggtattgttagctgcttgcctgccacagcctacatatgctgccatattacagaattatgagataggtggactttgatttctgtcataatgattaactaacttgatatactcaaactatgcagctcctagctggtatccttagaatttatcgagtatgcatagaagtctactcttaatccatatctatttgatgtactcaaacttgaaactatgcagctcctagctgggctccttagaattatcaagtatgcatagaaatcttaatccatatttatttattatatgcaggtcgattatctaccactatctctcatggtaacagcttttaagaaggaagatgtcaaaaaaccattggaaggatttggtgccttgataccctataaggaacagcaaaagcatggtctcaaaacccttggtaggttaattcagctttacacttatattttatccagcttgtagctgcttatattttgatttgcgaattaaaaattattaaaacagccttgaaagaagaaaccatgttcgctgtggagactagaaattcccacattaattggggaaagagaaatatttacaccctatgattttggcaagtgcaagttttaatggttgagattgatggattgaatatatatcatatttggactcagtatgaacaaataccagatacataaatagatagtactaattcaacatggatctgaactgttgatcagaccaattgagcacttggttgtaattgctcgcggactacacgcttactgcctgactagggttccatgatgataaggttcgattttctaaaatactattacaacaagatgactatttaataaaatttaaagagaataacgtatataaaaatttagataaatttggtgcaccgcgcaattgcgcaggtcaccctgctagctgtattgaactcaatatacaaatcaaccttgctacattgctctactttttctcaggtcttatttactctgatttctatttattctaatctatacatgtcgtcttgtacagggaccctcttctcctcgatgatgtttccagatcgagctcctaatgatcaatatctatatacatctttcattggggggagccataatagagacctcgctggggctccaacgtatacttccatattatgatcatttatgttttggttgttttttcttttcttgctagatttttctgatatatatacttatgtagggctattctgaaacaacttgtgacctctgacctaagaaagctcttgggtgttgagggacaacctacttttgtgaagtaagtgataagaaactactgccatggtttagagtatctatatgttttctcttgttgtgcttgtgttatggttttccatcactatggagttttgaggattcattcaggtttttgcactaccacttgcgaattcaatatgatgttcttttacacaggcatgtacattggagaaatgcttttcctttatatggccagaattatgatctggtactggaagctatagcaaaaatggagaacaatcttccagggttcttttacgcaggcaagtcaatgaaggcacccctattgtacaaaagaaatcttagatatttgaaacatattcctgttgattgagtacgtgaataatttgctgtttctagtaagtcaatttggtatttctcatgcaacttatggggctccttgatttgctgagaatgatgagtttcctagagcaagccaggaactgtaatcccagcatgtaatactttaccttgaaattaacttcaaaaaaataattgaagctttttctgtatctgtaggaaataacaaggatgggttggctgttggaaatgttatagcttcaggaagcaaggctgctgaccttgtgatctcttatcttgaatcttgcacagatcaggacaattagcatttaaggtatctgaccttaagcaatttcagacaaatttgctcactttatgtaaattgaaaaggttcacatgatttccagtttcatatttttctcttgctatagtatatccactcatgtaaagatgggaacatagtcctaaaagacattatggtcgcttgagatgctcatgtttttttgaacagtgattcttgacttgtactattttttgacaaccaaataaatttctcaatgtttccgagaatatggcatgtacaatttgacctgttggttcttttagcagtacaatttctcgtattgcttgaggcttaagacttttgttatctcacaatcttagacgtccccttatcattattattcctgtatagcttttacgtagtactctatcatataccctctgaacagtagtcatctcatccttgccttactgaccagattgtataattttttccctgccattgtcgtttgtgaagtaaaacatacatcttctacatccagttgacatcaatagccatttctgactgactttggtggtgtctcatcaatccatctgggataggcaagagaggtcttccttgtcatgatacatctttattagtactagtcatatactacatgttactattactatatcactactagctttaggccatagataaccacttgtagccacagtttgacaccccaattaaccaaaggtcgaaaaggtcagttcagcttgcaaacaacactgggtctttggagaatccaggtaaagatatacttgtacgatatgcgtgctccactggctgtgtgcattattatgatgtagtctcttttatctttggtgtcctttttgaagtctagagtactccataattaccatgggccacacaggattatatgatgcttgaagcttggttttggtccatgtatatgcacaataggtacatcatttatctaatttttgagagagatgttcatatcaaagtgcaaccgaccagttcaatcagaaaaagaacacattcgagacaaggtttgcagtagtgcaaccacctaaaaggaggagacagagagtgagagatgagtgggaatgataggagacattggggcaaatattttgtcgtctgaaatgatatttgcttgagcttggtgtaaggaaaaaaaaggaggggcatttgcttagccttgggaactttagggcacaagcaaacatgagtagggtactccttgaggctttatgtccttcgttgcacttttctttttgggcacacccttcctagtattgtatgagcatggcggtcactggccataaaggagctactccataggaaagccaaaggcaggcattgcccttgtttattttctccatgtctgaaggactggaatggatggaccttatccatggggagaatgaagcttctggtgtgttttgtacttgtgttgcttgtctgaaactgaagctatgcattttagtttgcattgcgacttcctttggttccttgaatcacaaaatcctgcttgtgtttgacatttaaacattacaaagataaacatgctgcttttataagcttattcatactcattctcacccaatgccgtcctcggcctgggttttggtcaagtgccaaatggttccttctctgttgtgatacatattgtaagcaaaagcacgaagcatcatagaagtacttaaaagtaatcttgcgtacgaagcctatgtttttatttatccaggcaaattttgattagctcaatggcaatgaccaagaacagcttaggtctcagaggctagcgcctgcctagcaacaaacgggtctcgacaggagttgagcttggtggctaaccatttcgaacatggctagttggagaggacaagcaatgcctatcagttataatatcaagctacacatgacttgaattggttagtgaacacatcatcaccgtcctatatatcccaaaaatgtactatgtgtgattatgtgcatgaatatcctcagccccaagctccttgtggcacatggctacaagtaatgtagcctcccaaaaaatgcacaacaccccagctaaaaccctagaaaacggcagctaggatcgatgctctattgcctagagagtagtagctacctagccatcttgccaatgacaaggagataaggcctttgaactgtttgttgcacacataataattgggtatgtgctcgaggactagcagttcttgttatatgtatctgcgagcaatttgttggtatatgcatggtttggttgtttttggactgaagcatcctcgactccttgtacaggtttctcactgttatcccctcttgctcctgtctagacagtgcgctgaaatgtgcatatgcatctcttggtcgcacgtgtagtcctatcaatcctgcctgcttgcaatccaatatatatgcgctgccaatattttcatccagttgaaaaaccatactccatgtatttcatacaacagtagtacaaggtatcttgaaagaaaatgtgagattgttagggtatgatgtttttttattaaaaaaatggagaagaaagaaaagtatagtcatgctagcatttggtatgcttggctggaaaggatccaataaataaataataacgatacgccaagtacctgcagcttaaaacactggattttcccaacaattggaccgatttctcagtcagccttaagcctgccctttcaacgttgcttcctcgaagattcggaccgtatctatcgatcgtgcacctaatgcaactatgcggtcgtggcagattaacaaactgtaaatgctacctgatagccgctgcaacatgtcaaaatgcatggatgcagtcatgctcatgatgattcgatccacccatgagctagctagctaaggattttggcctaatacacatgaataccacttgacttaacagaaaaatttgagtagctaaagcacgcaatccatgcattggccacacctattatgcatttcttttttgctctaaccattcatcactacattgttaatactatttttatttatccgtgcaagcacttgaacaattctcgtaaatcacggccttccaattggagacccagtaatcgatcgttgaatgctgcgtgactccggacacaagcaagcagacgattatgatccttcccctagcaagagttgactcgtgccagtttctgccacgctgcaaaaaaacctgcacaaaatcacccttctgttccatcacataatctgcactccttttttcactttctactgactctccgtactcggcagttactagtactactaccatagtgtgtgtgcattgctgagtggcgacctatcatctcttccatttcacacaaaaccaaggaaacagagcaaccaaccagatcgaaatacgtgatgaattgcctagacactcgacagcctttctccctttatttttttccccttttcttttcgtttcctcttttctttttcctctcgttggtatagcacacttgtatgtgttgatcttggtcaggaagagaggccgagaaaatcttcaccggaaaagaagcagagagaaagcgaaagggtaaaaaaaaaaaaaagaaagaaagaagttgcgccatgcacggatcgaccagatgggttaccggtacggcgcagccagcgcttgtctcctagctctcacactatttgcatgcacgttcctcctcagattgtgatctctaaccacgtagagtactacggagtactaatttagttactcctactaaacaagtggccggcacttgatgctacattaacactccagcttactacgcatcaatgcacgagtataatagagatcagtacagtataaaatgcagctatacaagtatttggttcgatcgggcaaagggcgagctctccgaggcttgtttttttggggcgcctcgatacacccttgccgtcgccatgccgtcgaacaccggcaagtgcgtgtatggagtacttgacaagttgacaactgcaagtaggtcgtgtagtttcccatcggaaacgacaaaggcaaaatggcctagctgtacgtacgtagagccagacacgtaggagtaatgtatagctagatcagcacacatggcaactgggtgccattttactactcgacctgtaattaaccggcccgggttacacttccacctgagaaatgcaggcaccgtgttggtgtgcattatttcaactttgctgatgagcaaaacgctctaaattcagagtagcaaacgaagttggtgtcaactgtcaagaacaaagagaccgaagaagaaagaaaaatgtcagcaggagtacacgacgagagagagtaaagtggtttttttaattaagaaatgtattttatctctgtttctgttagtatatttttttaaactagtaaacggtgtgttttgtgaaagctttcaaatataaaagttattttaaaacttagttaatcgtgtgtaaatgactttcttatttttttttcatgtcctaacatgaagtttatcttcgttagaccagaacaccaactaaagcaaactgtctccatggagaaaacagccaaaggagcaaccagagaggggagcagcgaacgcaggcatgatcacgagatgtgggagtacgtacatacttacacgtaccgccgctacgacaacatcaccatatcctttctcctgccaactccatccgctgcagaggcgacccgttcctagcttcctcggcaccggcttgactccttctcgctccctcgatcgatctcctggactctggatggaccacctgcacggccaggccggatgcagatagcgcagcagggcagggcaggcagcccggtggtaaggattgcaaaaaacagagggcgaccgttcggctccggcacgtagtactcccccggcccgcgttacagccacgggaaagcacgtagagcagcagcagcagcctgcattcactcatacgggatcggctctggtagcgatcaatctgacgcatcggcaggcgaaacccatactacgctccaggctctccagagatcgatctgggtggtaaatcagccgggctccagagagcctgtagtggccggagtaaacgagcgagaaatacgtgctggtactactggtagtataggtggggtaaaaggtgagcgagacgagtgaatgagtgggtgctactagtagtacgactgtgtaactgtccgtatgtatatctactagggagtaatttttccctttttttgataaattgaccctttttaaaaacttaattcgaaactaacccctgccaaacacttcaaccaaaactaggccgtcggctcagcgccaagcgcattggcgctgaggttggccgtgtcagcgccaacgggactggcgctgacattgtgccaccgtggcagccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggcggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcggtgtcatgtcacataaatttatgttagacttgaatggagagatcgaatggcaaacatatatagatatagtattggggtcacatttcaaatctcttgaggtgtttgcatggaagaaagatggtaggatagggaagaaagaacttatagaccttaatgaaagtccactcatagaatcacccattagctgtcacgaactgtcggagaggtgtagtagaaaggaagaattgattgaggaagacgtggaggggggcgagggagtaaatgatatggcggatgtggaggtcagggaagagaatgacccagtaagggaggaagtacatgcagaggagaatgtgccgttaagtgggctggcgctgagtgtcccacggtcagcgccattatggctggcgctgaggtcccagcccgcaagccatccagaaggcttgctggtctgggccttgggggttgcggccaagtcccacctcagcgccagtccggttggcgctgaggtagctgccacatcagctggggatcggcccggccgccacggtggcacaatgtcagcgccagtcccgttggcgctgacacagccaacgtcagcgccaatgtgtttggcgctgaggcgacggcctatttttggttgaagtttttggcaggggttagtttcgaaataagttttccaaaagggtcaatttgtcaaaaaaacgggtaatttttacctgagcatagtagagcaagtctaataatacagccgacctgctggctataaggttttttatagttttctcttagcttatccaaataatagtagctctttataactaatacaaggtccacttgtcactctcaaagtttattggttcttgtgtttaagccgactgtaaatttatagcctgcttcttcttctctctcctccatctcaacatttagcctatttatagcctactattatactctctccgtcctataatataagagattttgactttttacttgcactgtttgactactcgtcttattaaaaaaatgtgtgcaaatataaaaaacgaaaagttatgtttaaagtactttggataataaagtaagtcataaataaaataaataataattccaaaattttttgaataagacgaatggtcaaaaagtgcaagaaaaaaagtcaaaatcccttatactccctccatccctaaatgtttgacgccgttgacttttttaaacatgtttgaccattcgtcttattcaaaaaatttaagtaattattaattcttttctatcatttgattcattattaaatatacttttagatatacatatagttttacatatttcacaaaattttttgaataaaacgaatagtcaaacatatttagaaaagtcaacggcctcaaacatttagagaaggagggagtattatggggcggagggagtatacattgtaaaactgtaaaaccggcgtgacgggaggaggacagacacgcggcagcttttgtggcgacaagtgtgtttgttttcttttctgaaatcccagcgaaggcggcggcactcgcgccatgccagcgggagcaaagcagcgcggagtgcggggaaagagcgatcgacagacaatattgtgaggccccttcccctagccttgcgccggcggcagcgccggcaccggctttttttatcgggcgccacgtcgaccgcgactgccaagccacgtatagtaatgtactgcatctcctcgtccccgcgacgcgaatcgctcgtgcgccgcgcgcggtgcggagcgggcgggcggcccgcccgccgcctcacgttttcgcgtggttgcgctgcgtcgcgccgtgatttgctaggccgtgtgcgagtggtgtggtcgcggcgcccggcgcgcatggtggattcaaccgagagccgctgagccggggaggcgccgagccgtgaggtgaggagagagtgatggatatcacgccaacgccatcacgcccggcccaccatactaggggaggggcccacgcacccctccacgtatgcacgcacccccttttagagcaggtacaatagcaggctataagccagctgcaaacatattttaaagagataaatgaatagagagaagggcaacaagctacaaatatatagccagctgtagcacggactccaagacacagtgtgtgtatgatagatgggactatgtattaatagtgtagtatgtaactattgtataaatgagctattagactggctatagttgaattgaagatagtagttggctgtactattgaacttgctcttaccccaccggagcagcagcacatccccgcttacaggtgggccccccgtatttgcacctttcagtttcacccacgcggtaactctaccgtgccggcttcctgttgttgttgctcgccgagagcgaccgagtccccacctatatattgctccgtcccgtcgcgccttgccgcttcaagtttcccaaggaaaaagctcagagtcgcagccgcacagggagatcgcggagcgaataggggggagagagagtggaggaggaggagaggttgttgcccttcgagaagctctcctagggatggcagtgctgctgcggccggcggcggcgatcgccggcgggcggcaggtgtggccggtggcggaggaccaccaccggcagctgcgggacgaggcggaggcggaggccgcgtcgcagcggctggtggaggcggtggcgcgcggggacgcgagggaggccggggagctgctcgcgtccggccgcgcggacgtgaactacgccggggtggtgtggctcaaggcgcggcgggtggcggaggccgcgctgcgggacggcgccgccgctgagctgcgggcggcgcacgaggagatccgcgccgacgtgtcgccgctcttcctcgccgccggcaacggggacgccgcgctcgtccgtgcgctgcttgtgagtgccctcccctgtttcctgctctgttctacaacttcgccgcattactatgctctgttcgtcgcatgttgaatgctctcgtttggtgcggtttgaatgcttagccattctcgtttttgtgcattcgaactgaatacgtcgcattccccccataaaattagcgtctggtgtcggtggcgaaatggcataaaatttgcagagctcgagcacatttaccatcaatttagttctcggaaggaagcactgaacactcatgcttctcgaaattcacttaacactagtttcatttctcctgaagcattcgagttggtggaaaccttggacgacatttcaaatgggcctagcgggcactgccaagtgccatctccacacccaataggtgctagataaaagttgcccactgttcagtctaatgatctcttttttttttcatggttgctcaggtagtagtattgtttttctatgtgcccatgatgattttaatgtactgtataaatgcacgcgctagacaaatatcatccttttttaaaaagttttatcgccatttttaataagcccaaattatgagtagaagtaggacttgttggaaagaaaaaataagtatacttccaaacttcgctaacttttattgtcgctctctatgatattggaacttcttttcatttttttggtgggaaaccataacggaaaaagttactcatcatgagatattttccaaagttttagaccgaattatgtgcttctttagcaaagtttttttttataggcattagcaaaatatttttatgaacttgtatttttacagttatactactattagtttctagaaggtaagttaccaagtaccagccccgcatggctgcaaatctgcaatgggaccatgctttgcattgcagatttgcagttcgtttttaatgcgtacggacatatttgttctatataccgatgataaaaatctggaattgggacaagcaaataggcagggaagcttcctgggcactctttattgtctagaaatacgtgtacgcattgatcaaggtgtacacgcatacatacggtatagtatgcctgtattttagtaccagtaccatcaaaagcatctcctattagcaaatgtggtttccaagcatttcctataagcaaatgtaccatcaaaatgcatttcctataagcaaggatacgatgctgtgcgcgcatttcctattggcgaatgtggtttccaagcatttcctataagcaaatataccatcaaacgcatttcctataagcaaggatacgatactgtgcgcaagtaccctgctaaagattctgatttccagtaacttctccctgctgcttccagcatcatgcatgctgcgactagaaggtaagcctaattatatacactgcgtgagtgagagtgtttttagctcgagaggactggtgcttgggggacaggggtagatgggtttgactttacctgaccaaagcctctttgtttactgctgctgataatataatgaatcattcctttagcaaaattgataatgtaatgaatctgtgtaagcatcagagggcactggtgttaagtactcctccatagtgtaccgggcttaagtacttaagtaccagctcaacgctttggtagaaaccaatatattcccctcgtgagcttggtcgggggtgggatcacgtgatctgcttggctctgctcttccggtctcccctcgtttgatctctcctgttgatgcaggagtacttactcccggtaatcttgagagtgtagttacgctttggtgctggatcctatggtactttgcattgggccctgtcaccctaatcacactcacgactcattcaaccccctcggggtcccacatgcccgtcactcttgtgatcctgatcgcgtcaccgcgatcggacggctaggggtactttctgaccatcggagaagtagtgttggtggatgatggctgacgagtggagaggtgtggtgcgcggaccgggtgatccgccgatgtcatggggcagcattgaattgaatgggagtggcaagggactaggggagtggtttgcgctgcgacggggcgtaggggagcagccgggcacggccatgcgtgtacttcttcttcttgtttttttttttgccttgcaggcagatgagctcgcacgggccacggccatgagggcctctgtacgactgtaccggcgcgttccatggcctctgcaaaagatcaataaatgccattgccaaggacggcagccaccatagccgtggcttttatcccaaaacgcataggaggtgaaaatgtggaggatctttttttttcacagaggaaaaaaggattgaagaacccgtttggtgagcatgaaatgcatgcatgcatgtcatgctagctgtccatcactaatcattgctccatgcactctctgatcttcattttgcggggcctcctcttcttcttggaacgtcaccctgactcccacaggccacagactgtggaatcagccatgaactgctcatcaataatcacctctcaatgcactctttgttctgcattttgcggggtcttccatcctcttttctgcattttgcgccggggtcttccatcctctacactggaatatctccctgtctacccacagtccatagactgaactgactccgagagtccgaggtcaggtggccatccaaaggccagcgtcgctcggcagctcagctcatgtcatgtctcccgggctctggccatgcgcaacatcatcagtgagttcacatgttctgcacctgggtacacagccaagtaaccggatccgatgtccgccgcttccaatacgtccaagccgcaccagctgtatttgatcacgccttagaaatgaaaaacccaactcctcaccggagtatagccccgatctggccgcggcctcctccacggcaggcagcgccaagggcctccctattaactgacagcaacgcgcacgtcgccgcccaggtgcgacgcatcgatgtgtgcccccacaccggcgcctgatcgatcggctgggccgacgcgggtacggatggatggctgctccttcgctcgctctcctcgcgcaccccgtatgtgtggacggtgtcgtgttcttctttgccctgtagccatctgcttcccctgccaccggccggccgcgcggccagctgtatcctcccttgctgctgcacgcacctggcgcccatgcaacgcacagcgcctctcgcgtacggcccgtgggggcttcgccgatcgggcatctgcgtatgccggccgctgctcagccccgcgtgtgctcatggcctgatggcccccggtggaatattgatggtggcatggggatgccagtgtgccacgtaagtgctgtttgagaacatcacctcggttcagagttttcagagtggtaaatagcagcatgcacagcactgtactcgtggtggtgcgacgaatttattgtgtgatgagaatcctggatgtggaattgaatgcgtctcttgtcttgttgtccgatggatcttgataaaatgccaagggttggttaagcaggagtttacaatttgtatgatgtgtcctgatggtgggatcatcagaatcagaatgtaggagtagcaaggaccaaaggactagcatcttttatttctgagcctgcattgttcatttcttgctccatttgtctttccgtgaacttcattttctctaagagcaaatgttcaaggatgggtagttaaatattcttatatatgatgttgaaagagataaatggttccagtttagataattttcagttagctgtggccaactactgtattcagcgaggctgagctgacattgcggtgaaaccacacatcaagatttcatatatcgatggatagcatcaccctgcagaattttgaccagattccttcttccagtaggaggccccttctgtctcttgctatatgaatcatggcacagtgccattgccacaggacttgcacagactggctagccagtccattggttaccaagtctccacatcaccgacctgaccagacatagtagtaacagcgacatttgttactcggccagctatgtttccaagtcccgatggctgttgttgtgccctgttctgtgctactgtgttggtccatcctgatggtaccccttatcccgcggtgtgtggagcaatgtaggtgaaagagagagcatgcggtaaaaggagaaactgtactaggcatatcagttcttgtttgctgagttactgtccaaaatctgagaaaattgtttgatcaacttgtgctaacattatcgttttggctatgttcatatcattacaagcagaaacttgtgtctagagcaaccagaagtacattctttagcacagtctaatgtttggcgcaaatgtgcatcgctcctgcaggcgaagggggcggacgtgaacggcaaggtgttccgtgggtacccggcgacggccgcggcgcgggaggggcgcgcggaggtggcggcgttgctggtgcgcgccggggcgtcgcagccggcgtgcgaggaggccgtcgtggaggcggcgctgcaggggcaggccgccctcgccgtcatcttcatgggctccgacctcgtccgccctcgcgtcgctgtgcacgcgctcgtgtcggccgccgcccgcggcttcgtggacgtggtggactcgctcatcaaggtaagtgtgtactttgctccatggcttcatagccttcatgcatctgtagagacatcgttctcgttccatgagattgcgcgattaaagatgtgcaggacgatttgatccccgatagcgagcgttgcgggtggtgttgtactgttttgcagagtccagatgctgtcgagcccagtgtgcctagtcacatgggccgtggcccatagggagaagcagatagccgtgttgtggtttagtcccacctcgcttattcttgctcgtttgcactggtttataagacgaagcggtaacccatctagcgtgttcgtagaaaggagagacggttggcatctcccctgacagggacgggaacagtcttcggactttcctctagcacattgcggttaaggctacccgcttcggcggatcttacccaaatttttttgcatccgtgcccttcaattttttttccatttgcacttgggtccttcaaacatactacttttgcacttcgtagttcgtacacggtacacctgtggcattcacatgttttacatttgcatctgggttctttaacttgtacacctgtgcccttctcccttcatatgtttcacatttgcaattcgtttagagtacaattgtgccggcgttcttgcttgaattagtacacgactaaattgctgcagctaatatcgtctgatcttttcgcagtgtggagctgacccaaatgctacttctcgggtgctcctgcgctctctgaagccttctctgcatgccaatgtcgactgcacggcactcttcgccgcgatcgtcagccggcaaatcgccgtcgttcgtcagctacttcaggtatgcaccactccactggtggcgggctggcagcacacgcacttgctcttcagcagccggagctatactaacaccatcttttgatctcatgtccaggccggagtaaagagggacaccaaggtgaggctgggagcgtggtcatgggacacggccaccggcgaggagctgcgcgtcggcgccggcctcgcggacccctacgacgcggtctggtgcgccgtggagtactacgagtccaccggcgccatcctccgcatgctcctccagaacgggtactcgtcgggcgccacccatctcggccggaatctcctccaccacgccgtcctctgcggcagcgccggcgcggtgcagacgctgctggcgtccggcgtggaccacgaggtggccgtgaagacgtccaggagctccaggtccaggcctgttcacatggccgcgcgcctcggccagccggagatcctggagatgctgataggcaagggatgcgacgtgaacgcgagggcggagggcggcgacgttgcggccatactcgccgcgcgccacaagcgcgaggattgcctgaggatcctcgtgtccgccggagcggacgtcgcgctgttgaactcggccggcgagtccgcggcttccgtcgcttgttccgggggctggaaggccggcttcgagcgcgccgttcttggcgtgattcggtccgggacgatccctcggtcgagcgaccggaacgtgttctcgccgatgatgttcacggcgcgctgcggtgacgccgccgcgatggaagttctcctggcccagccagacgtggacgtcgacgagcaggacgtggacgggtgctccccgataatggccgcggccaaggagggcaacgtcgacgccttccgcgcgctcgtgttcgccggcgccaacgtgaagctgagcaacaagcgcggcgagacggccatcgggctggcgcagcagagcaagaagagggacctgttcgagcaggtcatgctcgagttcgcgctggagaagggcatgccggggggcttctacgcgctccactgcgcgtcccggcgcggcgacaccgcggcggtgcgccacctggcgagcgcgggctgcgacgtcaacatcccggacggcgacggctacaccccgctcatgctggcggcgagggaagggcacgcggccgtgtgcgagctcctcatctcctacggcgcgcggtgcgacacccggaccccgcgcggcgagacggcgctctccctggcgagggccaccgcggcgttcaacaaggccgaggacgtgatcatggacgagctgggccgccagctcgtcctcgggggcgcccacgtcaagaagcacaccaagtgcgggcgcggcaagccgcacggcaagtccctgcggatggtcgccgcggcgggcgtgctccggtggggcgggtcggggcggcgcaacgtggtgtgccgggaggccgagctcggtggcagctcggcgttccagctgcaccggcagaggcggggctgcgacgcgtacgagcccgggctgttccgcgtggcgacggcgacggggagggaggtgcacttcgtgtgccagggcggcgaggaggaggcggagctgtgggtgaggggcatccgggcggtgaccagggcggtgtacggcaagagagggaaggagtgagacgcccctgtgttttgttgctccccgtaggctttggtagttcgcagcgagcgtgcctgtaaagagtaggggcgtagagggagtgggagaccgcgaagagtgtagtgggtgtgcccagctgctggccttcagctcgaaggctgggttgggtacttgggttggcttgccatgatgtctttttggttcaggggcctggagtttgtatagcctttggtggttgtttgcttggctaaagttgttttagctgactgcttgtagttgctttccctctgaaatatcagtatcatttccaaaatttcacggtgcgtctcaccactttatctactgagaattggacatatagaacatataagcactgtcaatgtgattgatcaccccaagaaaggatagaagaaattctaatgatttaaggtaaacaaactcatcaatgcgcagttgcacacattagggtaaactcattctcgattcgtgaattcatgagtgccttgcaaccgaatcaatgttttgtcacaagctgggcaggccgcccttggtatcacactgtttcgaatttctaacatcatagttagaacgggcacaaacaaaaaagatatatcttcccggctgctgcagaattgcaacccgtgaactcgttggcatcaaagttgtgtaagtaaaagaaaaaacttctgccagattaacgtcctcagtttccagagatttccttctccttagccttgcacatatcatctgctgactttatgaacttcttggtcaattcttcaacctggtacataacaggtacatgtttgttaccatgtggacttctttatttccaggacaccaaaattcagttactcacctccttctcaagtcgttttacatcatccttcggcataccagacgcagatttctttatcgtatcaagtgcctagaaacaaagaataatacagaattcagatatagtacaatgcatcatctactccatcagcattgatgcacctaatccaattatgatatgatagtccaagaataagtgtttattctacataatgtaggatgttgaagaaactatatttggtgtcaacaatcagaagctataggaaattctatcttcagaactctacaatgagagttgaaccgattttataagataaatagatcagatgaaccttaactactcaatctaaacttgttaaagtaaagtaatacttcccattttaatggatggcaaaatgctatagagaagagggtatacaataatacaccaaaaattatgttgcaccacacttgtctattagatgtcaatttcaaatggaaataaatatctgtggttgtattaacaaaatgtatgcctcacacctagaaatgccaactaaaggcttgaaaacattaatcaactaaaaattctgaacatagcataatagtaatccagatccaccacaagttatcgttttattaccttttggcgcgctcgtctaatactttgtttgaaatcctcggcagatttagtgacaaccttacacagtgcctatattgtggatgcagaaaataatcagcatttcagctatataaaagaagttcaagtttagaatctcacctgtatattctcctttgtcaacctgggagtgcacaaaaatcaaattagcaaaagaaagaaaatttaagagtagaggaatatgcatatcatatactggaaacagaagaaaagtgctactgaatattaagtccagcaattttttgggccatagttaaccaacagattaatcgttgaaccatttctacgagtacaaaatgaccatggaaattaactacattctcacatgctggtctacaagatccaagttgctgatttatcaggtggtcagcactcagcagaacatcactagcatggttgataagaaacaatccaacagcaatacatgtggagtagaaaaccacaataaataatagttagaaacagtataggcgtcacttacggtgggatgtttgctatgatcctgttgccatcaggtgttggattgatgcccaatggagatgagatgatcgcatgctcaatagacttcattgactacacgagtatactagaacaagtcaaaggaagccccaacagaaacctaagtacaaacagcgatccaatgtaacgctgttcctccagagagaaaacatataataaacacatttgtacgaaggctagtatattggacttctgtataacttgtgattaaaatgacaacgaccaagcatgatattttgagaaaattagtcacaatcctctacatataaaatatggataaaaaagaagtgacaacaaaatctattggtttgtcaaagcaacaattaaggaagcaagaaaaactcttacactcggatcataaggcatcactgatagggtatgtgcatcaaggacagaaacaacggccaagcgattcaacgcaaccttaacacctgtagtctccaccatgatgtgatcaagcatacctgcagaagaaattcgtcgcatcttctgttcaagagatagaactatccgaagaaacaatgacatggtaaagattgagattacgacgatacggtaccaggagaagctcttcccgttcgcaatttactaagctcccgtgacaatgcaacaacggctgcctccatctgctgagttgcagcagatttgacagtcggtccaatgtcaggagcatcctgaactgtatcgcctcgaccatcatcctctaatcacatacaacaaaacaaatatgggtgattcatcagagtgaatgctttcatttaagccctacaaagctatgttgcaaatcccacgtcaactgcattaacctaatttgaaaattattaactcaataaaactacatctaatacaagtagtaatcgacaggcaggaaagatttttttttcaacaaaaatctaatgaggaatggggagtggggagtacacgaggagagcggatgaatatcttactcgatttcttccccttcgcgaagcctctccgggcctccaggaggaacagcttcgtgggggccaactccctcgcgccggcgagggatccgacggacggtaggcggtggacggaggtggaagcggaggatgcggcggctgcgcggatggagcgggcagcaagggccgcgcctcggcgcaggaagagcgccatgagattaggtactcggtttctaactaccagggcttaccggagggttcaggggttcttcgccggcgagcggcggcggcggcggcgaacgagggttttgatgggttttgttcttcctttgcggtctcgcagtttttttttttttttagaactcggtcgcagacttgacacttgagagatggggttcatctcatagaaagacaattaaaagatagccaagtacccagggttctttctgcaaatatccctcgcctgtcaatcctagtcgcccacttctctatccaacgggtaacggctgctcgacgtcccgtactggaactttgcaaatgagtcccttattctgggaattaatttggatcgcggtctgtgtttgagatccaaaacttcatgataaaagagtccatgatgtacgaagaactttctataatttgaactgaaatcactagaagaaccctaaagctggattcatggatgtctaggagctagactgctaggagttgtgccaaacaaaggtgtcgacaattgaatttaggccttgtttgtttcagcttaagattattgtaatctgaattattaaatcagattactctaagctggattataataagctgatataaaataagctactagttgtttgtttttctggattattagaggcatctaagggtagtaggtctttagccactcaataatctggaaaaagctcctctagaggagattattggattatagtaatctggcttatacattgtaataatctagcataataatctacttgtttgtttcagcttgctcataataatgcagattataataatcctaagcttaatcaaacaggaccttagtactagtatatacaccctccgttccaaaaaagtccaatcctagctatgaatctggacacatgtgtgttcagattcatgtgtccagattcatagccagagtttgttttttttgacagactagtatgtagtatttgttcaacaaggacacaattcttttttgctatttttgatttgaatagtccgctgcaacacacaaatatttggccagtatagtactccactactccctccgttttcaaatatttgataccgttgactttttagcacatgtttaaacgttcgtcttattcaaaaacttttgtgaaatatgtaaaactatatgtatacatataagtatatttaacaatgaatcaaatgatagaaaaagaattactccatccgtcctaaaataagtgcagttttgcactggtcacatccaatgtttgactgctcgtcttatttgaaatttttcaatgattagtatttttgttgttagtagatgataaaacataaatagtactttatgtgtgactaactttttttaatattttcataaatcctatcttactataaagttatcccccactaactccttaagcttaacatgcaaatatgccacattatcatccactaacaatcatcacatttaaacatcatgcaaacatattatatctttatagtttttataatttaagagcatttcaaatacaaacatgttaaattatcatccaatataattcacgtaatgtttcaacgtatatctttattatgttttatgatatcctatatacttatatagttcatcctcactgatacttagtgcttaaatgattaatctatggtacaaattatatttctattttttctctaattaagtcatatcatatcaattgtccaaactatctccctacttttcttcttctataaagtcataccaccttactttttacatttgaatcaccattctacatactatttaaatttaaattagcataaaccacattaatttacttaatctgatgttatctagttatctgacacgttattttttctattgttatcatattaaattcccgcagcaatgcgcggggtttcacctagtttttcaaataagacggacggtcaaaccttcgacacggattctcacggctgcacttattttgggactgaggtagtaataattacttaaattttttgggtgttgctataattatgtcgacacattttgtgagtaatcacagttgatttcttgttcaatttgatctcccttgagattcatgctatgattgcaataccatgtgcattgaacgtctttatgtgtttcgtgttgcatcgtgaagccaatcaattcaaatttcttatctcgtcagcatgtgttttcatgaaaaaaattacatatctaatttcaggacttacatatgtaattttagaacttacactgtaaatatactaaaattacatatgtaatttagggacttgcaatgtaaatacatgctgactattttttggtgaaaaatatggcgccataaatatagttactctcaatttttttaataagatgaacggtcaaatatattgaaaaaaagccaatggcttcaaatatttaagaaacggaggaagtaaaatttataagatatgaaactgaatccactcaaaatttaatcatggattcttgattctttgtggcatctcaaccttgtttccgaggattctgatactgatgacgaaactcgtccgcgtgtctaatctgccgctggccggtttccatgcaacgtgggatatgaaataccccttgttggaaaggaattaagttgccgatacgttgattgtccagcacattggaatatggacagtgctcctaactcctaatacttgtcctcatctttcgagtgttagtcaactaccgtgagacatacacaggacccaaattaaactttacaacaaataggaatggtcggtataagtaggcgtgttagtccacctggctgatcgtagcctgccgtgcgttcggagttcagatcaccggcgctgcctggaaagtcacataccagtacagaatagtactccggtagctggtataccgtacgataccgtctacggagtggactattccatgtctccgtcaaaaaaaaaaaacgcgtacctatcgtagatcctggctgattcggccagtgaagcccccaaaaaaccgagacgtttacgacggcttcgcgtacgcgccggagagacgggctccacaccacaccaccgcccaccgcgtcacgccgtcgcgtgagattggcttacattccctggccgccgcacgactgacgcccgtgccgtgcagcagcgtgcgcttccgcgacgacaagggctcacgcgcggggagctggggaggcaggtggaaccaacgaacctgcatgcgggggggttgtggtcgatcgatccgccacccgcgtgcggtgccgcaccgccgccacgaggccgttgatagagatatggcccgcgcgttgctacgaacgtttgccgtgccggtgccccgctgcggcgtgttggccgcggctagctctgcctggcgacgcgcacgcacgcatacgcagacgcaggccgaaataacgtgcaaccgcacgcaaaagcgacggtgaaacggtaacaagctaggccccagaccgggaccggacgacgtacgggtggatggaagcagcgccagcgagcgaagcacacgcttttcccctcctctgaaacgctacgcgtcaatgtagtcatcaaagtctatcgatcgatcgggataacataaaaggggtaaggtaattcccaacccaatgaatattgttcatagcattaaataaactgtcacctagaataaaaaatgatgtggcaagtgaataaatgagaaaagagaaggaaaccatatcttgcatatcatagtttctacacaacatccaagacatcatgtgagataagtagtattaaatttaagtatggaatagtggtgtttgtattggaaggataatgtctcgtactagtttttcaatgatgtggagtttataaaaatcatatctagtgtgttgggttaggaataacgtaagatcgagtaggacgaatcccggtgtcccacctagcaaacagcgacgctaccgcgccaacgacagcgtactacgtaccgggcggttcagggcttcaggctgcagtgcaagcctatcgagagctaatttgcccgagacttggtcgttcaactccaacgactgtagtagagctgatagccgggccccgctacaagggcgggaagcagaagaagaagaagtccgcggcgagatgtcacggcggctgggacgactaaatatcgccggttcacttcaaagtctcggaaatttgtctacttcctctcgccctggcctcccttgcagcgatatcgtccacaggctaggcacgaaacttcagcaacgcgatcaatcgatagatttccgtgcaatacataagcaggcgactactttccgcagcttagccgccctctcgagctcgtgcaaacctaccccagaggagttaattatagatagttaactcgtgctgcttgctagctgatcatcagttgatgccggcgatggggttgtgggagagcgtgaggagcttgttcggggagggaggcaacggctgcctacctcggattgggaagaaagagtccgaggatctttactcttatccagtggatcatggtatgtaattttgtttttgtctctctgtgtgtgttgttgttgttgtttctttctccattttgttgacaattggaccacgttgcttttggtgctgaattctcaactgtttctctactccggttagctgtaatttgattagctcaattctgggattctcatcgtgtctgtcagcaggtagacaggccctcgatatattcttttgcgttcttgtgttctttctagctctgctttgataagtgatagtcgacagtgattaaacaggagacaatcgaccatttctactagcatgcgtgaaggattaacagcgaaatctttgcttttttccactgtgttcagataaacggaaaggagcggaccgtgcggccgcggaggaggtggtgacagtggaggtgccggaggtgcccgtgcgcgagctgaacgagatcaccaactccttctcgaacgagaacctcatcgggcagggctcctacgcgaaggtgtacagggtcctcatgcgcggcgcgaggcccgccgtcgtcaagaagctcgagaagccgtccaagcacgcgtccaacgtcgtcttcctcaagcaggtgcgtagctcttctcggtgctttttaccaatgctcactctgctactacttaccatatatatctgcagctgtcggtggcgtcgcggctgaagcacgagaacttcgtcaggctgttggggtacacgatcagcggcgacctccgcgtgctggtctacgagtacgccgccatgggcaccctccacgacgtcctgcacggtacaatctctacttctaaggatcagtcactccctctcatttttttttacaactacgcttgccgaactgctaaacggtgtgatcagcctgggactgaaccattggtgtgtcgtcgtgtgcagggccgagggacggacaggggtggggcggggaggcgaaggcggtggtgagctgggagcagcgggtgcggatcgcgctggacgcggcgcgcgggctggagtacctgcacgagaaggtgcagccggcggtgacgcacaaggacgtgcgttccaccaacgtgctgctgttcgaggggttcagggccaagatcgccgactacaacatgttcagccaggccgccgacatggctcgcctcaaccgctccactcacaccctcggctccttcggataccaggcgccggagtacgtgcacgcacgcacacacacaagcccagctgatctctgtctggccatggctgatcgatctcgtcatggctttcttgttgttggattgggtcgtcgaacgattttgctgaaattttcgttggtttggggatgttccaggtatgccatgactggtcagatgaacgataagagcgacgtttacagttttgggattgttctgctggagctcttgacggggaggaagccgctggaccggacgttgccgcagggtcagagaagcctggttaactgggtaagcatttttcttttctggttttcacatttccttttctttgtcttaatcactgcatttccctctcagttgtaccagctaacccaaagaacattaatatattggtcacctacctcgtctattttcatccttggtcttcctttctcacctaagaagcagctgaaaagctttttagtgaaagatttatctgatagctaagctgtggaataccgaacacgtacttatcaattatcaaactgcaattcgtctgccaaatttcaataaacctcaaaccagaagcttctagccccttgattaaaattttatggaggtcactttccaaaggcgataagacagtaggagatgcatttgtgctatgacgcaagaaacaaattgcatcagtttctttcctaaataaacaacacaatccaacgaaaacaaaaacaatggcagtacgagcatagtactagtatatcttgaaacaaagatgatgctatcacacaatgttcagactctgacctggcgtatctcctgccccatttgatatgctaggcaactccaattttgactgaagacagggtccaggactgcatcgaccccaatcttggcgacaagtatcctcctaccggagctctcaaggtttctctcttaactattcacctgcattgcatttttgcacccaaccattaccatctctatctatgtatctctagtaggtttctacttctaaccgtcagggtgtggcaatgtcacaatgcagctggggagaatcgcggtgcagtgcctgcagtacgaccctacgttccggccatcgatgggcaccgttgcccgcgtcatcaactacgccgtcgtgcgagaccagcaaggcgtggtctgatgatccacgaggattttttttttttttgcacttgttcattttgatttgttcgtgtgaatcaaccgtgtatatgccttgcgttgtgcaggctagttagacatgcaagagatacaattcttgcagtaatagttgaagagagactatatccaaaaagcctctggttgatataaactggtaccggtaaaactttcccaaagcttaggagtccatagggggaaaaaaacagaacagaaggccttattaaggccatgtgtgcaagctagttagacgtgcaagagtatgctagtagtacagtaaatcgctcaattttggatggagttgtttctcttctttttttttctcctgaagatgcatcatctaaggaaaaaaaatgtactgagcagaacactgagcttgttaggaaaaaaacagttcagtagtataaatggtacgaatgttcagtacaattgtgtcccgttaacatacatcgattttgccaaaagaacaaagggaactttgtatagtatgagtgtatttgtatagggtcggaagtcttgccatccgaatgtttgccccaaaaatgttggggtaaaaaaaagagaagagaaaataggataacctgaaacggagctatgaatatttcgtttcattctatagtttacaactgtttattttactcatcatgctacataaattctgtgtgattcatggcaaaaagaatttcttctatacctacctgcagaatcaaatggaagagtttatcagagctattgagaatgaacgtcttacaaagctgttgattgtaataccaacaaacaggaatagaaattgtttgcaacaaaaaataggtagttttgggttgctgtaagcctaggctctcaaatagttttctttggtgctaagggcttctattccatgcccatgagagtacctgttgttttacaaccatgaactggcttactagtagtgatagatagtaccaatcttagtagtagtcatataactaagatgaactctgattccaactatgttacacccaactgattatgcactccttgccttcaaagtcacaagcatctgctctaacatccatctctactctaagcaaaagagaagctactgacaatagtacataacaccaaatcatcaactgtctctgtcagtctcactgatggcagctgcaggttgccgcaaccaggtctataaaatcacctcctaccatcatagtctaaactttctaataggtgacccctcacccacccaacccatgttttgaatttcaatctgaggtaactaacgctaacagtaatacagaaactgatcgtaagcagttccttgcgaatgcagtttcactgacagatagcttacagttgtaacaaagtgacattttcatccaacaaacactgaaatgacacagcaacatatttgtccatgagaaaagtgtgtgagattcacctcaaacagaaggctaaataggcaacaatggttttctctcatcggttgcagtaagatggcttgcctgaaaacatagtcagcacaagagataagtccatgagaaataaagttgtcattcttggttttattcaacaaaacaatgagtcacttacatcatcagcagcgccagcagtcatatttacaaaagaagagtcggatgacctgccacacaaaattgttttatgagattagatgttctgaaatatttcataaaatcatgacactttcacttcaaatgtcattaatatgaagtataaatgcaagggacaagcgatgtttacctatgattctgtgcatcttccggttctaatgctccagctggtttgtcatctttgacctttgccagtggggagaaaaactgaacaagaacagcacttagccacttacatatgttcaactaagacacaataagtagtaggctaaagaatagacaataaaaaatcacctggtgcatcgaaataaacactattgagatgcctaggagaaagttaactgtcaaggtatgtcccaaaaatgcagcagatgctagaccggtaaatattgtggccacggttgatgaatacttcttcaaaattgtgtctgcattacgattttagtcaattgttactaaagcatgggaaatcataacatcatgtaactgaaacacagaaacaaagaattggaaactcaagattgtgtaagagagtaaatcaggtataccatcctttacctgcatacttaaagaagaatgaagagagaatgccttgtgcagcattgttacaaatgagaaacattgtggcccttgaatgacctcgaaggatgtcaaaactctctggccctgcaaacaatggggcaaagttatatcatagacatatagccaatagtccaaaacaaaacataagacacggtacgacactaatggaaggtagtaagatttggccaactcgacagtttgtgagacacagagtattaaacacgaaatacaaagtaatgcccgtctggctgcttggaagaggtgatgcatgcataggctatatgggttcccctcttgaacggtactttaaatataataacaaaacatgctacagtgcatgattttcagtttctgactggtagcgctataaaaatttgcaggatgaaaagacgcactgatttcaaagtacatattcaaccatataccaagctctaaacagacatccaatttcctttgctttgcaacacaaaagacacaagagtcctcgggtaccacatctgttgtttgcaacacctgaaatactaatgagaatattgcatgcatgccattttccatcaggcctaagtcaccccacatgttgactttcaaatactgaaatacattataatgcataacagcatattcatcaccttagaatctaagttgcttaccttgaaatatgacagtccccaggatgccaaggaagttgaaaattgcaccataaccatatagaaacaaattctgcatgttgtgccaagagttagtgtgaatgaagggagagagaagtcaaggaaaaaaaatgtgaacaggtaagcatcaaaaaccaagggactagatcttatcagtttattgttttcagtattatatgcgtgtgttataagtaatttgaaagagttgtaaggcaaacttttttagtgcaaatcacctgaagatagatgcttgtgtcgaactggcttttcaaagcatactcattgtagactgaggcaagtgatgggacagtaacctacaatctcaaatgaacataaatatgaacatctcgattcaaaatttgttcaggtggctgaaaaaatagtgaaaactacacagatcaagatactatgtaggtgagtaaaacttacaaatataagtgtatatatgtatgcaatagtggtgactgcaagaccaaaagatttggttccatcaggtatggagcttagttgattgacactgattccaataagcaacagagcaagggcttcccactgatagccataaaaaaagaacagggtcatagatcagcattgttggaaacatttgaagaacatataattgctctacattttccctaggatttgattcagtttaagttgttgtaccattctagacttcaagtccatttttaattaatttggcactgcatctaaaagtgtcaactactcaaccatcattgctagttacgattctgcattggtactaacagagtttgtgaaaaattcaaaaatatagtcagcaaaaggcaaggcaaaaaccttgagaaaagaggcgaatggtgcctattgatttctaaaatcctagcagtagtaaaacatggaaactgcatgcactatattcacaataacaaaccaatagcctaataggaaaaaacatctaaatgagagaaattcttagctgaattatagagactgcatgcactgtgcagtttaacatgtaatggctaattgtgttttttttttccacaaggaagattcaggaataaaaggaccacaatactaatctcagtctcacctgaattatagagaatttccttctcattatgaattttaggaggatagctatgacgagtaccttgatcaggaataaaagaatatgatattagtaaatcttgcttcttgccaaacatagggaaaatacacactcgcatcttgcaaaaccacatgaataaagcatgggaaaaatggcgaaagagggtaccttcaggttgcttagcatcttcacagttgcagggctgaagtataactgcatgtgcagtacagcagattaaattaaaaccaagaccaaaagctatatcagattggaagactccaaatccgaactctagaaaaaaatcttaaaacatcattggtctctcattagatagattcctactgcaatggcttggaaacattgataagtattaaaattcatattaactaactcaaatgattggacaagttgcaatgacaattaaacagttcaagaggccttgagaaacacttaaggccatctcttttgcattcatattaactaaaagtttctaaatagtttactagtagctgaataattatatctttttgaacattagcttatcatcatatgctataaactccttttcagcattatttcacagcattgtatttcccttgaaacacatgtatttaacataagcataaaatactgatacactgcaggaaaacaagatttcataaagttcaatgaacatttacctgcatgatgaactttaggtagttgttgatggcatataggagagcaggaacagctaagagtgcattattacgtgctgcctaaaaagagaaggattcaagaatcaaatgataagttgccataactagaaagctggaattagagcaatttgatgcataaagttataaataaataaaggaaagctgaaggcaagtcattaaggaataaaaactacaaatgagcttcttctaaggaattaaaaacaaatagacaaaaacaatttgtggttaacactataaacataagtcatatatctaatctgtgtgcatgttgagcacagtcaacaaagagtgcatgctgtgctagcattgacaagataaatcacctgtacaaaggttgaaagtgacagaagtggcttctccccaaccttttgttttctagactgtcaaacacaaataacaacattagggcgaaatactaaaacaacaagactacaagagccaggaaggctgccaatagtaaatccatgactacactgttggtctactgaaaatggtgaattatgtgtgcaaaacaaatgctttgattagccattccagaaattatgtgtgcaaaacattgatattacatagaaggatcatgcatgctaacaagagatggaacatttaaaaaaaaacacttgtagaaagcacggatcagctagaactaacctggattattagcattacaatagcaaatataacttttgtaacctctgtcaaaaagttgacactgataggactgaactgaaacttcccatcaaccttggacataaatactagaataggctgcatatacaaagtaaaaaattagcatggtttgaaaaggttggcaatcagatatgtccaataatttggcagcatattggcattgaagtcaaacactttcaagtagagtggagtacctggaggccaaccaaaatgcagtcccctgacacaagaaggaagttaagcgcgcggtacttggacgatatcttgctgcggtgcttgtcatatgccctcgacacactcctggggctcggagccaccaccttggagtggcatacactgcattccatcactccgttcctctgcatctcctctaactaagcaggaccggaggccccaaaagcacagcagcaagatatatgtatcactctatagccgtggcctctgatccctttgcatgcctgcagcaaaaaaatacatttgtgaactaagcaaactaatcgatgaaaactgaacacatttctctctaaattcacataatctcgcaaattcatgtgtagcaccgctacccagcccatctcaccaaaacacatcatagccgacagcatcaaccgaagtaaactacaaataccagcactaaacttcaaatcacccaatcagctagataatccatatcagatcactagaagctaacttcgccaataaacatccaaaataaatcacgaccaaatgcagcaagcgcgtgcttctatatactagatcacacaatcagcaccacacacaacaacaaccaaaaaaaaaagtagcacaatcacaggtgagcttgaacgacggagagatccgagaggacctcgtatcagcgaccgtaccacgggggagggtgggggggccgggcggcgggatctaacgccgcctgggcgctcggcgccggcacacgcgcggggcgaatctggtggcccctgtccggatcggcgcggtcgaggctcccgctccgcacccccccgcccggcgccgcacggggagatcgggcggtggcggcggggttctcctccccctcctccttggctcgcttcccagatttcgtcaagttccggcgggaggaaggtggaagagggagaggagcaggaggacggcgaaggcggggcgtgcgcttcgcgtgtattttattcacgtttctttctttctctttttttttttgtttgagatgttcgtgatttctcttgttcacgtttgtatttgtagtaactttttttccttgcagctgtctgtgatgaaaaattggtaagtttggtcattttacgccagaatttttttatctgtaaaatgaataatgccatgctataactgcaccatcacactataatgtgtttccatgtgcaagctatggagtaatactctcccctaaaaaagatataaaatggagtaatactttactaacttccattctcaaaaatagcacattcaagttatgtatacatgtatttgtttatgtatctggacctacataatgtctaggtaaaattcttatatatatttgcggacaggtgcattatctatttactcaagtgaataattatcattgttacaatataaaatcaccatatgtgttgctatttcattattgaaagagaagtcatcataggtgttgttacttatccatgttactgtaaatgttctgaactatatttgcgattgattacataaacggtggatacgcaaattatattcaaacgaatcctacaaaatatgtgcgagggagagaggcccaaaacagatctcactcatattcgaagttcgctccatatgaattgggaggtggcgactagtctgaaggaatagtctctcactctgttgaccatttcctttgcgattcgtgctacagtgataatagtaacttgttgtgtgtcatttactcgcttcctattggagcacgttgccagcgtgtatattcaaatctttccattcgacgcatgttaggtccaggtccaaacacactggcaaattctcaggcgaatattctaattgattcccgtctctttcgcaaggaagagcagctgacacgatcacaccagctagccatcgttacagtggcattttgagtttattctttttctctatgagagctcgttgaattgagcctttagcgttgcttttgatagagagtggtcatgagcaatttgcttggaccactgtccaccaaaattttcattagtgaaagtagatgcaaaatcctatctacaaaaggtaataatcactgctatatagtgtaatacttactgaatttgttgtaagagccatattcttctactcatatttgtgtcgtcctggtatgaaaatggtgcgattttttttgcggggaaaagcactcaattactcagacatggggtcatcactgacaacccatgataaaaaaatacaactgttccctggctacaggcctgacaaatactcacaccgagctttattcgctaacctacgactagctcggttttggctccgatgagctttatacaggaggatctcccctatcaccgctgaattaattcttgatttccctgagaataaacgccatctccgacaactccctctcctttcactgaatcattgcatcgctacctgacagtcagtttcaaccacaatcggcctgagaaaccattaaagaggaagagccagtccttccttgagagcaaggatctccgactctagtgcatgacatgtgtccggaattcagttatggttactaatatgtgtccgtactttgaacaaatctattttcggaattgatcccagtacatgacatctccggtaccctttcattgcatttatacaactacagctgctatagcagctgtgtttcttataccatagttgtactataggtgcatcttcagcaatttgagctgaacatgttcacaattttgagcggattctttataatatatcgattaacttcttatgtcgtgcgatcaaattttgaccttctaagtagagttattttccactgtttttggtgaccccatataccagctatagaaagatacaaatccaaaagacctagtaagatgactttttgagtggacaaaggtactaataaaagttttagattgcatctttgttggagttgtttgcagtgggatgtaggttgggcaagagtgcacacaactattggcttatcatttgctcttatattattgtttcatatccttttgtaaaagctaggtgaaaccctacgcgttgatgcgggcatttagtatgataacaaatataaataatgtgtaatatagctagatgacgtaagcttacataagttgatgtgatttacaataatttaaatagtatataaaataacgattcaaatgtaaaattaaagtgatgtagctttgtaagagaagaaaataagggagataatttgcatcatagattaattatctatgggcaaaaaacaattgaggtgatatgacttaataagagaaaaaaaaggaaggagataatttggaccatagattaattatataagggctacaaacaattgatatgatgaactcaagtaagtttttagggttttcttaaacaaattttactgttttaggatctattagatagagtttgccttttgtacatagaggtagatttatttcgagtttgtcttttctatctcttcgttgatgtctatttgttaggtggatcctccacggagacctataaaggtttgtctattgggttgctgatgattcaatccgtggcactggtagtattgattgctaacatgtcacaggaacggagatgtcagatgatgcttagtcatgttctttgtgtgtgcttgcgtttttcaacggtgttattgtgcttgtctattcacgttgcagcaatccaacatatggagctctttatcttttttgtgaggttttatacttcttgttcttgtgacaacaaggttatagttatatttcttattccatccgtcccacatagaccttgtttctagaaattctagaacaaatcagtagtgcggcgaattgatcaaatgtttctcattaattcatggttacaattcttatgttctagtttaaatgtgtatctggagcatgtataacttagaattaaacacctcgtggacggcggccagcgggggaggccacgcgctgctcctccgccgcccaccgacagctcctcccccaccactgccgcgttgcccgttgccgccttcatcgctgacgcctgccaccgaggctggtgcctcgcagagaagggacatagaagggagagagagaagaggggaaaagagagaggaggttgatgtggcctcgctgacatgtagggtccatgtggatcgcacgttgactcagccgccacatcggataaatcgggttcaaaaccaccgaatgacctaatgtgaacggttttgtaaattgagagataccatatatctagttttacggttgaggttaactcaataacaagttgaggcatcttgggtgtactttttacctttagcataatcgaacaaggatgctaacatggcatacaaacctttccgggctccacatatgtccacgggccgacttgtgacttggagcacgtacgagtgcacgacacggaccgagcctgaactctgatgaagtcgactctcaaaaagggtccgtctcctccggaaaacagaacacggctcggtggagaaaaccgaaaagaggaaaaagaaaaaaagaaagaaaaagaagaaaaatcctagggctagcctccgcagacacacgccatccgaaattcccgtatcctctcgagtctcgtcttcctcggcgccgccccatctcagccggacaccgcggcggcggcggcggcggacaggctgttcgcgcagaaccggccgggacgcattgttccgtcggtcgcgcgatccaggccggaggagaggggaggaaggagggggtgggtgagtcaacccctctctctctctgatcggaggtggtagccctcctcctcgtcgccgggaggcggctgatgcggcgcccatggccacggcggtgctcacctacctgcagagcctgtggccgctctccgctctcctgagggaggacgacctgcgggcgtccgcgcggctgctgcggggcgtccccgtgccggaggagacgaagcagttcgtgctcgcgctccgcgaccgcgagcccggctccggctcgcgcgggggcgtgatctacatcctcgcggcgcagaacctgtccgagcggtcggcctccgacgccgactccctgatcaggcgggtgcgccccgccgccgtggtcacgcagctcgcgcacacggcggccgacgacgtccgggccgaggaggagtgcctcgagggcggcggggccggcggcgtcccggcgtccccgttccaggtgatcaagaggtgcgtcacggagaagaggagcaaggatcagtacgtcaaggcggcggcgtgccaggtcttgcaggagattttcggggtcgggttctacggccatgtcttggccgcgaagagagccgcggaggagacgggctcgtgttttcttttgctcgagtctccgtatgagaggaattgcaatggcggcgcatcgggtggccaatctaccatggaagaaggctcaggtcagcaattggcgagtcgctgctcgctcgctcaaagttcaacggatgatggcacgggtggacagtcacagggtagctgcttgctcactcagagcaccagttcaatcgtaagctcgcatgtcaggaagatatgccttgtggatgacattgggggacaactcgtgaagtcgctagcgccgaccgttaatttgttgatgtcccaggctatctcttctgatggtgtttcagagtgcaaactggctgaatgcaagccatcggacagatacgaggctccaccttttgcacagactgtttatccgttgcttgctgatctttatgatatatttgtggacattccgtcaattggaaaagctatggcttctgctcaggaattgctcagacaagttcatgatgggaagccaatttccactgaaatgctgtctgatgtgtatgtatttaggatcgcaatagaagccctcaggataggtttaaacaacgcaggaagaagccacattgacaccagagataatcatggttcaaaaaaattggatttttcagaactcaactctgaggagaaatgccatattcttcttgtgcaagccctcagaagccaggttagggagtttggttctgtggtggctgtagtcgatgccagttgcttagctggaataaggagacactgggatacccctgttccttcagagattgcacaattagccagcagttgcttcaagcaatacggcaataaaaatgacagtgaggacaatgagctgccatcatcagttgacagcacagataaaaagagttgggtagctgagaaacctgtggtcgtagttggtgcaggaggaacagcgattctgggcttttcatctttatcaaaaactgtacaggcatctgcctttcttaagctggctccctataaaacaccggtggtcctgaagtatggcttaatacagctgcaaaggcatgcttccatcgtgttaagcaaggtcctatcgaatggggtttttagtgctagttcaaacgcatccgttttacaattcacagcttcatcggagaagattcgagcagttactcacactgtaatttcatcagcaaagagaactagcttgatggctatgcgaacttcgttctacgaaataatgcagaagaggcaaaaacaacctttcaggatcactccttgggcaacatttggttgcagcatggctgcatgcgctggtctcctgatgcatggagacgggattgagtgtgctgctgaggtcgcaccttctgttcccatgattgccactctgggacgtggtcttgagatcctgcgcctcacatcgcaggaagtgaggcaaacaaggggccaacatataaaggaagctttgggcgcgctgatgagcaacttaaagaaaacagcaaaataaagacataacaaaaaaataactgagactgtatagatttccatcatgcaattttgttgttagatagatttttttttgttacctctgtacagtgcattcttcttgcttttactgaggtaatcgaattcctacaatgtgttttggggcggttctacttctggagcatttcatccatatcagcccaccaaccttctgtacatacatgtatacaacatatgcctaattgacatctctaatgctttcttcgggatcatctttaatgctttagtaactcttattgaatcagtgctgataccgataagaatgtgatgcagctatctgtaatgttctaagtgaaataccacctggagatactgccacatggacagtaatgcttatcttttgtgaatcatcgtcttggctgttctatttgtgtttatattttcccaggcctggttcagccttgtgaatttgcatatctctgattgccccattcatttgctcactcaatgttgtcttcaagcttatctgtgtacttgactgcccttttctttattataaacaattatggttgctcattgttgattttgagctaaggacaagtggtcaatagtatccattgtgatatgcacttgtgttacatataatagtgtataaacatttgtctcatggttacaaaacaatgtggaaagaaaaagcatccttgtgaccttagttgctaaaaattggcggatgccgcctatacaaaagtaaggggcctcgcccatctgtaacacatttacttcccatttcttcagacagttgctgctttgagggtgagaaaatcagaaatttggtttgtgtagaaatctggctggatcgagttgtcagggctctgaagcatctgtacagaagtgacacctgcaaaatgcatccaacacttggtgcttgtactaacataaaatcagcagagcatgcatagttcagaaggagaggaggatcaaggaacctgaaaggaccagaagagttttgcaacctccgttttggccaaacaagatgtcggtatccaaacggtcaccaaccatgcatatctgggatgttgtgatcccaaacctgccacagaggtaaacgagaagaaaggtaagaatctgaaaccatccatccagctacatttctgataccgatggatgaaacatgactgctgctgagacagttggcctctcacttctttgccaggtagtccatcatgaatgttgacggcttcccgacaacgagcggttcttgtttagttgaaccaagaattgcaccaaccattgaccctccacctggtgaaggcaaaatcttcatcatcttaagcatttatccatcatattctaatgtaggaagagctggaatgcctgactaacctgcccactcttgggcatcagtaagatgggtgacggcgtcccggtttgtggcaatgaaaaggcaccctggattctcacgaatgcacagtgtcccgtaccttcagaagttgattagttgtaacttgtaagttagcaaatcttttgtattggttttggttaatgccaaacttatttacatgaacacgagagctaagatgtgatttggcaacacaggcagacagcattggtcaacattggtaaagaactgcaatcatcaattcatcatctgaggcatcttgcatgcatcaattatcaaatggatgcatgattatgatagaactactaatctgattctgcttgccttacatatatgttcatgtcttcttgacaatggaggaaagaagaagaaacttactgtactttgtagtagttaaaatagcgatcgaatcccacaacaactgctccaacctgtgacaaatccaaatggttctcagtgcaatgatcgcattttactgcaaaccaaagtagggatcgtagttacatctttgtcatgttccatgtaaaatccaggcttcagctctatcttcttgtctccatcagactgcaagatgattgttatgtgtgttaatctgtcccaggaatgcagcactgaacatgggttcagaaattttataacttactggcccgccgaggtactgaaatccagccagctccagctccttcagaatcccgtcctctccaatcacataaacctgaacaataaaaatgttaaccttgcgcaaatattatttgccaaaattgctgaacatgaacagtaaaaatggtaacgttgtgcgcgtatctttgcaccaaaacatgttaaaacttctgaagatgatgatatagattagataccttcttgtctttggggaaatcgatggactgcaggtacgcggcagctgcgaacgacgaagcgaagatctcttcctgcgtagagcgttccaggctcatcagaccagattggttggacaagaaaatttggcaaagaaaaattggcagttcatggcatgaatcctacctcattgacgtttagtcccagcgtctcaaacttcttcccgtattgcttcctcgacttggtcgagttgttcgtcacgaacaccagcctcttgccctgcaacgccacaaccccatcatcatcagcttcaactccagcagattgctaatgctaagttggactcggagttcgagaagatcattgcagtttgcgacggacctttgatctgagcatgtcgagcgtctccggcactccgtcgatcagcttgtcgcccttccaaatcacacctacgcaaacaaaaagaacgcgaaattcataacaaaatcacaatcaatcaaaccatcgagcgatcagtgtgccatctcaccgtcgcaatcgaatatgaacgtctcgacggagtcgatgagcgcgtcggcgttctccagcttcgccgcggggaccgcgccggccgccgccatcacggacctcctcctggcagcacagcgctgaccggccaccggagaagaaacggagaccaatccacctccccggcggtactggctcctcccgaaggtcggggaggacggcgcctgctgcggcgagggcgaggcggcggaggtggaggggaggaaggtgggggaggcgcgcgtcaggagcatcgcggctgctgctgctgctgctgctacgtgcgtttttgtttatccggtggcgtctgtttggttggttggtgtcgtttcggtttcggcgaatgtaacggtcacgtaggagtatgtgtagtgtagcaagggaggctgctgctgctcatgtggcgacgatgatttgtggctgggagcagagggaggagggatcagggatttggggtgtggccggctagtgttgtggctgtcaataggcacattggcacggcgtctgtgaggctcaggtgagaccgtgaggagaggaagcaatcaagcaacatgtccggtccggcatatcaatgtaccaaatggtctgttcgatagaactttaacttttttaaatttagcttcagaagttaagtctgtagtggaatcgtacagcagtctaaactcctaaactcagctccatttctttagttcattttgtaagaacgctccacctagctccattttcattttaggtgaagctaaaactgtttgactgtgttttagttctaggagagttgaagctgaaactgtgctaaacaggcacttattgttacttgggatttagcatttgaaagaagctcacgtactccctttgtaaaaaaaaagataagatatcccaatacaaagaactggacatgaacaaatttttcatttttcgtgcgcatacttcttaacgaactaaactatacatttttttttaaaaaaaaactaccgaaaaattgctttaagtaatcatattaatctatttttaagtttaaaataattaatactcaattaatctaaattaatggctcacgatactatttttgtctcccctcaaacacactttaatgctctctttggaacataaatttttggtgagagataatatgatgccaccaaattcttactcataggtacaagtaggtacttctagaaattgtacagaatttacttgtgctaggttagatgacaaacagggactacaaaagcctgctacatgtacaaataaatttctgctaattttattggtgtagttttcatgctatgtttggaatagatgaattttagtaagagccgatatgccttcttacctgcaggttacacgtgaaatcggaggtgttatataatatacttgctccgtccctaaatatttgacgccgttgacttttttaaatatgtttgaccgtttgtcttatttaaaaacttttgtgaaatatgtaaaactatacgtatacataaaagtatatttaacaatgaatcaaatgataggaaaagaattaatccttacttaaatttttttgaataagacgaatagtcaaacatgttttaaaaagtcaacaacgtcaaatatttagggaaggagggagtactattttgtttgttcaacaaaaaaaattttcatgtataacaacatgtgggtttgcaattaaaagattttgtaagcctgctttggtatagttttcatattggtttgtatacgtcaggtgttgcttatgatgaatttaatttactaataaacagtagaccttttgacataaaaatacagtagatcgatcatttgtgtatttgtttttaaaaaatatttatataattcaattagacgttgaatggtagttaatgccacactgtgtgccattttctaacccttttgtgttataaattattatattatgatttttctacttataaatattgcattatgtttcatttggcttaatttacttacatggttggggcttggaagccaacaagtgttggctaaacttctctgcagtttgcactcgatatgtttgagaggaataagatgtgatccacacgattaatctttttgaaactcatcatcacaatatcggtgaatattctcgatttctcctttggctctatccccatttctctatattttttaatcgtaatttgaggtatcttttattattgtgtgtacacacaccccttatcagtctgtcttctgtttcgtaacttctgctagttttttcgttgcttttaatttgtttgtagttgcttcatggaagagttttttcgttgcttttaatttgtttgtagttgcttttctagtctttgtagtcgtctcccatttgtagatgagaaagatgaactgtggttggtttctcattatattagttggatgtttgacttgtaaatcctgaatttgttgtgctccagtcgtttacttatgttcagttgtcattattgtaagctcttctgaattttgttgagtcttgacttttttcaccagtactttggtgtaaaaggttatccttttatatcatccttaattttttgttgcttctttgtacgcgtcatgtgcttttttcatgagttgaatattaatttgagcccctctccgccgccccctaaggcttttgattgtggttttgttcttttcctccctctgttagaccattgcttttgaactcttcttagtttcttcacagtattgttcaacctttttgaatttctttcgattgggtcaatggagtaattcaaccaggagctaactatccataccttgccgtcttcaatttatatagcattttatttgttcttgttctttttatttcattatctatgccaactattgtatttatttgaggtgcacctgacgcccaagaggttgaacctgaacgacatgcatctccaccaaagctatttacctagtgagtgtcgctcaacttttgctctaccaaattcttcattcgatgaaaatgcatgatgttggtggtttgaaggtttctgtgctagggaaaaccataagggaaaaaaattaccgtaagagagcgcggcaacaagtgttgggtatattgagctgggaagtcatgacagtggatgttggaaatatgaggtgttttgccatgctatctagctactactagtagaaccattctagatcattgttttttaatccaatggatcatatttattatattactggtagtagaatattatttttctactggtggtagaatttataaatcaatgttggatatcatttttctagcacgaaaatactggtagtataaaattaccactattttttgatttttttttgaaaaagattacctccactattatcactagcttgttcctattctctggaaaaagagcaccgtaaaatattagttgttcttgttctcttggttgggacgtggagagttgtttgtagatcgagttgaaagttggatcatccatgaagtttttttatgtgtaaatcattggagtatgcttttgtgttgcaacttgtttatacatatactccatatggaatgttgaacgcaaggccatggccaccgtacctggcaaaggcctgcccgtcaaatataatcaaaggtaactgtaatattattcaatttaaagcaccagggcacatatagtttaggatcggatgctccccactttctgctagaataggtccttcaatgtattatgtatagaatctattctacgttgaaaagagatttcctcataacaaaaaataatcactacactatgctaaaaatgcgttttttttcccagccacacttagtgctctaatagtaataattacgtacttagccaactatagcaatatatggctgtacatattgagctatacagtggtgtatagtatatgtacagaatctattctacgttgacactagacaagttttatctcataaccaaaaaaaaaatcactacattatgttaaaacatgtgttatttttctcagccacacttagtgctctagtacacctcataattacgttagccaactttagcaatatggctgtacacgttgagctatagtgatatacaataatgtcaaacttgctgcatccaagtatggcaaggtattgctatacattgccacatacgataggcttttactccttcattaaatgcgtccacctagtaccaaatcactttcagctttcaaatctcaaactctttaaattcccagccttgaatccacctgacctgtgcctcgtactcccataatcccatttcgcatccggttctagctttccttggcttcccatttcctcgatctccagcgatgtcgctcgccgacgacctggccgccgtcgagcgcggcggccacatggtgccatcgaaggcggcgggtgtcgacggcgacggggagccgcggcggacgggcaccatgtggacggcgagcgcgcacatcatcacggcggtgatcgggtccggcgtgctgtcgctggcgtggggcgtcgcgcagctggggtgggtggccggccccgcggtgatgctgctgttcggcgccgtcatctactgctgctccgtgctcctcgtcgagtgctaccgcaccggcgacccgtacaccggccagcgcaaccgcacctacatggacgccgtccgcgccaacctcggcgggaccaaggtgaggctctgcggcgtgctgcagttcgccaacttcttcggcgtctgcgtcggcatcaccatcgcctcctccatcagcatgctgtacagtaaaccaaaaccctttctctgatctctctccgccgccggcgccgcgcgccacatctcgccgtgaatctttacgctttctttcttcgcttcttgtgcgtgcgcgcgcgcgcgcgcgacgcggcgaacggcggcgagcagggcgatcaagagggcggggtgcttccacgtgagagggcacgaccagagggaggcgtgcggcggctcgagccggccgtacatggtggtgtacggcgcgctgcaggtcgtgttctcgcagatccccaacctccacaagatgtggtggctctccacgctcgcctccgccatgtcgctgtcctactccgccatcggcatcgccctcggcgtcgcgcagatcgtaggtgagtgaggagcgaggggctcgttgtttcgttgtggtttttttgaagtgcttgacatgtttgagatcgagtttgcagcgaacgggggaatcaggggcaccatcacgggcgtcttcgtcggcgccggcgccggcgtcacctcgatgcagaaggtttggcggagcttccaggcgttcgggaacatcgcgttcgcatacggcttctcgttcatcctcctcgagatccatgcaagtcaccgttcatccggatatcactaattcagtatcccgtttgatctttcttgattgcttattactatgcatgtgtgtttgtgttcgatatgttccattcaggacacggtgaagccggtggcgccgccgtcgacggagacgaaggtgatgaggaaagcggtggcggtgagcgtggcgacgacgacggcggtgtacctgatgtgcgggtgcgtcgggtacgcggcgttcgggaacgactcgccggacaacctcctcaccgggttcgggttcttcgagcccttctggctgctcgacctcgccaacgccggcgtcgtggtgcacctcgtaggcacgtaccaggtggtggcgcagccggtgttcgcgttcctcgacgggcgcgccgcggcgggcgcgtggcccgggagcgcggcgctgggcaagaggaggcgggtgctccgcgtgggctccctggccgagatcgaggtgagcccgttccgtctggcgtggcgcacggcgttcgtgtgcgtgaccacggcggcgtccacgctgctcccgttcttcggctccatggtggggctcatcggcgcggcgtcgttctggccgctcaccgtctacttccccgtggagatgtacatcgcgcagcgccgggtgccgcgggggagcgcgcagtggctgtccctccaggcgctcagcgccgggtgcctcgtcgtgtccgtcgccgcctcggcgggatccatcgccggcgtcgtggaggcgttcaaggcgcacaacccgttctgctggacgtgctgaatcatctgaggccttgttcgtttaattctaagaaaaaaagagaggttggaggaactgaaaggaagtaatttcacatcacaatacatatgaaatactccctccgtcccacaatataaggaattttgattttttgtttgtaacgtttg

SEQ ID NO: 76191 - DNA, 7058 bp, Oryza sativa
ctcgaccagcggtgtagcgattctcccactacctttacttctagtggtcgagtttagagtacatctggttcttgaccagcggtgtagcgattctcccactatttctacttctagtggtcgagttgcgactaccacctggtcctcgaccagagatgtagcgattcttccattacctctactccaacaaagttgacatcagatacacaatatcgccaagtgttttacccagagatcccttaccacaaaagacacctagcgttgaaacctatcctactatccctttacgccgtcttgacaaggcctccgaggaacctaaggaaacttcggttggggacgcccagagtcgataaggccttgttggatccttcagagacgaaagaccatgtaagatctggtcgtgtaagagttctcgcagtgcgtattaaccaagccgtgtaatcggaaatggattttccaacttcacggctgggggctaggatcaatgcttgttcaactgaggcaggtccaaggtccaagagccttatcttccgagaacgattctccgatgacaaggctgggggctagggagagtgtataactcaacaaactgactaatcgaagtcggtaaaagagtagacgctcatatacaaaacattggtctgtaagtttaattcattttcggttttccatacatatataacatgtcaccctttgagcattcgttcgggggctatttctatctaatatttttttctgagtattgatttcaggaaaattctagccgacattatcgaagaccgcatgtctctatggttctacaccaagatcgactaaggcgagtatgaaaaatgtcgacaaagctccgtcgtagattctgcgccttcttgatcactcgagaacggttggtggatctcgacaaggaatacagaatgaagaaatggtgtacccgccgagataaaatttcttgacttcaatccaaattctcgattacagcaagacgggagacttagtcgtatgctctgtactttctcggttgacatcagagattgactcagacaaaccctttaggtgcccgcacgaggctgacaaaggaagtctaacgttatctctgaactcaccaagaacggtcacgtgagctcgataacagttcctccaaggtctgcggttgggaatatgaactcgttcatttgcattgaagtcaggggctactgtcagggttatggataccacatacctaatagtagttgactaaatctcggcagaacctaccacatagcatgttctatacggaaataacctgcagatataggaggagttccagataaggaaatacaaccagaattctacatggaaacgacaaggactactcggattgtatccatattggtttccctagttctacttggacaagggaacacctatgggtataaatacaagcccccctagaagtagaggggagacagacaacatagaggatcaacacccaacacaatcaacatagaagccacaacatagaagcctacatacgccaagacacgccgtcggatatcgacttcggagataggcacggctagtcccctacggtgtctctggatattgtcaggagagacgaaagcgctatctctgatctcgccgggtacggattcaaggagaaaggctaccctgttgtcgattacgagtcagatcatcagaccgccatgtcgacaacagttagataggctaccccaaatattgtactggtgtgattatcatgaataagagcaataccggattcggccaacaggatgtagggttattacctgacaattcaggggcccgaacctatataaaaatcctcgtctccatctcttttacctcagtctcgcgtatatcctagtactaacgatccccataccatgcaaataccgtagtcgagacatcaaacgtcgacaataccgcccaaagatgattaaaaatgtatttataccatccaaagatgatttgggtgggaattgcttatatgaagtatatattgggtgcctataaaaaaattatatattgggtgggaattgcaagacctggatagtataacaaggtgggaaaggtagtatgtttccttttcttgagtagggagtggttatacccaggcaagtttacacgttcatttttatcagaatcggtttttctatttttctgatttttttttgttcgttcatacgactaacaccctcgtttttacgcttttcaaacggctaaacggtgtgtttttttataacaattttctatacgaaagttacataaaaaaatcgtattgatccattttctaaaaaaagaattagctaatacttaactaatcacgctataatggaccactctattttccatgcgggagtgagttgctccaaaagtaacgaacacatcctaaatttaatcgtgccaacaaaaagagagagagaaaagaaagatgggactgggcctgtttgacgctaatttagagtattaaacataaattgattacaaaacccatttcataaccttaaactaattcgcgagacgaatctattgagcctaattaatccatgattaacatatgtgatgctatagtaaacattggccccgttcgaatcctctagaaagagaggataaacttttggattttcgtgacacgcttttcaaactgctaaaccgtgtgtttcgtgtgaaaactttctatatgaaagttattctaaaatgtcatattaatccatttttcaagtttgtagtaattaaagctcaattaatcacacgttattaccacatcgttttacgtgaaacacttgatcttaatcttcatcttaagaagattcaaacaccaccattatctaattatagattaattagacttaaaaaatttatctcgcaaattagctgctatttatataatcaattttatataagtagtcagtgtcaaatatcctacatggtaccagggtttcccaaaccgccggggccagggttaccgtgcctcggcggtaagcacggttaccgcgcggtaccgcggtaaccgtgaaaaactgtataaaatcgtgcaaaatttatcaaaaattcaaattattttttaaatttatttgaatttgaggaggttatcacggtatttatattaccatacccccgcggtaagctcggtaaccacgataaccacgcagttaccggggtaatgtaaatcctggcacagaataaagtttagtcctcgtccaaacacgacaccaccaaaatcttttagcgtctagaaccattgtgcgtgagtatctctctcaaggagaaaattgacattgtgccattctcaaaagtgggtttcgtccaaataccacgctgggagtgggctttattaaaatgccactttcaatcgaagactacacgctataatgctcgaacggacaaaaatacccctgttactaccttcttccacctctgacaagggatgcctcgccggctcgcctctgccacgcccacctcatccgcctccacctccgctccccttcctccctgacaaccctcgcttcgtccacctccacctccgcaccacttcctccccgcctcgaccgtccccaaccgatgaccccgtggtcacgctccacgccatccgcgccaccgacgccgacgtcggcggtctccgtctttcgtgccaacccgccgtcctagccactcccgttcttccagacggcggaggcgcacccgcacggcggagtcgttggtgggcatggccatggcgaaggcgcggcgcggtggtcatcggaggtgcaggcgacggcggcggtggccgggacgggtgcgagggctcgcggagggcggggctgggatgggggcggatgggagggggcacggggaggggagccatgggaggggtccccgcaggggcctttggcctgtggttctccatggaggagagctcgcgcgaaggcagatggtggccgccggcgagagctgatggtgatggagggaggaagaagatgagaggagggtaatttggtccgagatagtattttagcgtgtaaccatgtgttgaaagtggcattttaacgaagcccacttccagcatggcatttgggcgaaacccactttttgaggatggcacaatatcaattttctcctctctcaagcccctccgccgtcccctcttgcgttttggccgtctcgtctccgctcctcgcgccctgcgccgatctccatcccgcgagcagatcagggtcggcgatctccatctcgcgagcagagggggacgccgccgttgtccctgctgctgcttccgccacatcccggtgagcatccgcatccgcatcctctttctcattcacccccccctctctctctctctctctcacccactttttgtctcgattttgcttgcgtgaaccctagcttcttctcttctagatctggaagaagcttttctctaaatttgagagccctaaccttaatacaagtaacagtttgtttttccccccaaaaaagtaacccccatgtccgcccctgaattactaatcgatggatgcagtaggactctgctgtggagaacagttcgagaattatagaattattatatgacaggcttgactgttaagcatgtttgttcaactctgcatttattaaatgtgaatccccatgctttcggtggtacactgctgaggcgcactctttttggtatagccaatagatcatctgtttcctgtatagcgagcggtatccaactgcttggatctatctgagcatctagaagtgataactttcataatggtgttgcaatactatgtcattgtcttgtaaatatttagttcagatgttgatcaatgatccactgatctttcggcctgtttagatcccaccccaaaattttacaccctgtcacatcgaacatttgaacacctacatgaaatattaaatataggctaaaaaataactaattacacagattgcgactaatttgcgagacgaatcttttaagcctaattgctccatgatttgacaatgtggtgctacagtaaacatttgccaatgacggattaattaggcttaataaattcgccttgcggtttactgacggattctgtaattaattttcttattagtgcctaaacaccccatgtgacaccctatataatatctgatgtgacgccaaaactttacacccctggatctaaacacccccatgatgttcattccatgaacaaagggctttcctgagatgaatgtatccccatcttctgtttttcgattgcatcatgctatgttctgttgctgatgttatcacatttcaaggacaggatatcccctttaatgatctctttggttggttcatgttttgttgttgacacatctttggcccaacagccaaatataaaataattggtcaacataatgctttttgaattttgaattgcagcattttgagcaattaaggaggtgtcaacattcagtacaagaaatggtatgctatgattctcctattttaacggtctgtgtagtcttgcattgtataggtatgcattcctttgtgcttagtttgcttacccccactctgttcatttgttgcagacttacataagggatgaagatacaagacttgagaccactcgggcgaggcgtaatagttccctctttctttagttggaaacaattcttttcttgggggctttctgttattaaggaatccaagaaagcagtttaggcataattttgaacttctgttttgcagtgtcgaatgttctcaaaaggcatgaagatttgaaagagcgcctctcacggtactcccttttgcatgttctttagcatgtaacatctgcatctgtgcataaggaaataatttaataccctattcaaactgccagcaaatttattgaccatttttttttattgaagaacagattctaattgaaaccaaactcttgcataaaacaaatatcttatgagatggatacttcccctcaaatatggctcctctaatatgtaaatatgaattacttaggatttcttataatcgtatttgttgcagctatgttcctgataactaggcttactattgaatggattttatcttcctgtcatatttctgaattctgataaacatatgaatgcatgggctaagcttttactttgtttcagggattctgataaactgatttttgagcggctacagagagaatttgaggctgcacgaactgcccaaactgaaggtacagtttgctaacattaccatgaatctttgtgagattctactagaagaaataagcttaccaatgattatcaatatccatgtaattgtatatttgtgcaatctccttttcctttaagtttgcatattttagtattctttgctgcatattccttggttaagatcaactttgtacaaaatcaacctccacaaagactgctcaatttgcaaaataatgctcgccgagccatttctgatttctttgcattttgaactttgaaattccaaatggtgttttaaatttcatctctcaagttatgaaactgcattttggactaaattaaaaaaaatatggacacaaatgttcataagatagaatttaatgtggtcactgttcagttttttttctttttttttcttgagcacacaggagtcacctgtttaggttgctccttgaattccgtataaaccatgaactaacaagaatccatgcatgtgcatggctgaaactattgagcggttactgaaaaattaaagagctttgttagtgacatttttttgaattcaaaatcattaatacagaacataaaatataattgtaaggtaagaaatgctagctatttgcaatcctagctacgaattttgcattgaaggagagagtgagattattattctgttaatgcttctgttcacaataattcttttgttgtcatatttttatttgagtaaagtgcacgggcggtccttaaacttgcaggggtgtgtcatctaggtccctaaactctcaaaatatatatccaagtccaagaacttgtcatagggtgtcatttaggtcccaaatcgccccagcccctataggatcctacgtggcactgatgtggcatgccacacggacaagacgtggcatcatttt

SEQ ID NO: 76192 - DNA, 5958 bp, Oryza sativa
taagtacatgtgcccatgtatgcaagattgtgccattagtggcagataatcactaactattatttctaccaccatttctagaattagtacttggacacacgcatcatttcttttagctcatttaaatgaaatgtacaaaatatcatcgaacaatgttcattcaaaagttgagtcatagttataagtgaatcatgatcacaaaactcttctttaccacaagcaatagcatctgaatcaatatgtgttaaatacattttagcaataggttccacacttgattgctctatggtagcatgaaaagtggacatgtgagaacagtcaccttgatttatccatttttggaacatttggcatgtgtttggtttggggacgaagtgggatgggttgggttcatccctattttctggaataggatggttctattttttgtttggttagagagatggagcgcaccctattttttgtttagttagagggatggagtgagatggaatggttccatcacctgtttggatggagggataaggtgggatatccggataaaaatacttcctcaaatagaattggtgaggttacctctcacatgaacaatatatttttagcacctacaaaaatttaataaactctcacacaaaaaatacattcgtagcagccccaaaaatttaacaaaaagataaatatgttgccatatcatactcaagcactaattaatcatctcatcacaaattacttgcacacatcacaaactaattcttgctcacataaaaaaaagtctactgaaagaacatgtacagatctgaaacgaaatccccatccaatgttgtcatcgggattctgggaggattggagaaggaagatcgcgcgtgctgctgacgttggaggccgatggcggatggaggctggttggacaccgccatggctgccgccggctcaccccagctcgcgcgctcctgccgccggctcgcccatgctcgcgtgctcctgccataggctcaccctcgcccttgctcgcgccctcccatcgccggctcgcccatgctcgcgtgctcccatcgccggctcgccctcgctattgcttgcgccctcccgccgctggcttgccttgctcgcgcgctcccgccgccggtgagagaaggagaaaggaaaggggtgcggtgaaaaaaaaaaggtaggccagatggttaccgcgcgcgtgcgaagtgggatggcgctgtccgccagattttcgcggatgagatcgtcccgaatattggaggaatattctctttttggaaccatcctatccctcctaatctctcaaccaaacacttggttttgggatcatcccatcccatcccgggatatccctccaaccaaacacaaccttggtttatctcagcaccatttaatttatctttctttgtttagaaaatgtaggtgcatcagtcttctctttcttctcaagtgatgggaatagcacctcgatctcgttttcacaggtttgctgaatgctttgaactccctacaaaatgttagtaacaagaagcacaagcatagcatgttgctccctcgtgtcctccaaaatttcaatctcaacattgcaagcaagcatgaagatgtgggctatatgattagatgtcacattagcaagcctaacttgagtatctaaattaagccctttcaagaatctacttattgtgcattcattgtattcttttaaactgtagtagatgatacaaattttaaattcatggaattactcctacatagttttatcatcttatttcagatgttctaatttcttaaggagaacctttttataacaagaaagcacaaatctctttctcatcaataacttgcattctccccaaatttcaggtttgtcaccaacatgattccaccaaaaggatacagaagtggtaaacttcttactagcagtcttaatcatttgaacattagaaaaatcatgcctctcaaattgtttgtctactgctagctcccaatcaacataagcggcataatcaagcatatcatcaaagaaaagcaatacagattctactcttgcatgattataattgggtaccttataagcgtcatgtatagtactcgctgtgtcttttagcaggtgaaaaggttggcattcaacatgataaactccagttcctttgcataacctgtcagggttatggataccacatacccaatagtagtcgaataagctcggcaggacccaccatatatcaaattttatacggaatcatacctcgtatatagaaggagttccggataaggaaggacggatagagttctatatagaaacaacaaggactactcggattgtatccataatggtctccctagttctacttggacaaggggacacctatgggtataaatacaagccccctaggaggagaagggacgagccacaacaacaacacacccaccatagacgcgcaaatacacaagccaacacacgccaagacgagccgccggatatcgacataggagataagcctagacaaacccaatatggtgtctgcggaggccaacaagagggatctaagctatctctgatctcaccgagtgcagactcgaggaggaagactaccctgtcgtcgactacgagttggttatccatgccgccaagtcgacgacagctagataggttatcccaattattgtactggtgtgattacgatgaataagagcaacactagcctcggctaacaggatgtagggctattacctgtcaaataaggggcccgaacctatataaaaatccttgtctccatctcttttacctcaatcttgcatataccttggtacgaacgatccccataccatccaaataccgtagtcgcgatctcataccatgattagtagaaaacaagaaaaatatagcctatcaactattgaacttggtgatatccaactccctctcaatctcccatcttgtgcaactaagttcttacatgtttttaccatgttatgtagatggtgtttagcaaacaacaagaacatcaacaatggttagttgtaccggaaccaacaacaagcacgagcatgtgtcatagtagataaatatgtggagctacaggaggttggaagcaaaatcacggtacaactaggagctataggagattgaataaatgctcaacaatgatactatgttgctcctagcttaaacttagttagagacacgagcttggtcacaagcgtagccattcaaaatagcactaaaagaacacaaacaaaaacaacaagaacaacaacttctcttttcttcttatgtattgtttcttctcctttttttcttctcttctgataccttttctttcctccttttttttatcatttgcacaactagctcaaagctaaaacgtttcacaagaatttttgtcagtgttctagatataggacaccctatacttatgtttaagctcggcggggtccaccatataccaagtcctatatataatcaatcctcatacatatgacaaaagtcctaagtagataaggaagaagtcccggacaaggaaagagaaatagagtcaattttgcctcaacctaagctacttggattgtatccataattgtccccctagttctacttggacaatggggcacttgagggttttgttgacagccgttaagtaccaactatgaccttcaactcctgcataaaaaaatacaaaatataatatcaaacttagtagtgagggtttattactaatcgtttccacgagtattggtaaatatatgtgtgcagataattttggaaaaaaattacacctgctatgtgacgaaatgtacctccgactaatcatgtgcaagcacaaggattggagggcccacataccagtcaaaaccgactaaaattaagcttatccacggtgcaccgccataacggccacttttcagcctcaccaaggaaaggttggtggctgaaggtggtggcctggcagccttggtgctcccggccaccgacttccacgtggtgcctcactatcaggttcccaatgacgataggagtgtttatcgacttaacaaccgatctacaaccgtcattgagctgctataaaaggaggaactcacttcactcacaacacacaacaaagtagagtacaacccactttcatattttaggcatcactttagtagtgtggagaaaatacgtacagagtgaggagaagtacggaggagtgtcgaagctgtcggcattctctcctctcctggacctaggcagaagcttctttcataaagtaagtgctcgagattttcttttcgatatttaattacttactatcagggttatgagtaccacatacctaatagtagttgactaaatctcgcaggacctaccacataccatgtcctatacggaaacaacctgcggatataggaggagttccggataaggaaagataaccagagttctacatggaaacgacaaggactactcggattgtatccatattggtttccctagttctacttggacaagggaacacctatgggtataaatacaagcccccctagaagtagaggggagacagacaacatagaggatcaacacccaacacaatcaacatagaagccacaacatagaagcctacatacgccaagacacgccgtcggatatcgacttcagagataggcacggctggtaccctacggtgtctccggatactgccaggagagacgaaagcgctatctctaatctcgccaggcacggattcgaggagaaaggctaccctgttgtcgactacgagtcagatcgtcagaccgctatgtcgacaacagttagataggctagcccaaacattgtactggtgtgattatcatgaataagagcaataccggcttcggccaacagaatgtagggttattacctgacaattcaggggcccgaacctgtataaaaatcctcgtctctgtctcttttacctcagtctcgcgtatatcctagtaccaacgatccccatactatgcaaatatcgaaattgcgacaacaaacgtcgacagtggcgcgccaggtagggggattcggctgtgaggagatccaacctgtccaagtacatcttccgacaagatcggaaccatcgtcgtcaacaacttggtctatcgagatcatccaagcctcaagcttcgcggcgtaccaaaagatgtcagatcgtatgatgtcgaacgagtacgcaataaggtaattggtagattggttttttaaattgatctactaatttcgtagatacatccggcatgtatctacaaaggtacgcaatattttatctgcaatttgtcgtacctattcagatcatacaacattgtcagatccatgatttattatgtttatctagagcatgtttttatacaatatctattatgcgagtgtttccggtgttaagccgacaacggtttaacgctgggggctcgctctatttccttctgtataaatcatgcttgtttacggtttacataatacctgatatttacatctgctcgttatatcctgataatactagaagatccatgcagttttttgagtatatactcgattttatctactatatatcttgtcttctagataattctactcgttcgctagtcctcgaaccagtgcgtagcaatctctcgcactgcaacttccattggtgttcgagagataattctacacgttcgctggccctcgaaccagtgcgtagcaatctctcgcaccgcaactttaattggtgttcgagagataactctacacgttcgctggtcctcgaaccagtgcgtagcaatctctcgcaccgcaacttccattggtgttcgagagatgattctactcgctcgctggttctcgaaccagtcgacagcagcaatctctcgcatcgcaacttccattggtattcgagagatgattctactcgctcgctggttcccgaaccagtcgacagcagcaatctctcgcaccgcaacttccattggtgtttg

SEQ ID NO: 76193 - DNA, 6863 bp, Oryza sativa
atgggataggatacgggataagtgatatgttatttggtactacttatacccggctctaaatttaaatttaaaagataatatgagttaggatatagaaatgtcataatccgatcaccataccctacccgtttttaccactagatgtatgaacctagaattcttatgtcgattgttgacatgtgttcattggacacgcggcttctttttcttacatgggctgtcacaaactattcgcgtgggccagagacgtccgtccgcctgctcgttagaccgatctcttccaatctgcagccctgtttggcactggcacagcttcagctccagctccatctcttctagagctagagctcagccaaacaatttcagctacacctataatgagagcggagctggttggagctctctcacaaaataaactaaaaatgtggagcagggtttaggcagtttcacaactctactccagaaccagctcctgaagctaaatttaggagttggaactctactaaataggtcttgcatgtcacacgaataataacgaataataaccacattaagagcgggtcgatgactggatgtgttccggattagtaggttcagaggctaaggcattgtttagttcctaactttttcttcaaacttcaacttttctatgacatcaaaatttttctacacacataaatttttaactttttttttcaaactttcaattttagtcaaacttccaattttaacgtggaactaaacacaccctaactacgtaccgatttacattcatgattatacgtacattacggtccatatatatatatatatatatatagcacgtcacgcttaatatcattctggttataaaactggtaaattgatgagcgcgtctaacggcggtcgatcgatcgaatggataagcccaaatatatacaacattccggttatatattcaacaagaacaactactagtagatagccaaagcgttccatgcagtttaggagagttttccgccggaaaagagataaattaggagagtttcaacagtgacagcccaggcgccagagccggatgatcgtgcatgcctatcgtgattagttagcccagtcagctcgatcagattatttcatataaaggcaaggacgcaaggtgaggtgagagacacatcgatattatccaaacaccatataaacctttctcaccttccggattccggccatcttcgtttctcgtcttcgccggcggccgccgcatttctgatcggccgatatatatcggatcttcagactggtcgcagcaggttcgtgtccattctgtcagtttgatctcttttttgatcgcgatcgatcgtctttgtcatttcaaattcattcaggcgtgcctgtcgtaatcgaactcgattgatcgactacgtagagttccatttgggcttgattggcctcaggtttgaactgatcagtcatctattcatcgtcggcttgaaattagtcagccgttgttaggcaggttttgcttggactttctaggattctgaagaatgaagatatatatatatatatcctgaatgacgattttgcaaaacaaaaattgtttacgacgatcgaggaggataagtattagcattattatatatggtggtgtaattaaaaaggtacgatttgtttttcccgaaaaatatgtacgattcgctaattactaggcgatcaatatattgcaaattaaccaaaaggaatattattcgctcgtaggaggactgcttaactagtccatgaataatcaggataaggggttctgtgctgtgtcagcgtataataacagtagatgcaccgtacccgtgtaattgtgatagaacttaattaatttcaaacattatcttttactttgtttctagtactgttccggccacgtatatacccactagaccaatagtacataggtacatgtgctttgcatggtgacacatatgcatataaggttttttaagttagtgcatgcacaccgaaatattattactcaattattttgtataataagactaggtatttgcttgactctttttcctaaacaatatggatgttgatcttcaaccagttgctttcagtcttgatgttgcttgattttgtacggatactctaataagtcaaagatgctttagctgcttggccagccaataagaaacaaacaaacacaccatggatcatgataaatatgcattgctactctaataaggaactaaggaagtcagcaaatgcaggtgttgtgtttttttttctctgcatggtcctagctgtttaattaacaactagaatgcacactataaagggaggaaaaggaggcagctaacatgaaagtatctcacaaagtcacagctaatgtgctagtcaatttgttctctcacacactgagaaagatgttttttttttagaactgagaaagaggtaaagactccctattagggggttgggtacaagtatagtaaaatgaacatggtgaaaggagctcacaaaatggtagttagccaccaaattttttcaaacatttagaccatccatgcatatgtttagaaacttatctggattgttccagatattcttaaaaatattcttttaatactatggttgtaccatagcacatatatcataacgcaaagctacaaaaaggcagtgaccatctatcctctcatgtttgacttaacaaacacgtacacaaaaacccaaaaaatgtgaaacaagcaagaaccgaaggagctgcaagccacatcatgccttgcattgtcaccaacaaatcaataaatacctttcaaaataaatagacaccagacatatttttgtgtcactagtataatacaagaataaatgaatagacaccagacctattattgtgtgactggtataatgtatttatatccacaccaacatgatagagagtacacgttacacgtactttgttttggtctcatctgaagtctgaaatctgaagcaaataaacaaagaattgcagagaagaaaaaatgtgctctctttgtgttgaccacttagctcatccatggagataagcccagaggatgcgtacaaagcttctctcctccgttgagctgtatccatggttgttattgcaaatttaacaactccttgtcaccattgcacacagccaaaaacgcccctgtattcctgtacagaaaacatgcacaaactgtattttatttcttcagcatgtgctctgcttctgtattttcgtcagggagaaatgtctgacctttggagagaggctcagtgtttggagactgtcatttgcactgttttatccaatttggagatagtggtatgctactgtctactaccattgttagtagtactgtactgttttagagtcttggaccataaatatcttacgagtttataagtctcccaagatctttttgccgtttactcttcactgtagtgtccagttgtccactccactattgcatcagctaatcgaaatcgacaatggtgtgcaacctagtgcctaccattacatagtctcaaagaaagtgtacaattatttcagtaaaggacagatcagaaaagaaagaacataaataccagccatctgcaaaagttattacaactacaattttataataacttctttaatttctctctgcatggcttacattacattgtacactctgtattccttgtggttgcggctataataggagagcacaagagttgtagcttcccttgtcttgctcaagtgttcaattttttgtgtgcgtttttcagctcgtgtgtgattgagaagtacacaaggagaagaaggagaagacgacgcagctgccatgggagaagagaagcagaatgacgagaggaagaacaagtacgccgtcgggtgctccatcatcggctccatcatctcggtcctcatgggctatggtaaactacattagaacacctaattgacatgttattataacattttcgatatcggtgattttagtgagatcagtgatttaccgccgatctctgtctcgttcagcatgtacgtgttagcgggattcacgtgtcacgtgagtgcggtgtgtgtgcgcgtctttcatgtaatcgcgcgcgaaaaaataaagaaaaagaaggaaaattggcatgatgaaaaataattaaattgcagacactggtgtgatgagtggggcgatgctgttcatcaaggaggacctgaagacgaacgacacgcaggtgcaggtcctcgccgggatcctcaacgtgtgcgcgctcgtcggctccctcaccgccggccgcgtctccgactgcgtcggccgccgcctcaccatctccctcgccgcctgcatcttcctcgtgggctccgtcctcatgggcctcgcgcccaacttcgccacgctcctcgccggccgctgcgtcgccggcgtcggcgtcggctacgcgctcatgattgcgccggtgtacgccgccgagatcgcctccgccgacatccgcggctcgctcacctcgctcccggagatctgcatcagcttcgggatactcatcggctacgtggccaactacctgctcgccaagctgccgctggtgtacgggtggcgcgccatgctcggcctcggcgcgctcccgagcgccgcgctcgcgctcggcgtgctcgccatgcccgagtccccgcggtggctcgtcgtccagggccgcgccgaggaggcgctctccgtgctccgccgcgtgtgcgacaggcccagcgaggccgacgcgcggctcgcggagatcaaggccgcggcggggctcgccgacgacgacggcgccgccgccaacgcgggcagcggcggcaagggcgtgtggagggagctgttcctgcacccgacgccgccggtgcggcgcatcgtcatcgccgccctggggatccacttcttccagcacctcaccggcatcgaggccgtggtgctctacagcccgcgcatcttcaaggcggccggcatcgccagccgcaactcggtgctcgctgcgaccatcggcgtgggcgtcaccaagacggcgttcatcctcaccgccatcctcctcgtcgaccgcataggccggcggccgctctacctgtcaagcctcgccggcatcatcgcctcgctcgcctgcctcggcatgggcctcaccgtcatcgagcggtcgccgccgcaccactcgccggcgtgggccgtcgtgctcgccatcgccaccgtgttcaccttcgtcgcctccttctccatcggcgtcgggccgatcacctgggcctacagctcggaggtgtacccgctccgcctccgcgcgcagggcgccagcgtcggcgtcgccatcaaccgcgtgatgaacgccggcgtgtccatgacgttcgtgtcgctctacaaggccatcaccatcggcggcgccttcttcctcttcgccgggctcgccgtcgccgccgccacgttcttctacctcctgtgcccggagacgcagggcaagccgctggaggagatcgaggaggtgttcagccaggggtggcgcgcgcggcgccgggcgtcggcggcggccgtcgagatgccggcctccggcggcggcggcggcggcggcgccccgatggcgtagtgcgaagtgcaccgcggtgcgcgtgcgtgaacaaagtgcaacgcacgcgtgtggatgacgtggaagtgtttgtcacttggggaaaagaacgaatattcgctagctagctagtggtacagatggctagagattgaaatggaagggacctgatactactactgttgcatttgtaggaaacgactactagctaacaatgtcattctggtgtcgtgtggtgtttagaaaaaacaaaatcgttgaaatacagtaaaaaaaattaagaaaataaaaatttgtgctacagcaatggtaatagtcatcgggtgtcaagaacaaaaaaagcatttcataccgtataattacaggtggacaaggaatggaccagcatgtccctcaatgcggctcaaatagtcacattatttactgaatttttgtcggacatactccaggccaataattctggaaacattggtagatttgttagagagagagagagagagagagcagatttggtgcctcatctaatctaaatgctaaccttcgataagctactaaagtccaggcgcacagcgtattgcatagttaatggttgggccaaaaaaacgaagtgaaattggaccggaagttaggagatataggaataagttcacctaccgtcccttaactttacatcaggtctgtctgaggtccataatctccaaataccataaatcttcacccctaaactatataaaaacgtgcaatttcgatcccaagatagtatggatccgtggtttcactgacgtggcatcctagccagcaaaataaaagataaaaaatttatggggcccacatgtaagtgagaagggaaaaaatgtagggcccgcatatcttctttttctcttttcttctcctctcttatgttttcttacctctcatctcttctcttctcttaaccggtggcagagaggggagaggcggccggtgagcctggcgaaactccgccgcctcgagcgcctcgcaatgggagaagggaaaggggaagaggaggcagccggcgggaaatccatactgagccagcggaacgccgccgctgtgacccacccgaacagctactggcggtcattgaaggagggggtatgcgggtgggtgttggtggcggctagctctgcgaagtccaggagacgggtgtgggcgaagcgctggtcatggtagtaggcatcggtggcagcagagtggcagcggagggtgaggtgggcattgtgcctcgtcaattccacggtggtggcagtagtgcaccgctctagagaagcacctcgtccccgccacctccaacaccgatg

SEQ ID NO: 76194 - DNA, 3248 bp, Oryza sativa
cttttccaccactcagcaataagctaggacctggatacataagccatgaagtaaggcacaccatcaagtccatactatcttgaaagaacaaaacgtccaatttgctccatccaatcagtcatatgaattaatcttctcacgtaacagtgatgcattaaccccaagaagatgtggacttaactctgacactgcctttaagtcttgtattgagatcgagttagggcctgtaggtataataataccctgcccatgcacatgatttttcagtgatacgccatttattagcttacgtgacaactgctgcttcagtgatgcatggcttagtttcccaagctgtgatcttgttccaactagctgcacacaagatccaatcaactgctttaagaaaacatcaactccattattcaacaaattagcacattctactgagaccccttccaaacctgctgcttctgcaactttttccatcctcttactcagtagcatagtatcacataactcaccaagttcatagcaactaacagagctatcatttggagggacagaagcaatggctgaagattctgaatcccaccaaaattaactggggaaaattgaatccccagtggagctcgcacgggaccttggatacggtgtatattttcacctcccgagttttcaccataagatatagcagaagggccattgctgtgtgaaggctcaagaaaactcggtggctccttttcataatgtaatcgcttgttacgtggctcagcatgctcactgttctgaacctgttggcatctcttcagatcactaaaatttggagcaccattctccctgataataggcgctccctcctgctcaatggtcaatgatctattgtctttgacatgctggattgaaacattaccattgttccaaacaggatgaagtatctgttctgatttagaaacatctcctgctaacttgggcgcatcaattgccggtggaccatttgcacggcatgcattgtggagaatagaacggatgaggtgattgtgcaatgggaggttctcacggccaagtgtcacaagacagagcttatcaaactcatttttgttcaattttgatgataagaacctctctagatgctgaaagtatttctttgctcgccctggcccaatcctcttaatgatgttggacttaatctcacgaaggtcaatacgagtgctctgtcctgccgtggatgacggtaatggttgcacagttggtgcaggttgcactgatggtggcgtagaggacggcatgtcttagaaaagatatgccatgtaaatgtaattgaaacacaacgtagaatctcagtaaaatctccaccaagtagtgtagccctcctccaattcgacccctcttagtataaagctagccacaaaatgtactgcagtgaacaaatctctgattaggaatataaaatatgtaaaataataaaaataaaaataaaatgccagtagcacattggattatccaagaacaataaatcagtgaagaaaatcttctacgtatgatataatgccagctgctttctccttttacaatgaactgaatactgatgatggtggttgctcaaccaacacctggctcaacaagaatagaaggaaagacttattgaactacttggctataataaagcctataagtaaagactggctaaggacctgattcccctgtaaaccgtgcatggcctgcctcatgcagctcatgccatttgaggtgcccagctcaccattcattcacagattctgtaatgaaattgagactgctcgatttttttaaaaaataaagtgaggatatcccttctagggtaggatgtttacttgaaaataacaatcgcctgttccagtagcagtggccagtagacttgcacaacaaaactatccttgcacttcctaatcctacatgtaaaagttaaaaacaatctctaaaaatttggagatacaggggagggataattcaatagcaatgaaaattttagaaaaaggaaactccgtaccagcaataatgaatggtaccaagcaggaaaatcactattcattatgtctgtctttcatacatctttcaaatacaaaatcaagtttgaccttggaattctacatggatacaaaattgtctccctaaatgtccaaattttgatttttgagaacttttacacgtgggaagcagggaggtagcatcatatgagagggaagcaccaaacatctccttgatgaaggctcctccaaaccaatacaatgtgaaatagggagcaggaaggagatagggatgagagacaagtggggctgactgccacaaattacttttaccaaggttatttgataaggccaaatccttgtaaaaagaaaattacttcactaaaatgtgttaatgtcctttcaggacaaatagttttgtaaataaaataaagaacgtaattcctcagtatgttctggatccttatagaattgtgttagtgttggcatttggcaaaacttgaagaagtgccagcaaattgtgtggtcattgaaatcaattagtactagcttctaggtaagataagcacctattaaactaacaaaaagaaaggaaatttgatattggcatgtatcatgtacaggaataaaaaaggccactgaatgggtgattctaaaataagtgtttaagtttgaacggccaacctacatgggttcatgtgccttggaaaatcagaaattcaggattccgctcgttcggaacatgatgttttttctttaataaaacgaggtaaataaaaaaattcaccacaaaaggagattgaaaataattaataattgaaatacccaaaccagatactgttcctaaaaaaacacatggcaaaaggcactccgcaccaaattttgcgcactgttcataactataaaccattcgagaaaaccaaccatgaagaaacaatatgaaatggcaggtcaactgtacacgaagagtaacttccaaacgaaacctaaaacagaacagcagaaacacagagtttccctgctccaactatgcagtttttgcagaccctgcaaaaaatccaagcttgacagcaagctttcctcatgtgaatacaggtaccacccaagaagaaaaactgagacatcagccaactgagcaagatcacataaaattgtacctacaatcgccccccccccccccccaataaaaacattgtacctacaaaacaagaaaagaaaatcgccaactgagatgcatccagctctccttcactcacaactcag

SEQ ID NO: 76195 - DNA, 4899 bp, Oryza sativa
atactaaattaagtgtatgtttgaacagccgtactccatgtgcctttgaaaattaaattcaggtttccgcttgtttggaacatgatgttgataaaacaaggtaaacagaaatactgtccatgaaaaaacacatgccgaaaggcacaacacatcaaattctgtgcagcgctcatcaccataaaccatataagaaaaccaaccatgaatgaacgatatgaaatgccaaggtcaactgtacactcagagtaacttccaaacaaaacctaaaacagcatagcataaacacaagtttccctgctccacaaaattcaagcttgacaactaactttcgtcatgtgaacgaagcctaccagaattttcctatccagaaaccatgggaaaaaaactgagaccagctgccacctgagcaagatcaaacaaccttgtacctacaaaacaagaaaagaaaaatctccaactgagatgcatcaagctctccttcactccaactcagtttctcccgattcgaacgagtaagcaaaggaaaggcttcacactcgaattaatcaaattattgtaactctaacaaacagataaccgaaatcacaagctccaccgggtgactgaacgaactgtggacatagtcacaattcaaattttatctccaacttacatggacacgagctcctctgatccagtgccccccattacctcaacccgaaatccagataaaagctagggtttcgcaccaaattcaaactcccgagctcatgccgtcgcaccgagctaagggaacatccccaaacaacgaacccgcgcacatcctgaacctgacgagcaaaaccgcgccgcccccgcaacaacgcgcagctcaaaccaaatcccagcgcccccgtccccatcccctctgatccaatccggacaaccccaattccgccccgggacctgcgtcccgcccccgaattcgaactccccggcgcccgaatcaccagaacgaagccccgccggcgagtggcgcgccgccattgccgccgccccccgcgcgcgtggcgggtacatggatcgaggcagagttgggggtggagggggattttgaaccggaggggggtgggggggggggggggactctcacctctgctgcagcttccgcgcgcggggcgcgttggaacgcggggggaggcggggaggcgatctccggccgcggctgctgctgctgatgctgatgctgatgccgctgacgctgacgacgctgctgctgacgcgtgcgtgcctcccgaggcgcgctgcccgtcgtggagggaggggggcctgcttgggtggccgggggttagcacaagggggtagtgagtccgggcggcgacggcggcggcggaggaggaaggcggccgcggcggaggaggaggaggtggaggttgctggctgctgcgttggttggggtggtctctctcgctttggcttggggtggggcttgtgtgtgcagttgtttgtctgtgttggtccgtctcggcctcgattcgatgttgtagtgtggttcttccttccatccatctcctttgccttgcctctctgttgttgatctatccatctgatgactatctatctgctgtcaacttcttctccctaccgttttttttcacttttattcaagtcacctttggtgtggccagatgagagtattaggttagtttagtgcttgtaggtaaaggattttcgtggttgctaaaagggatatatgaaaccattcttagccgtcggtcgagatagatcgaacggccggcaagacttcagtatctcctagcaccactcctccatcaataggagatacaagtgcgaaagggtactatggttctataggtattttgcggctaggtttaaggctggcatagataataagtttattctgtaatggctacatcgattctctcctagtctctaggcccccacgcacaccgccgccgcctctactttcttaagcactggcttcttgccttccctcagttgtctatcttacatcgcctatgtcctctccccagtcagaagtacaacaacggcatttgtgggcaagtaagcagtttagatctaggatcctatttgattactttctccacctctaaggacatgtcatggtgctcatatgtagctaaagtttttagagtaggccagagttagtttaaatttaggatacccatagaaggagaaaatcaaataaatggatggtattacagctcaaatatcaaagggattgtcttgactaatcaggatgtaaagctttgaaaaaccaaaatgttgagtgcccttataaaaagctctagaaaattaaagcaccaccaaaaagaaagtcaagatattctcttactacttcttaaaaaaagatgacaccgttaagaggatggaagaaagggactaagcacaatcaattttgtactccctccgtttcataatgtaagacttcctagcattgcttatatttatatagatgttaataaatctagacattatgtgtgtctagattcattaacatctatataaatgtgaacaatattagaaagacttatattatgaaacgaagaaagtaatatggaagagtttgttaaacatttatttacacaataccttatagtagttcattttatgtggattgttagtggagtgtgctttaaatattgtaatgatacacactaattgtttggagcatggttgcacaaatctatatgttctatatagatacaacccactaaatacctaaacttcaacatgcaagtatagtaattattatatagggctttccgatctttcaatgagaagaggataactttgattttggggaggagtccacattgacagtctaactacaactaccacacagggtgttgcaccatagcaactggtacaccaatgtctaactacaactaccacagggggtgttgcgccatagcaactagtacaccaactctgaattgttgttgttcttgttgtgccaagaacaaccttgaacctactagcaatcgaagaacaaagcaagaacaaattaacaagaaaacagtcacaacacttgctaaatatgaaattgacacacactaagttgggaggggggtgaatcaagtatccgagttgtctaactgacacatatgagtacaatgaagtagctgaagctaaactttcatgtaaacaaaattcaagttgcaaatggtagctacaaggggtttatataggtggaaaatcaaccgagcagagtggtaggagcaaaccctaaccttggtggatccctaatatgctctactgaatacaagacccaagcccaagttttttgtctagatgttgtttcgattattctgggtagctttgctcaaatctaatggtgaggatggactaacttgagagtaaacaacaatatcttttaaatgagtacttgtgaggccaaaacggaacagtatgcgaattccacggtcgtttgaagttagttttgtctcagatggccgaattggattccagtgtgcgggggagttgatctccatctcttgatgtgtcataactgatgtgtacatcttccatatatatgcaaccccaaccatgtaggttacccctaaacaaataaaggtatatatctccctcattagttggtgtcatattcttaatgcaatcaaatgagagcttgtgatgaaacgacttcatccgatgatatatgatgtgagcaacgattttatgcatatttgtcatggtcacatcatcctcccttaatttctttatagaaaactatcgtcggttttatatttatgtggtggttgttgtgtagtgcatgatcttgcccatagaaatgtgcaaatgaaaagcacactaaacttttctcatgtaatatcatcaattatttttcaaatagaatggttctctaataaaatgaatgtacatggcaatggagatgcacaacaaaagtttatgaattacattgaaatcactctcccgcaactcatcttgcaccccttcatagaagcaaagtactcatatcgtgcatctaacttgttgtatgccgacagagtcgggtgatcagacccctcctcttcttcaaatgtttcctcaaatcaaaactacaaaaaaaaaacttgagacaatatatctctttagtttgctattttcttgcacaaccataggaggtttcaaatctaaatatgcataaactctgtgcaccatataaattgctttattactatattgcatcatatcgtgcatccaactcttggcagtgagtgacatctccattgcaatctagtcgatggtgaagagctcacctgacattggccgacacgtcgatggcgagcttgggagagcatcactgacagcaacttggcatggctagtcattttgtcttctgcattgcctaagaggatggtgactccagcagcaacctccggactccatggatggacaccatgaacctgtagaaaagaaggaaaaaacgtagtgtaacatagaagcagattggagtgcatggccttctctactggctggctgttcaggtcatgtgcttcattgcctctacgacatgtttgtacaagcttgttgtttgtgtgagcggtcgtgtgccgcccatggtgtaaggccttcagccttgtagatgccttctgtttcactttattgcgtctccctcctctgtatgtgtgtgatggtctaccttttatagtgaagatgaggcggttcccatccattgcgcatgcatggctgatgtctcaattcatggctagctaattgcctgagttttgtgatttgcatttcttccatgcgttgtgattcttccaattaatagggatcctactcagcataattccatccgagttaccggggcaagctcctttccaacctggcgtgatacggatcgattatttccttgtattcgtatacacatagtgtacaacaaatctcgctttt

SEQ ID NO: 76196 - DNA, 3866 bp, Oryza sativa
tgtggatttcgatttgaagtccagcctcatcacgatggcgtaggctagcccgttctgtgccaagcctaatgaggatgccaatgctcatatgcaacagttcctagagatttgtagcacgtacattatcaagggcgtcagtcccgatgccgtcaggctgcggctgtttccgttctcccttctcgagagagcgaagcagtggttctatgccaaccgtgctgctgtcaacacctgggacaaatgctttacggcattcctctcgaaattcttcccgatgggcaaaaccaatgctcttgtggaaggatttccagtttccagcatacaagggacgagtctattccggaagcatgggaacgactgcaggagtatgtggccgcctgtcttcatcatgggatggacgactggctgatcctgcagaatttttacaatggactcaccccaaagtcccgcgatcacctggacgcggcagctagaggagccttcttctctaaaacagttcaaggagccgttgaattaatagagaagatggtctccaatatgggttggagcgaggaacgactccagacccgtcagcgaggcatgtaaaccttcaaggagacggaattacttgctgccaagctgtacctcctcatgaaacgcttggacgaccacgagaaaaggccacaaggcaccgtcaaggccttggactctcacatcacgtgtgaggtctgtggcggcacggatcattctgggaacgactgtccggaaacctgtgaggaggcgatgtacatgggcaacaacaccgggtaccgtccacaaggaggtcaggggtggaaccaaccacgcccatattatcaatgaggtaaaaacaacggtaacttctctaaccagccctccttgaaggatcttgtttttgcgcaagatgaaaccaccgatgcactaagcaaaaagcttgctgctaccgataagatcctagagaacataaaattcaaattagatggctttgcctacgcatttcaaaactagatgagctttaataagatgaaagaaacccagttagctcagttagcatccttagtccctgcaactgaaactgggaggattcttgggcaacccgactcctccattgaaaatgttaaggcaatcacgacgaggggaggtaagtccactcgtgatccgccgtatcctaaccttgcaggaactaatgggatatcaaaagaagcgtcatctaatgactcggctgacaaggagattcagccagaaaagaccgtgccgcaggagtactgcgacacgcggttgctgctgtttccccaacggattaggaaaccgtcagtagacgagcagtttgctcgttttgttgaagtaatccaaaagattcacatcaacatgccattgttggacgctatgcaaatgccgacatacacccgttatctcaaggacatactcaacaacaagagaccgctcccaacaacggaggtggtgaagctgacagaacaatgcagcaacgtcgtactcaacaagctcccggagaagaagaaagatccgaggtgtcccatgatcacctgctcgattagggcacaacaattcgaccaggccttgtgcgatcttggagctagcgtcagcgtcatgcccaaaaggcgtcttcgacaagcttaacttcatggtgttgtcaccgacaccgatgcgcctccaactggctgactcgttagtccgttacccggcaaaatattcatgtggtcgaagtggagccacccaagacggacagcctggtgaaattcatgcaaaacttcctggagaaggaaacaacaatgcctaggaaccgctattggaggacgtcggtaaaatcacctgtaccggccaagaagttagagcagccggctcagaagaagccatcttccgcaccaaaatcaaagaaggtgtggaaggaaaagccgaaaacgcccgctccatcacctccagagacgggtagaaaatccgtgaactaaaccgaaaggaggtacggtcttgcacgtcggactttaaatgacgcgaccttcgccaacaggtaaattggtatgtatccgcatatttgctttcaacaatttgaatttttgcatcatcacatatttgaatttcatatttgcatttaggatttttgaattttgaggaaattcttcaaatgaatttttcaaagcaaacaaaaaataaaattttcaacaaaaattgactgtgccacgacaacactgaccgttggaatccaacggccgaaagtggggccggttgggcccaccaggggttcggccgaaccggccaggcaacggtcggctgcctcactttttgaggcaacagctagtgggccccacaggtcagttttgaccgttgtgggtgcactacttaagccaaccgaccgggagaagggacttcaccccatttcaacacattttcatcccctctccaaagtttgctatcaagttcattcaagctttgatagtttccctcaaattcaaaatagtttagttgcatatataaaagttgctttggtgaaactaaccggcgggtgaaactcttatcattcctaacccccgccgagtttgcatatgcaattactctatgttatgacgatgatattatagtagtatctggtagtttaggcgtggtgtctagattacgggatatcattatttggggttatatattgcggatgagaggtgggccgctgatggtgacagctcattacgggtattcctccacaccggtatataatcctaagttaattccctggggagggtatttctccgtatttagccctggttgtatggtcatgacgggctgtcgtaaggaactcgacagtctggggtggcttctcgaagtaccaggagggcatcggatagagggtattagctagtatatcggttaaccagaatgtatgtataccatgtatattagaagtatagaaatagattatatttctcttttctgtccacttagcttagataatatattatgagaatgagtagctaaaacttgtgtgtcactctacccttgtattatcttaaccactgcttagaatatgattatcacaagtaatatataaattatttgtcaagttctctacatgatcttcccatgggataaaataaatacgatacccttggaatactctcggttgaaatgctacaatggtatatccgtgcgcttgcgaatgaactctgtaaccataatatactagaagtattactgcgcaattgctgggaattatatttatagtaatgttaagaaataccaacaacgggcagcgacatgcaccaccggcgatgggtgctggcgatgcacgagcaatggcgggaggtgcggggcatggtggcgcacgcgggatgctgcggctcatgtagaaacaaaaggggagaggggaaagaggaagtcctgtccagggaaacagcggtgaccagcgcagagcgcgggacgatggcaacgttatgccaaggagcagacgggctacggcgagccgtagaggaggagatgagaagggtcaagaagaagatcacttgcaattgaagaagagtgggttccggcgacggggagcgatgaccgaacggtggccgaggggcagacaggctcgacggtggtggcgacgcagctaggtggtgaccctagcgctgtctagtggacaactggaggagagcgatgagtagtggagctctctcgatccggagtttgaatctcttcattctcgacggacggctgctcaggaaccttttcatcaatcgagctagcagaagtggatggttgagcgagtggcttcatcgttaaaggttcctctatcttggacactgatgccttcgactggttttcattggtttgcgtcatgaagatagtattttctagaatgcgatcctacattattcttcctt

SEQ ID NO: 76197 - DNA, 2056 bp, Oryza sativa
ctatttgtatctaacaatctattatgtgttttgatttcaggaaagtcagactttaagactttgtcgcagactctacaactactcgattactcgagaacggttgctggagtttgacaaggattacggaataaagcgatggtgtacctgccgagacgaaatttcttgacttcaatccaaattcttgattacggcaagataaagaattaagtcgtatactccgcaccttctcggtcatccgagaatgtcaagcgagcacggcaattgttattccaaggtcttcggtcgagaacatcaactcattcatttgcattgaagtcaggagctactgttagggttatggataccacatatccaatagtaatcgactaagctcggaagggcccaccatatatcaaatcatatatggaatcatacctcgtatataaaagaagttctagataaggaaggacgagtagagttctatatggaaacaataaggactactcgaatcgtatccatacttgtctccctagttctacttggacaaggggacatctatgggtataaatacacaaccccctaggaggagggaagacaaaaaacagagacaccagtcagaataaacaccaacacacggcgccaaacattgatattggagatagcctagatggactcaatatggtgcctgcggaggccgacaagaggaatctagtgctatataggatctcgacgagttcgtactcgaggaggaagactaccctatcgtcgactacgtgttggtgatccatgccgccaagttgacgacagctagataggttatcccaattattgtacttgtgtgattcaaatgaataaagagcaacatcggcttcgaccaactggagtagggtcgttaccttcgtgtgaaagggcccgaacctacataaaaatccttatctctatttcttttacctcgacctcgcatataccctggtaccaacgatccccataccatgcaaataccttagttgtgacccaaaacgtcgacagctactttatataaatctgtgatccgttagatcattggtttctcttctttggaacccacctaatgataactatcatgtgttccctttctatgggcaattaggattgctttatatatatatccgggtgaatcatagacccaaaagtgcacacgggtgaatttattcggcctcagtgcatcggcaaaactagccatattaaaatcacattgcctataataaggtttttggattcatatattgatttaatttatttcataaataaatcatgacattacatatgtaaactagcataatcatatcatacaatctttggaagatcggttgcacaacaggaatgactcgcggtatcgggcattgacgacaacaagcaacacccgagagaagaggaagaagagccattgtggaggaacagcaaccagtcacgcaaagcgcttgcaaaaacattattgtcatcttctcctggtgcaggacgtcgaaggcgaaggttctggagagttgctctctcgattgccggtgcacgccagcgagcgggatggagtagactacaagtgacggtgcaatactgaggaggaggcaaaccctatattgattttgtgtgtgttacgtggaggtggcggcgcctgcataatcttcactccgctcctcgcaccagattattcactgtgtttctaaaaacaaaaccgaattttgtgcagcaaaacaaaattacaaaagaatactgtatctgtgcaaaagtgagggaccaattttgacgaaccattcgacacgcatgtcaccacgtatgcgccgcgcttgtgtattcccgttgttctctccacctcacacggtggcggccccagggttttaaacttgtgtattagaaatggggagaggaaaattttttgttcatacacctaaaaacctaataactagcttgtatagtatcacacactaataattatataatatatagcgtatataacataaaattgagtattagttcacacaatgatagaattgatcatcatgtgaaattgtttaacatatagaaatactaataataaacatat

SEQ ID NO: 76198 - DNA, 61867 bp, Oryza sativa
tttgtgaaacaacactaccaaaatatatgtacttaagtgtcaagtatcaaagtgtgtgcgattttctacaacttggaccataaaacgtgtagttttgtgaaatttattcaaaacataagtatgagcgaacgacggggcagttcgttttcaatcgagctcttgagaggaacggaggaagcaatttgaggccgttggatccatgatcaatgcttcagatggcacgagaatcactcgcctctctctcacctcttcttcctcagctccgttccctacttccctccctctccggcgtccgccgccgccgccgccgccgccgcgccggcacaccatggcggcttcgccgtgagctcatcatgagcttcaagcacggctccgactccgatatctccctcccgcaccaatgccagcctcctccctccgcctccgcgccctcctcgcgtcgccggcaccgctccccgcgcgcgcgctcctcgccgcccacgccctcctgctcacgtccggcctcgccgcggactccgccctcctcgcgcacttcgccaggcacctcgcctccgcggccgcgcgctcctcctcctccgccgccgccgcctccgccttccgcgcgctgctcctcctccgcccgcgctgcgcacacccgttcaacgctctcatctccagcctcacccatgcgggcgacccctccgcggcgttccgcgccttcgcgctcctcctcgtcgcgtccggcgcgggcgcgggcgcgcggccggacgggtacacgctccccgcggcgctcaaggcgtgcgcgcggctgggcggcggcctccgggagggctgccaggcgcacgcggtcgcggagaaggccgggttcctggggcgcgtccctgtgcagaacgcgctggtcacgttctacggtgcctgcggccagtgtggcgacgcgaggaaggtgttcgacgaaatggcagagcgggacgttgtgtcatggaccgcgctgttgtctgcgttcaccaggggaggtatgttcatggaggctctcggggtccttgctgagatggacgttacaccgaacgaggtaacactggcaagcgtgcttgtcgcttgtggaaatctggggacggcacgggctgggaaggccgtgcatggatggtacttcaggcgggagaaggagctgaacctaattgttggcaatgctctgttagatatgtatgtcaagtgcgagaaactggatcttgcaaggagggtatttgacatgcttttggcgagggacattgtttcatggacggttatgataagtggcttggtgcagtgcaagcgtcctagtgaagcattggaggtgttcaatgcgatgcagatatcgggagtgaagccagacaaggttgttctttccactgtcctctcagcttgtgcaagcttgggcgcactggagtctggtaggtgggttcatgagtacatagaacggaagggcatcgagtgggatgtgcatgtggggacttcagttgttgatatgtacgtcaagtgtggatgcttggacaccgctgtttccatcttccaagagatgcccctcaagaatgtatcttcctggaatgcgttgatcaatgggtttgcattgcatggtcgtggcagggaggctcttgactgctttgacaggatggttgcatcaggtttgcaccccaatgaggtcacttttataactgtccttggtgcatgttgccactctggtttagtgcaagaaggccgtcagttgtttgagttgatgacaaagtcctacaagctctcaccttgggaagatcattatggttgcatggttgatcttcttggaagagctgggctcatccaggaagcatatgatgtaattaaagccatgcctatgagacccggtgtgttcacatgggtaaccctactaagtgcatgccaagctcatggacgaatggatttctcgcagcagattcttatgcatatccatgagttggagtcctctgggaatgggatttatgtccttctctccaacatgtatgcagtgagtgatagatgggcagatgtagggaaggcgagagggttcatgaatgagaaaggcatgcagaaggaaccaggatccagtgtgattgaggtgaatgggaagacctgtgaattcttagttgggcaacagaaccatctgtatatggatgatgtacgtgcaatgctttccatacttatgaagcaaatacatctggatggtctctagttctttaggatttaaatggttattgtgttctgccgagatcatcttgctgcttgtgttccatttggacaaatgatgatcaacgattcttggattggttactatgtttgcatttacactatttattattcctaagctaatgtgaggattttctggtactaaagcttagcagtcaagtggtctgcctaacagtgaaatccgcaagtcagcatcgtgatcagactggcaaatggaggaatagacctgacagttataagccattggcataatattgagactgctagagtttccactatgcacattattgcaccaatagttatgcaaagttctcagtaagcctaggatgctttcttttttaaagaacatgacgtgttatcagttgcattcttcaatgatgcactcaatttgttgctttgatagtcgcttttgaacatgacatggacaacagttgttgggtgcagaatcagtaggatttcgttcctgaagaaccagataaagtgttctccaagatgagatctgaagctaaattcattcgtaaagcaccttgtttagtgcctggatacgtatcaaaggtagtagttcttaaatgaagatacattaaaaggtccaccattgaccagcacgttgcgatgtgcctgaccccattcatcttctcacatgaatatcacctcttcttgtagagggctatgaatgatcctgacttttatctaatgtaccgtctgcctccacatccgttctccctctggcaattgaagaacactgctgccacaggaggtccaagattatacagtgcggaaaaatctcttgtattgaaatttggtctccatcctggtgcataaatagtctgttgtacatattggcgaaataatataaagacaaaacgatgtatccctgcagttggttttgggctttcataactgacaacttcatttcctgtaataaaaattgttaaaacatgttaaagtcagttcatatgagtattgctctcagcctctcaaacttaaaagttctatgcatgaagtatggacatccattggtcaagtttaggttaataaaaaaatagcatagggatgctcatgttgagctcagtgcagtcagatcagacaagtttatgacaatcatagttaaaagaaattatttccatgggttgatgtcgaaggcaggacgatctgctgtttatcatctgaaatccaggtatgacattggtgtatcgttatccttcagatttactatatgctcttatagtttagttttagtgtttattaaatgtaactacaaatgatacactttgctagttttttatttttaattatgttgtcatctggaccagcacgatatgtatttgctttaaaatcttggatgacttgatgccatcaaaacattaaattcagaaaagaaaagaataggaataacccaccataactagcatttgccgattctggaatgtctgtcaccaacctgtcacatgcaaataaccataagaatagcttttgattttgtatttgtcacgtcacacacaagtggagaagtagaattgtataaaccaattaattctgaaatgtttcagattttaccaatgaaggtattctctttttgttgggttgcttggacttggcgagtcaggatccaccatcacctaaaagcaagttagcgtgttacttctagggaaaaatataactttttagttaaataaaacattatcattccaagcaaaggataaaaactttgaatttgagggtataaggtccatgaactgtgcatctcagttacttgtgttccactaagattatatggccattgctttcttaattgacacaacccagatacaaggctctccataactttgatgctttagaaaattaactttctataacactattattttgttagcttcaatggttgtgtcactactaatgcatcttcatgattctagcaaagtacagttaattttttaatgcatctaatcataatgattcagattcctatacttcatggctgacgtgcataattttgatccacaggcagcattcaaatatgcaggtatatgtgctgacctatcaaaagcaaacagaatatctttgtttacacgaaataaagaaatagaggtgcaaaggtctttttcaatccacccagtcacacagatgaagttgtacaacttacagaaagctgagaatatttgcttccagtgttctatacgtactgaacactaatagcacatgctacaggtatagcactctacacagttggatggggctcgtgtaattaggcacatgcttttttccccctgggctagatgccaaatagtattccttatgaactcaatattgttcaatgcagtaatgaggatttggacttaccagagtgtaaaggttccttatgtcgcggccagcaatttcaatccttggttcatttgctacctgtgacggtttgagctcagacccatttgttaattccttgttgttgtataggaccttgagtgatgctgatttgttgaatgggtctaagatatccccaacaacatgtcctacgacaagtgggtcccttgacatggctagtgaagattgatgatcttcaggagttgagcaagaagaggctgtgctaagaagctaacttgagcagaaatgttgaacttgggtgaactgatgagtgcaggtatgtgccctatatatactcacaatctaagtgctgaaggcattcgtggtatcaggagttgttagctcctgaagacttggaatcttaactttaaggcgtaggcaggtgtactgtattatattggttgccatcactggaaatattgtggtatgtccactctcatagcctacataaaaataaggagtgttcattgctattccacatcgatgaataaaatctgctgaccactctcacttattccctatatctgcaaccctagacatgatacgctcctgctgaaaagtagattgcctttggacttgtcttttagattgacacctcatgtttctcattctcaacaagaactttctgtaactcttcctcagtaagagttgtaggcaaatgggataagtaagcatcagccccctggtagggcaatacttgccaaggttctatacttctatctccatactgtagacaacaagaagttagagcgtacctactatttgatggcattgcagtgaggatcatttctcaatataaattacaaaagaggtttcttgagcatgattggttgggaatattggactgcaacaataaaaaagtgctagaggattttcttgacacttgttcactgtcttctaccaaatcaataattcctgtcttcctttatagcagttcttttatcaagtagatgcttgataagcaaattagtggtacagctgtgtggtttatttcagtgcatgccgacatctagaattcagaatcaagttttcgtcattcaaagattataggttagggtgggttcttagataatgatgacgatggtaaattggctttatttgatctacaacattctgttattcactgctctccaagtatgtctatctaaagttctaaacatattagtcctgttctttatctatcaagcgagattttgctcaaagactaaaacagccttctttcggaacaaacattttggcatgttttgaactgtcacaatatctgctctattgtaacaaaatttgaaaatccaattttcttttattttaatatgcataataggtggtgcagtcaattataatataaaatcagtctgctattttttttgtccaaaatatttacccttttctgtgtctctgtagttctatgatctcacccccccgagttcaagctactacctaaaacaccagtccaagtcacattccaagggcagtaggccttctagaatcattttataagttgcttgacacacaatcactcatattgcggaactgaacatctaaactcacttgtcagctgttctcaagattcaaactttcacacgaaactcagaatttcacttaagggctgttgacagtacgcatattctgctaataaactttctatagaagtttattgtactctgtacatctctattttactagttttcctgatggaatatgatctctgacaaataggtcagaatgcagcttcttacgaatactcctaggggggtgcatttgccttttgaaatgtctgccgctctgtcttccttgctttctgacagaatatgatttgtgtaatacaacgtcctaatcttcttatcatgacaggaatatgcctgcggagctgatggactctacataaagcggacgcagaaagcagagatagataaggcaaaggcctactacatttattcttgaccaacaggggcccgcggaatcccattttattcctgtaattcgcaccaaagattttatgtcaatcacgcctcccccttctgatgttatgttcccacttgcagaacgcaggccttgagctgtgcatcgaggaatcaagccactggttttctcagtcctccactcctgctggcacctaaatgtctcatcctattaagcattttgcaagataaactccaggaaggtaatttcagttaacatttatttttctcgaacgcgcaaaagaagaactgcacatcattatattaagaggaaagaaaagagttcaaaaggacccaaacaagcccagtagggcatggtttagtacaaaacggcttgccaacaaaaaaaaaatgctaatggtagttacccaggttgctcaccaaatatttcatttgtggtcatggcttcttttaggaggcggctggagggtagcaggaaaggcaaagagctcagttacgtggacgaagcgaacgtcaggttgagagttggaatccatgccccgaactgtcgctggcttgataatcttgactggagaacaattgaacaaggcagagaacaatgcaccatccccccttcacgtgggcgcatcccattcgtcgcgtgatcgataggacttgcagagggggggccgtggtcctcgccgagtcgccggcgccggattctctgtgaaaagaggctgcaaaggagattccacaaggcagaaaaatctgccggaaacggcaacatgatcgtgctgctgctctcgaccaccgtcgccatcagcccagttgatgagggcaagtgtagtacaaaacctcagcgcctgcccgctgccattggcttgctttgggtcagaaagcaacaccaaggtttttgggtctttcagatcagaaagcaacgcaaaagactggctcttcggatcagaaagcgacctctagtgtgtgctttcggaattcagatcagatatatgcgtcgacgacacttgcttcatcgagtgtatgcccttcttcttcttcagcactgttgcagttgacctgtccacataacacattccatggatatcaggccaggcctaccgtgtgtatatctgatgatggactagcagcatatcggttggcccaggtaaaactaggcatatatcgcttgtttacatagcttcatctgaagcctccatgatatcatccaatctaattttttgtatcaagttctatctatcctaacactcgtcaactccaatagcgcgggtggcttgatagttgatacatatcctgatatcaagcagattgcggaacaaacaagccgaaatttacgatgatctgtttgcctttttgttattctgctacgcgttcgtattgcggctgacatatttttaaggtgatgtatctggatcagtgatcacatcaagaaaaacagttgcgaggtcaaaagagaggagcagcttggctgtggaagaacttatgcctcgtcgtcgaataagacaggagttttgtaggatgcagaatctatgccccggaagaactagattggtaacaataatgtgtataaatgaaacgatttcatatttttcacaatgttagacatatgcgtgcaatatttatttgaaacttcaatcttctgaatatcctgataacacgattcaactacataaaagtatcagtttttactgattttcttcaccgggtttttctgctattatgcaggcccattttatttattacgagttctttttattgacagctcaagcatttttatacaaggatgcattcaggttcagaatgctgacattcttttctgtatgtatcaatacgttgtcagctaagcgttcattttctccctgtcgacattatggggcagcatatcatatatattctcagcataattcccagcaacgtgctcaagactcatgtagcaagactcaaattggcgcctccgaaagcataacctttctgaagcaatgtttgattaaaaaaaatttgctgaactaatatagaaacgattagtccgcacagcactggcctgctcagtacgtctgcatcatgatctgcccaaagatcttatgcgaccatgataatggtcatgaaccatacatagtgctttgtgaacttcacaagttgatcaataaatacatttttatgaatctatgactatgatgcaacagccacttgatgtataatccacccatttcctcaaaattatcaactactacaacagtgcatcagaatgcatctatgcaggcaccaagaaagcatatccataacgcaaaatttacatttagcagtaaacccatgaagaaattgaactctactagaatgcatctatgcaggcaccaagaaagcatatccataatgcaaaatttacatttagcagtaaacccatgaagaaattgaactctactgattttcatagtttcccaaaaggatgtatattccatgcaatggtgagccagtcagctacatatgcttactatcccccgtctcaactgcaaattgaaatcagaaagattagaattctgcacagacgcatggttttctttttttcttcaagaaagcatcttcacattctcctattttgccctcgacaccataataaatgcacaactggatgaaaggaaatatgaaccacaatacttgtttgatccaatatatattcaataacagccatacagaacttttaaattaaaaggcaaccaatatagcaacatgtcatatactactagtgttgaaggcattgcagctgcaggtagattctaggtatggtaaaaatatggtactagtatgctaaaactaattatatagtagcaaattggggaaaaaaattctgggcattaattaacttccaaaaatcagttggatggcacagattaatgtttagcaaggcatgaaaaaccttctggatcaaatatgaagctaccagagtgaagtaagatggcaggcatagctggtgaaggatcttaacacaactcaccttataggcattttctttgtgatataaatatagaggttctataaacaggactgaagtccgtgacatgctgagatcaaggactcagacggtacaaactggtcaacaaaatgttgtcaaacatttaactgtgagataattacagttgataatatcagttcaaatatcattcaaataatcattaaaaatttgagaacgaacaaaaaggctgatagtatatctccattactctatcactgaagaagaaatttaaggaaatagaagggtgaaaatatcagttaatttgatgaataaaggaactatgaaactttgagattattttcagtcaaatgccttttgtataaccatcgttgccttatatacaaatgttgaacttgataaccatagcgagattcctttgtggctttgcccatctgaagatgaatcagctatccctaaataaaattgaaagaaaaataaagggtcagaaattacaaaggcaaaggagttcataaacctaaaaaattgcctgcccatattgaaaaaataaggtttatgcatacatggtacatcttttcatgcaggattgttcattctgtagtgttattccatggcctccgagttatttttcttgagtcatcatgaattgcactttaggtctctgagtcaccacatctcgcaacaatcttgagatacaagaacatgactccttaggtggaagtgttgtcatttgcatgatttatgatgcagtaagacaaaacagctctagcctccatgaaaagatttgttaccctgccagttcacaccctggtccaatacccaatattaagtagtggtacaatgcaaatcacccaaaggaaaaaagaaactgaagaaacctattgtaataaagctcaaaatgtgaaatggtcatattaacaacaaattgtggaagccgttagcagaaaatactgtactgatgctcttatgtcaggatctacgattcataaaggtgtatcaaaatcaggagtgtaattgtgcacaaatatgctgcatcaacaaaatgctgcccttacccaaaatacaatacaaagaaggatatttaagcagatcagtataccactattactgaatcaagtgcaattctctatttgtaaaaaataataatgcaaagtaatatttcagtctagagctgctcaacaaatggttgaatagcttacaggcatatttcataaaataacactgtcaaatttaataggtgagtgtctacatattacagcagtcttgagattacttgctgatgctgatactgtgaaagaactaaatgaatcccctaagtcaacctgtggttctatattcttgccataaccaacaacaataacaacaaaggtaaatagaaatatttgagtggtatatgaaagaagtagaccaacctcatgacatatgccatagcacaactggagggcttcgtcccacttttttacttcaactaatccctttatgaggcaaacaaagacacttaactcaggtacaaagcctctccttgtcatttcactatacaatcgaaatgcttcctcaacttgagatgctaaacaaagtgcctggatcaatgaagcgtacatgtcattgtcagtttttacagatgacggaacttccatcatctctttgtgcaactccatagctatctccagcctgccagctttggagaaacaatcgatcagcattccataaacaggtgcaattggtactgtgccatatgattccatctcctccagaatacccagagaagcgataaagctcttgctgaaaccttgaattgcacaacggtatccttgtaagtactttggccagtaagtctgcttcatttcaccaagcagtaaacgagccttatccaaaaggccagcagcacacaagtggtttatcagaactctgtacgtaacataattgggagaacatccttttctgctcatttgtgtaaaaaggtcaagactcagatcaatcttgccagctttgcctaatccatctattagagcagtgtaagttacaacattcggactgcatcctttctcttccatcaatgacagaagctttagtgccttctcactttcacctatcctacaaagaccatcaatcatagctgtgtacgtaacaacattaggagtacaagaatcctttaacatctgagagagaactttcattgcaagatcaagtcttccatccttgaacatcctgtcaatcaacgaggtgtacgtatgtacactgggaaggtacccacactttgtcatctgcagaaatacctcctgagcactgtcaatttttccagctttgcaaaagccatcaataagagcatcgtacacaatgtgattgggctcgcaaccagaagataacatagcatctagtaattcatgagcatggtccactttgtgagctttgcataaaccatctactagtgcaccatatgtcacaacatttggagcaagtgtgtgtctgtcctcacatggaaagtaaaaatcagaatcggcgctatcagaagttccaattaatttggcatagacttcaaaagccttactgatgttgcctgctttacagagaccatctaccaatgcaccataagtaacatcatttggacgacagccagcatcaaccattcggtgaaaaatatcattagcctgaggtacctgcttagctttgaggtaagcatgaataagtgcagtatatgtcaccacagttggggagcaacccacactcctcatctcctcaaacaaccactgggcttgttcaatgagtccagctttacaaaagctgtcaatcaaaattgtgtatgtatacacatcaggagttacaccgaccatcttcatctcttggaacagaaggaaagctttctctaccttagtagcatggcagagaaaagtgatcaccttagagtatgtacttgtatcagggacaaaacctttcctcatcatctcctttatgagctgaaatgccttgtcaaacttcccgacaccacaaaggcatcgagcaaaattggcaacgttaaccttattaagaacacaattagcagccagcatctctccataaattttctcagctaaatccagcaaatcagggcttggtaatttctcctgaccacatatacttccaataaaaatattgtacacaacataaccaggagggcaaccacaagtagtcatcctatttaaaagtttataggcatacgcataatccttttcattgcaataactatgcacaagggaattaaacaaggatggatttggattgcagccctcagtcatcatcatattaatgatcctcttgcaccagccaagctgtttctttttcaaaaatcctgagagcaacgtcctatatgtgaccacatttggaatacatgagttgcatcgcatcctatggaggaatgacatggcctcgtcaaaatacgatgcctccatcagcccgctgatcatatgtgtgcataatactgtatcaagcttgaaatcctccctctctatcatgtctagtgcatcagcccaccgcccctctttgcacagagcgtgcgcaaagcacccaacggtgaaccggtccatgcagaaccccgactcggacatctccttctgaacccggaaccccaagtccacctgccccgcgctcgagagcacctggaccagtgcattgtaggtcaccttagacggcctgtacccaaagtccttcagcctcccgagctcctccagcgcctcgttccacatccctccgcggcagcaccgccgcactagcacattgagcaatctgccgagcacctcgcggtcctcctccccaatctccctaagcagcctctcggcatccctggcgcggccgtcgaaacccaacgcatccgcaagggcgtcgtagcatgcgcccgtgtggctgtacccaacctgccgctcggcccagaggaagaacctcgcgcagagctccggggcgtcgcgcaccgccccgagcaccgccaccacgacggagtcggtcaggaacccgcggcaccgccgcaggacgcgctccgccttgccgtcgaagtcggcgccgaatgcccggatcgccttggagatcagcacggcctccggtggcgggagggcaccggccgcggcggcggcggcgggctcccgaagaaactcgaagtctctggggccgaggcgagaccggggtggcggttgcggcggcgcgggtggctcgacgaggccgagcagggggtcctcggagtcgccggcggcgtgggagcaggtgcggcgcagggaggcgcgtagtgtcgctaccgccgccgcgcggcggcggatcatggagcggcggcgtgggcggtggcggtggcggtggggcctggagctccgtccatggaggttttgaggggagaggggattaaaccctagggaggggcactcccgtaaatatctcggtaagctggtagtggggcccactctccagtgggagaagggagtgtttctctcgctgagccagtgagccccaccacccgaagctacagcgccacacttccctcatctctctctctccctctccctctcctcctcggcgcggctcggcggcgctcccctcgcctgcgcggccgcgcagcggtagggcggaggcgccggcggtggctcagccgacggacaccgtgggttggccctctacgacgccatcagcccggctcaccagcctccgctgacctctaccgctccacagaccacagcaaggcagcaagaggtaaggatttctgaaacgaatccctttccagttctcacagtccgcttgccaattattgttgatctgaagctgaattggtcactgaatcaatggtagagtttgagatttcagaaatgtgagtttgagaatttgaagtatttgtgggggaaaaaacttgttatggttgtgcgtttcatgtatgaaacgtttttttaactgaacaactggctgcaaaatcgtacattcgccactactcgtagcatctcatgctacctgtttgacgtatttgcgcagcggagtcgacactgccaataggagttgctctggtgagattcagctttttgaatttatcggagactattgctctgatggtagttctgtgtggtacaaccgtacaaatagcctgaagtagttaagtgttttcatattctctgtgtttccctgtgcaatggtaggtgccgtgctaggaaagttgttagtgcctcgtaattgcctttgcccttttaccatacctgtgaatgacgatggtgtgttcaggtttgaaccaaccatactgcattaatgctttaggcttgaggatttaaattacattgaacagcttggagtcaatcacgttttgagtacattggaatgccataaaccactgtatagtgtatagtatactgccgtagcaaacaataagctattcccatgtcaggatgtttgatggctgtctgatggcaaagtattttcccatcaaacggaatttggaatgcctagcaggctaatgcatcccttcaatttggttttgaggcatattgtagaattatcaattttttgcattgtcactattttcatcgtctgttccttcagataatccattgatatttctgttagtcgttgtgttcattctttctattgttttctttctttcttgacttatctacttttatctgcaaacttgtgcctctcacacaacagcagaatccctaattgcatatctgtgttttattgaaatttttatgttcatgcagtgattggcacttttcaatggcatgtgcttcaaagacaatctctattggttttgccaacagtggtctatatggagaggcaaggctactgtcgccaagctacaaaaactacccaaggagatcctcttacaaatttatcaaagttcgtgcagtacagggaaatgatggtcgtcgaaggctagttgatataatccgaaccatccctgaactctctagaaactatttcagaagccggtcaaggagagctctttttggtggtatctcacttctgggaggcttttatgtggcgcagacaatatctctgtctttcggagcgttgggtgtgaacgatgtcatagcagcagttgtgtgtgtcctgcttactgaatacgtaactaagttctactacagccggcctaaggttaccttcccatttgctctcctcaacaacttcaagatgggtttcacatatggcctgtttattgatgccttcaagcttgctagctgacctgcaattcttcctattggtgctttgacatgttatgttcttgaatcttgaaaaacagcaaagatggtgaaaaaatagcatgcccccacgatgttattactgagacgagggatctatagttctgtggctttcctcagctttgttctcctatgtgaaggcaggcttgttgctggtatagtttttgagttggtggatagattttcaaagattggtccacatgtgggtatactgtagtgtgatgataacaactatttattttgagattcagattacatatgattgaagcccggtgtgtacatatgcaaatttcaagctatctgatcttgatcatctcaaaaaggctgtctaatttttaatggaacttggttcagatttaagtccattttgctggaaagactgtagccttgtgtgattttttatgctaatttcctcgacccagtaactcgaccgagttacacctaaatgcactaagcttcatctgtactctttgatttcatgtatcgaagatgcaaataatacagtagcacttgatctgtcctgttaagacctgctgtgccaagagttcatttcattgttagcaactacaggtgcaacagctttttattattattatttttgaaatggtgcaacatgtaatttgtatagtattagtaccaaccttgggcaaagtgtaagcaaacatttttattcttctcttgcgcaacgcatattatcctgacctgatccaaactttgttaaactcacgataagtttatcctgtctcaggttgatatgggctcatgtggctcatcgacctatgtctgctttgctcaacgaatatcatctataatcagtaacttgtaccatcactgagtagtatactgtatggcaactgatattttcatgccataattggctaaacattttcttatcactttagatcaactgatcaatcatgccaaggtaaccttcagattacattacacatcaggttgttgccaacattgagcaaatggtagacatggaactgtctccctcttttctctttaacaacagtagacagggatagatggctagtggccactagcaacacatgctgttgcctagctgagctcagctcatctttacctccccactgtgtgtccagccaccagcttaccgaaatgtcagagctatcctctccacttcctagtggccaagaaacttctcctcttatagagagatcaagggagtaaagagacagagagaaccaagtgttttgtgttgtagaccacactcccttttgcaaagaacacacacaagattcctaatcgtctcctctccttgctttgttgttgctatggtttgccaccatcacaagcaaccttgtgcattagttagatccagaattccagatctctcacttctttctcagtaggcaagcacataatcttgtatagggtagtatatttatttgttttcattgctgtttctgttgctctcagtccatatctgtcagtgggtcagtattgcatctgcctttttttttctctctctcttcatcgatctttatagatttgtttgggtgatgcctgggcgcagtggtttatcgatctcttccctgccttgtgctgctccgatcgatgcccgtgctgattcttgataatatacaacgcaggaatcgatcgataagcctctgcatccagatctcactttttgtttatgcgtatgagccggtacaggttgcctctttgttcttgttttatagggatataatcactgattgatatatttcttgggagtttagtttttgttctatgtgctagaagtatctcttgatattggatagcaagatttgccccttttcttaaaaaaaaaaagtggatagcaagatgctgtcttccaattaacccgccttgtgatagtttctcttgttattttatcatatccttaactgctgcgtatgaatatatacagctcgattaatggatcgttttttgtacaggcaatagcttgctttagcttaacaaatatcctcatattgctgctgccacttttgcaagcttgttttgtaaattacatttggatagttggttatgcatttgtgagttgtgacaaattacataaagttatggatgatgtattgatgttagaatagttgcctccaattgttgcttactccttttttttctttttgaaaccgaattattgctttattattggcatgctcagaacatattccactctattcatgagtgaactaaaatcaggacaggatcagaaaatcatagtctgcatttctgcaatgaccttgtatatcctttttgcctttgagctcgggtcctaaattccatgctgtatattgaacgatctggacttcagtactcctaaatgactggctgttgagtttattgcatattctgaagaaatatcagaaagcaatttgagtggcaacggtatatctacgactacttgcatttgttggattttctcttgtataaattgtcttgtctccaaaaagcattagtaggtggttgccaacattgttctgatgttttctgctgttctgatattctttgcagagaaagaaatttctactgtttgcccttttagacagtacttaatgatgtttgtttttggagaggaactttggagctatatatttgctgcttaaaactcaatcgcatgatgcttcttttgatatttctcaatttaaatggctacatatatccagttggatatagaggctaggtagaagtatcgttctctaaaaaggaaaaatgatgcttcttttgatcctttctgctgttcggtgagacctcgtgggcctcttccaaatgtttgcccagttaacctcggctatgatgcaatcctgaagcccatccatatatggatcgcaaaggataggaataagttcactttagatcccttaatatgaaagcgagttcgactttcattcttgtcccgcaataccatatacaatgggtccctcaactatcaaaaccgatgtaatataagtcccaaaacggtttagccggtagtttcagctgacgtaaacgcctatgtggttaatttgactcggtcttcatctgacgtggcacatgaatcaaaatttaacaatttaaaaattaaaacaaaatatacgggtccatataacagtcagtaaatttaattaaaaatagtgggatgccagtgagcctcacgtcctccacctgatcctctctcttatctatatcctctcctccggaagggaagatgccctcttcaagaggggagaatataaagaagaagagaggatgaggtggagaattagggcccattggcatgtggctctcactattttttaatcttattggtcaactaacatatgagtccatacaatttgttttaatttttaaattgttaaattttatttcatgtgcaacgttaataccacgtcagataaagaccaagtcaaattaatcatgcaaatgccatgtcaactgaaaccgctgtccaaaccatcttgggacctactccatctatccctaaaatacaaatctggacatatgcatgtctagattcatagtagatgtgtcacatctgatattaaattggtttttataggaggggagagtatattgaaccagttttgatagttgagagatccgttgtatctggtattgcggtttaaggacgaaaatcgaacttaatgtcaagttaagggacctcaagtgaacttatccatttttatgtttgatatgtaagcgacccatttttatgtttgatatgtaagcgaaccaaatcatttggtttcccctgcggagtacagcacagctcagctgattgcaaatttgcacaggcttagaaatgtcaagagcatgccctgtcagggtttgactagcttatattcctccctcatctagaaaatttgaagcttggagctacatcttctcccgaacaatgctgaattgctgatataaaactcagttcaactctgttattctatactagattagacatttttactgcagttgtttatatctctgctaggtaagcaaaagggccacgggagacatcaacctagccaacggggaagcaaatggcctgggtaactaatagcgtttttcgataatagactaatttttatgtgtcaacggctatcgatagaggaaaaggcagcggcggagcccaggcaggttcaggtggctctattgctgatcttacgcaagttatcactatagccgctccttttgaacagtgaaattttatatgattttcacgtgatctagctcaaatcctataaaacttctccctttcttaaggaggcttacaagtttaaagtagctatctccccgaatttgaatacaaattgacagaattattatgctcgcaaaatagaaaccgacacgaggtttaggccaacgaaacgttttatgctgcggtagccaacgagtagctagaaaacgcgagtgtgaaaggcacgcccgaattttccccttgttttaaaaagggggatttgattttatgtgcagctgtgaaccaacttggactgtatttagttcagtgcaaagtttgaattttaattgaaattaaagatgatatgactgaaaaattgtatgtgtatgacagattgatgtgatagaaaaggactgaagtttagatccaaactttaaatctaaacacaaccttgccgttgatttgagctaggttggtcttcgtgtgaaattgggtcagcgtcagcgtcagagtcagatcacatcaagatatcgaccttaaacagtttgcttgtttgtgtatgggcagaatctaggctgagggcgacaaggatgtgtggccctccaaatcctaacggtgaattgacgacagagtactcttgtcaaattgcgagaaatttgtgcaggcattcagcgtagtaatggtccaaaaacgtactccaaatagagactatgctaattatctttacaacgtactacgagtagctaggacaaagaaaccaaggtactcgtaacttcgttgaaatataatgcaacaaaagttcaaaagaaagcaaagaaagctcgtgcattttagcgcaggctttagacacgtactaagtgcaaatgccgaacgtgacaccacaactctacatacaaacgctcccgtatgcgtcctttgttgacttattagacacggctttttcgatatatatcgatggagagacgtgcggtgtgggcaggccgacagggcggtgtatgtgacacacgcgatgacgtcgatcccgtcgtccccagccaggcagccatgatcgatccagcgtttttgcacacgtacgcgccaaaagagagagaaagaaagcattttcaggaggcaaaactataatattcggccggtcatagaggcacagcgggggtgtttatctattggtataaagttttagcgtgtcacattagatatacggatatatatttaaagtattaaacgtggactaataacaaaacaaattacagatttcgcctgtaaactacgagacgaatttattaagcctaattaatccatcattagcaaatatttattgtaacatcatattatcaaattatggagcaattagacttaaaagattcgtctcacaatttacacgtaatctatgtaattagttattttttcgtttatatttaatacttcatgcatgtgtttaaacattcaatgtgacagagtgaaaatttttgccagtggatctaaacagggccatagtaagaggcaaaagatttcgcattatacgtatgtcaaaagttttgtcttcatttttttttattatggaaactttattaaaactcagtcaaatacaccaagataatacatttcaattaagcccgctcccggcctctgcataagatgcatatagccacacacaaagaaagacctacgaagacccctatgacaaaacagaaatattagtggctatcaatccgtagactagatcgccaaccatactcttgagtaaaaaaaaaactcttgtgccacctggtccaacatcgcgataccactacaatagtatcccgaagacccggtttatggaggatagcccagatgcgaagccaccggatgattaaagtaataatctgcaattcaatattcattatggagtatttttttagccataaaaacataaaaatatgtcattcaattcgtaagggcataatttcatcggatttttcgttttgctatttctgtagttgaatttgaacatgggacttcacacataggtgtttaatactattagaagtacgtacacaagttttccttttaattttcggtgatatttgctagttcgttgtgcataaaaatgcatttaaaggttgtgtgggtaggatactattggagaagtgggagcccgggttcccacctccaactgctcagggctctaaagatctccaaaacaggccacgtggggctgcatcccgctagtcacaagcgggactaagagttcagtctcttaattttgtaggctgcgccctaagatcgggtgtaagcccaaaaaaggccccaagctcggtcttctgttgactgctcagggcctctggcataccataattgcaattagacttgaaccgtcattccctcacgtcgcacggttgatctcgtatttaatgcaaaggatacgaatccggcagctatacgtggggtggatgacaagactacgcataatgcccgtgaaacaagccatcaacactcctgaattaccggggcatgggctgtcaagaaatgggattgattgtcacgtcgcttggccgggcccgagaagacacggtgcgtccagcacactgtagcaggcaagtgaatccaccaagcgtcaccagcgtcctagtcacctaccctagctaggccacgcatcgacatgaggaggaggtgcccgggacgaccctgtcacactcaatgctagctccaccaagggagctcaggtgggagctagagagattcattgcgggcactatttgtaagcatgtgataagacttcacaggtctaatttcttcgggtgtcccatttgtaagtgacgaacactacggtattcccagcgaagtcaactataagggcatgaccaaggcgacagatgaggggatcgaacttcaatagctctagcgagaaaaagtttcataccctgtaagagagtcataaaaggagatcgagagaaaaacataacatgaataggatattacgttttgagtggactcggacatgtataaactgcttgcctctctttgtctcacgcgaccataacttgcgtctgtacatctattccctggccgaatcaactaaaaggatttatctgctactcgctattggagcttgggctatcatagacagattcccatacactcttttattttacttttttttttcaaaacatgtgcagttatcgtacagctacagttatatacttaggcacaatcaatttctaccgttgtatatatacgaaatgctatatactctagatacggttaatttatacggagagtaccttcatatacggttaatttggtcagttgctatcgtcagtacgtacgacatgctgtactggatcagtagttatattgcctacccttctagaagttgcggcgctattcaattcgcgtaaccgtagtttgacctgcgttaataaaattttctatcccgaatattccatgaaggaacacttccgcatacatcatggacttgtaggtttgatctccctctatcgccttggccaccaagcaattaacaagcttgcgcgcagtgcaaggaaattacttctcctaggcgaacaagaaaaaacaaactcatgctgctggtagagatgattgattagttattcttcggttcttcaggtgttgaatggttcaaagaatgacgagaaaataggatttcgagttcacgtgacgattgtgctagttacagtatcagggaaactgcacgcactcgttttctggtttgccgtttccctccccacctatagctagcggttgaactttcagcaacaaatcatattggtcagtctttaccagtaggagtacgtacgtgactactacgtgtgggatgattagcatcctgtctgaatcattgatttcgtgatacgctgttttaaatttggctgtgtttagatctaaagtttggatccaagcttaagtctttttattatatcaacctgccatacacacatgacttttcagtcacatcatctctaattttaatccaaatttaaactttacgctgaactaaacacaacctttatacccacccggacattaaaaaaaaaaaaaggtactactacttcccgaggaggaaagaaccgccgcccgccgctcgggtcgggtcggccggtcccccacgcccgcgcgcaaaaacaacgggacgaaattaagctcacacacgaccttgtacgttctttttttcttgggaggctcacaaagtcacgatcggtgcttggagcgtgcgccgctagagatggcgcgcgcggcaggtgacaacacatcggccggccggccggccgtcggcccgtcgcgcgatggctttcacgcggatgtcacggagtggagtaggggaatttttctgtcacggggacggagtcgagtagccgacgaaaacgagcccattagattcaccggccgccgtgcgcgatgcgaaccgacgaaacgtctgttgcgaacgttggtagggaccagggagtagtaccggagtagagagatcgatccgtccggtgtttggtggataccgttcgtggtactacgtcgcgtggagttgtaggcccgtctccgttgcaggcttgcagcattgcgactctgcaacagtgtgatgggcttacatgcatgtcctgctgcttaaaggattgaagaaacaaccgtgcagtgtactatgcttgctggtactccctccgtatagtccatgagccatagtagcctagtaagagtatcattctattcgctcaaaaaataagttctgatttttatatatcatatcagataggatcaggggcggacctacggggtgtgccaggttggcactggcatatgcaattttttttgaaaaaacactagacgtagtatgcaatcaaaggatataaaaatagaatcttatcagaaaattatcatggtttgtctggagatcttgtaatcgtaaagaaatcaaatcagggaagaggaaaggactaaatgaagagaaacaatggggccaaaattcttccatcagaattagatgttttcttttaaaaaatatatatagtggagcgatcgttagaatggatacacccactgtaatttttctgggtccgccgctggataggatgtattttttcccttggaagatggaatggaaatttggatgtgatcctctacttatagagtacttagaaccggaaccggtgtagagtaataaaaggaagtgatagttggaaaactattctaatccctcgaggggatgttccctcgtttgctcaaaaactatctaaacggttatgaaaaattctggaaaaatttgacaacattcatacaacacatatatacaacttcacaaaatcttaagtccaaactcaactcacacgtcgagatataaaaaagacaaattcagcgtatgaatattagcgtactgtttatatctaaatttgtctttttttgtttctcgatgtgtagatcgaatttgaacatgaattttggtggactagtaggtatcattatactctatattgtcaatttttttttagattttttcacaactatttgcatcgaatttgaaagaaaaaggtatattaggggatatcccctcgagggattagaatccactcccgtgatagttgtactattggaaccgaacaccagatatgctaaaccataatattgtcagtcaaatagtctcgttatggtattataaatttgtatcaatatatgtaactatcagagatgattcaaagtaaaaaagtataataatttaagtacttcatgacaatgttctagcatcaacactgacaatatacaaggattaaacttaatgttcatttcattattatgcgtattgatatagcctttttttcgaatatttgggtgaaaacagtatatcacggaaatagaataaactctccactatttccgtttccatttacagacattactatatcagaataaataatggtagaaataaaaaaataaacagcaggtgatctggctaggaaattccagattattttcatttctgaaccacatatgcgtaaattgaggtccaattattatttgacatcatggtccatgtaacatttacccaaaagaaacaatgtgtcattgtcctagagcagtaatacaagcaatgtggtaagcttctgtggcaaaatcatcaactttcgcacaagatcacatgcttgtaagttgtaacacaacaaaaaaataataatccacagcaattaccaggtgaagaccgggcctacacgcaaggatttgcccggaggcttggccgtcgcccctcccacaagaggatatatagccggatgttgccgtgcactcttttcagtattgcccgcggatcacagcataagcatcaccgtaatccgtaataagagcaggtacaatagcaggctatataagccagctataaacatattttaaaaagataaaggaagagagagaagagcagtgggctacagaactgtagccagctgcagcacgggctccaaaatataatgtgtgtatgacaagtgggactaaatattaatagtatagtaagcaactattgtatgaattaactattatattaactatagatgatttggagctaaagcacgcacgcacgtacgttccccgcatccccgggctcaaaacagcgaataaatcggccccggcaattcaggtagcacacacgacacgagaacgacaaaagcaaacatggcacggtaatctcgtccacacgcaggcggatgcatccaatccaatccaaaaacgccattggaatcggtgctgcgggcaaagaaagaatagttggtggcgtcggaaccgagtacgtattcgattccacatcgatctccaccaccctaccaggccaccaccacaccaaaggcaccaacaacttccacagatgctaacgctgctaacccccccccccccccccacacacacacacacacacaagcgaacaactaaccccgtcaatctcggacaagctgcattgtgtagcaggtcgatccccatttcagccgctcacgccgccccggtggccgggcgatgtttcacgcgcggaagctgcagcgcaggcggtgatcgagcgaacggtggtggaggagccaaaatttacgacgccaccaaccgcgcgggcatccgcgcatgtgcggccgcgcagtcaccactttactactgccccaaaacacttgggatccccagtacgatgtcagtttatggaagcctgatgagaaattgagaatgcattcaagcttggtaccatcacgcatttggtactggagcagcgaccagtggagtgggtgctgatgagtgaatccgagggctcctctctcggcgtgccaatggagagagggacggtggttggccaagtgggcaccctccctgagtcccggaaaactttcactgcgtgggcagctcaaacgcatttgtcagccacatggagcacagctatggtgtcccagagggattttactacggtgcattttgcaggagtaaaaaagagtttatataaacctttttttttgccagaaccacgtcgatatagaacggtataaaccttgaccttttaaagatagtgagtataagccttaacttgccaaaccaaactttagacatggtacactttcttaatcagttgtttgagttaacgtatggctaaccatatttttcatgtgacccacgtgttaaatacaccttttctttttctcttaagcttgtgtaagggtggctatccatacttcttgtgacaagtcagtaagtcacaccttatctgggtttaacaaagttaaccatcaatcaagcgaccccagtacctcatttccagccatggattatgttttctgtttgcataggtacctcattgatggcgcaagggcacttcaaagcatttactactttgagagaatgttgcagaaaaatgtacaaaaccgtgaccatttctattactcccactgaaaggaagtaacaggtattaacatcaatggctacccaaagcgaaatggaacacatggatggacacaacattaggccaattttgctgttcatcattccttatgtacactcttcagtaatcccctagcttgcatcgttgcacggggaaatgtatccaacaaagaagaaaataaaagggaaaggggaaaaatactatacagactgtactccattaaacacaagagcaaagtcgatttatgtactccaccgcgccgtactttgtcttaattatgtctattactaatagagacccccataataattctagtccatagaaaaaaccaaaatagctatgtaattttccatttttaagagagagaacgctaaaaaagaactcaataaatacgctcagaaaaatacggagaaatcgccttctttggacggatctctcctctgctcgccatcgccgacggccagagttccacctgcctccggcgaaggcttctccaccacacccgctgcggccccgccgtcattggccgcgaacacctcgttgacgaccttctcgacgtcgagcacctcgccggcctcgtcctcgtcctccggcgggggcgggatgaacggcgggcgcgccacgcggaggatgcggtcccagtcgacgccgttgaagaacgggtgcgccttgatcccgcgcgcgccgatgcgcttctcggggtccttctccaggaggcgggcgatgaggtcgcgcagcggcgtcttctcgccgacgagctccggctgcttggagaggacgcggtagaacgtctccttcctgttcagcccccggaacggcgtgcggccgtagagcatctcgtagagcaccacgcccaggccccaccagtccacggagaagtcgtgcccgctgccggcgatgatctccggcgccacgtagtcctccgtgcccacgaacgagttcgacttcgctggcgaccgcacgccagcggcggtggaggacgacgcggtggtggccgtcgaggatgaggacgaggacgacgccgaggccgtgcgcgaggtggacgttggcgacggcgagtccgccgacgcggccggcttcgtggcgccgaccgaacagaacgggaagcacgaggccgcccccggttgcctcttgcccttcgcgcggttcggggacggtgaactgggcggaggctccggcatggaatcagcaatcgttgcgtcctgctcctccggtggcggcggcggcgtcgggagcctcgtggagaggtcgaagtcgacgagcatgatgtggccgctgtcctgtatcaggacgttctccggcttgaggtcgcggtacacgatgccgaggctgtgcagatagtcgagcgccagcaccaactccgcggcgtagaagctgcaatcagaagcaacaatcaacaacggcgaggtggttagttaacccattcgtgcgcgggtgggtggcggagaagcggcgatggccaaacgggggggatgcgagaagcgtaccggatgacggagtcggagaacatcttctcggtctggcggcgccggagcgagttgaggtctccgccgccgcagcggtcgatggcgaacccgacgacggcgtcggtggcgaggacgccgcggagggaggggagcagcgggtgtcgcagcgacatgagcacgtcccgctcgaaccagatccgccggtgcccgtcctcgccgccgctcccgttcttcttgtgccgcgccgcctcccgcgagaccgccttgagcgccatggaggcctcctcctcccccgccgccgcgggcacgacgtggaacacgacgcccttggcgccccggccgagcatggacaccgccctgaggtcccccaggctgagctcccgcggcaacgccggctccggaggcgagggcgccatcgccgccgccgccatggctggcgaaggaccgcgccgatcgatcgatcgatcgaccaaccgctcgtggacgggagagaggcagtgaggaggggaggagaggatccgagtggggtcggtgcgcgagggaaagcaggggaggggggagcgtgagatattgggggggattatttgcggtttgattcgaggggattttatgcggccgccggcttccttggaggcgaaggcgaaaggcgagaagcgcacggtcacggtgtggttgagaaaatttttgaatggccgcgttttacttggattttttagtggtggtgttacggttttgaggccattgagggcgctgtgtcgcgtggaccggaatcatcgtctggtgcgatgcgaagtagtacaggggtttgtgatgtttgcaatagaaaaggggaggaaattgggggaaatcgggtggatttcgtcaggtctacctgggactgcggttgggggcctcgtcttgcgcggattttgttggtctttgtacggcttctagaagggccgtttggtcagaggcacgactacagtgcccagaaacttttactgctccgtacattcttttcactctagaagggcggtcgtcgaacccgtttaaattagcttactgcacccaaaatttattcagcttgtaaatcgcacataaaatttaatttttaaagcttaaattggattcaaattttataaatcgcacttaagttgtttactttatttttcgatatttattttttaaattgctaagaacacatatataaaaattttgtttacgaattacatttagttgtttgttgaatagtcgttacggcttattatgagtataagcgaaacaatcattgtgttaaaagttgaagggtatcagtgatatccgattataacgattttgtaatggaggttagaattaactaagttactcctaagtgttcattcaaaagatggaagaatgtgttttctttttttttacaggtatagctataattgttttgtgtgggttgcacctgacgggtaattatagagctatccatgtttcaatgcaataaatcacatgaatgtatttgctctctttttttttggaaaactgaatgtgtttgcttcatatgtgctaggttttggcgcacagtttttactagtgacgttatagcatttcagcaatcagagccaaaaccgtttggttagcctctaattcgctagaactagagcacggagctaataataagaataccactaaacttttataacatgtaaaagaatggatcaacaataatgtaaaaaagaatctacaaagaagaaaaaataatgttatgaaaaaggaaaatctagaaaggagaaaggcgtcattcacaccgatttgttttgcgtgtgagcttgctcctctagactctagctaatcgtgagcacacgtgaagctacgtcaacatctttagtagcaataaactcgtactggtttgaagtgtgaacactcatttttctaactaaaatttccttatcattggttgaaaatccaaacaaggtttatttaaacttttcatgtgtttcttgcacaacaaactttgtacccaaactgaccaggcagcagacctgctgttcagtagaaaaataaaatgtgcttaagaatctttacgtcaacattattcgcgtcttccagttctccatagcctgcagcttcggtgccttccgggaaattctaacatccatggatagcaaagaatgagatcgattttcgttccttaagagacacattcttttgttttaggtatgctatataaaaagtttaaaaaaatagagaaaatataacatattacgtgtgcccaagcttttcatgtacgcccatgtgcataacaaataacaaatatcaaaaaaaaattataaaaaggtatactcgtgatattaatgataaggaatttctggtggggtgacgtggaaaataaacgaagggttcattggatttcttgggagaatctaattttaccaaaatacatgggaggcttaggtttcagggaccttcgcctttttaatcaagcgttgttgagcaggcaagcatggcgtcttattcagtatcatgacagtctgtgtgcaagaatcctgaaggctaaatattaccccaactgtgagcttattgatgcagtgtttccggcagatgtttccccaacttggaaagctgttgagcatggtttggagctgcttaagaaggggttaatatggaggattggagatgggaggaaagttcggatttggaaggatcagtggatacctcgccagtcgtccctcaaattgtcgccacagaatggaagatgcaggcttaggtgggttcatcagctgatcaatcaggatacaaactcttgggatgctgacctaattaaaaatgtttgctctccccttgatgtaaatgaaatcttaaagattaaattgccacatcgtggaatggaggacttcctggcttggcattttgagaagactggagtattcacagttcgcagtgcctaccatctagctttgcacaaccaactgaaggctaatgaactgggttcgtccagttcgtcgacaagtggagaacgcaaaatatgggcaagcctttggacagctcctgttccacagaaggtaaaaatttttgcttggagattagctagagaatgccttgccactatggagaaccgaaaaaagcgaaaactggaaattgactcaacttgccgtatttgtggccttggcggtgaggatggttttcatgctgtcatatcctgtactaaagccgcggcactgcgatcgctgatccgggaggtttgggagctccctgacgagcgttttctgattcggtcaggaccggactggctgctcattatcctggactcaataaacgctgaaagcagggcaaaatttcttttactcttatggagagcctggtttctcaggaatgatagtgtgcattgttctgggaaagcttcagtactagggagtttgttattcctccagagcctttgggagtccctgtttatgagtacaagccaagggaaggtagacgataaaggcaaaaaacctgtgatgcagtctcggctcagttctccggacagccatgaaaggaatcacactacgactatgggatggacccccccccccccccccggccgatgggctgggttaaagtaaatgtggatggctccttcattcagagttcggaacctgctagtgctggatttgtcattcgtgaccacactggctcagtactgctcacttcctggagaattatcagccattgtggatcagcggaagaggcggaagcgactgcatgttgggaaggggtgaatctcgcagctgagtgggtgaaaaaaccgttaattcttgagacagactgtgccaacttggtatctatgcttacgagctctggatttgatcgagcgcagctctgccatgtcctccggagtattaagttattactccaagctttgcctgattttcgtgtgcagaggattagaagggaatgcaatagagtagcccatgatttagctaaatttgccatgcgtacgaaccattcagctgtttggcgtatgcaggctccttcttgtgtttttggggctctggcaaatgattctaatcacattgatgagtaatcaataaagcgttcccttcccccgcaaaaacacacacacacacacacacacacacacatatatatagtcttaactttcaactcactatattttaacggtaagaaaataattttttttgacaattttaagagtatatacctattgaaatttttttttgttctatatatatgataaatttgaagataaaaccttacatatagatgtaatactactaaaagtactataacttttcatataatttttatagaatttttagtgatatttgttagttagcatgtacggtgtgtgcacgtgaaggtttatgtgcatataataaattctaaaaaatattaagatagattaatatatgatatatcaccaacaacatataagtttgaattcgacctatacaattagagaaagcaacaaatttaaccataaattatgtgttatatttatagtcaaattcattatttttatttctgtttgtacaagttaaatttgaaattgtattttgtaaagtgatatatcacatattaatatatcatactaatcttttaaatattttttagatgatacgtaaaaacgggcgttccctttgagggactaataaagttttccagcaaagaactccattaagttctgaacagtgctcccagaaaaatgggggagaaaaatgcacatgtcccataagttcagtttcttgttggctagctgcaaaaatttgttgatatatttatgatctgataggaacagcttgaccgaaccaatgatgcggattaagcctcactaacccacaatttagactactccctccgtttcacaatgtaagtcattttagtatttcccacattaatattgatgttaatgaatctaaacatatatatctatatagattcattaacattaatatgaatatgggtaatgctagaaagtcttacattatgaaacggaagaagtagaagaaacaggtgccaaattggccacgcttgttgcattgggtgactggttatactgtggaatgtggatacagttcgaagttggatgtcatacgtcccagcattactacggcctttgtgtactactcatttttcttataaggttaattggttagctcaattcgtcactgttggtaactaaagcacgatgccaatataatcaacaatgcgttttattctattgagaacactcataatttctaatttcttttgacgggtcccgtacgtaactttgtgtaattcttttattctttttctattaatatatgaggcaaagcttttaccgtcctttcaaaaaaataatttttatttctacctagttaggatacacatcgttaaatccactcacatccactgatccacaagttttgcaatagtaaaagaagtgtaaaaggactatcaattcgtaaattagattaccacccatgacggaaagaaaaatgtaatttgtaccccttcatattttaattttaatgtatgacaccgttgactttttccaacatttgaccactcgtcttattcaaaaattttatgtaaatataaaaatacttatgtcatgcttaaagaacatttgatgataaatcaagtcacaataaaataaattataattacataaattttttgaataagacgaaaggtcaaacgtttgtcaaaaagtcaacggcgtaatacattaaaatacgaaatacggagggagtactgtttataataggtgaatgaattgaaacaaggggtttgttggtgagtactttgtacgtgcagggtggccggcacgacagtacgtcgtttgtggaattgtaggcctttgccttaaagcgaatggattttgagacatttcagcaataccggcgttgcattctccgtaaaatatctgtctgaacatgcaaattaaagcaaaatgcacgaactagcagagaacaatcccagagcagcgatatggtattttctcgtgtaccattcttgtttaattacgccggtaaattaagcaccgacagtacgcgtgtgctactttttcctgacttttctcttccggaaataacttttgcttttaatagcactagtactacacttgaaaaaattagtaaaaaaaaagcatataaacaagaaagagcgaattatactatggccttgtttggatcctccgggctattaaatagcccccaagaatcttgctatttaggattattaaacgtatattaccgataaaaccgattccataacccctagactattttgcgagacgaatctaataatctatattaatccataattagtggctgattactgtagcatcacggtagcaaatcatagattaatatacctcgttagattcatctcacaaaatagcttaggggttatggaatgagttttcttagtaatctacgtttaatactcttaaatagcaagattctaaagagctatttaatagtccggaggatctaaacaggaccatatatactgggtgaaggtgaattcggacgcggggtttgacaagctcacgtcaacagggagcagtggggtggtgatacgagaccattctggtgttgtacaggcagctgccgctcgatggatggaacgtgtcccggatgccctgactgctgaagctttggcggcgaaggaagctctagagctagcgatggaagtcggctgtgatcgtgtgatacttgaagtcaactgtgctgagttgaaggttattctggaggacagtgaaggttttaaatcatgcattgccgggatctgtttcgacatcacagagcttgctaggagttttgttgatttcaaagtagaatgggtgcctagggaggctaactcagtggctcactgttgttcgagccttgtgtcttctgctgagcgctccatgttctggtttgatgatatcccggattggctagagggattagtttctattgattgtactcctatgaacaattaatgaaagctctgtgtttggtctcaaaaaaaagaattatactatatacctttataaatttctttttcgatttcacaaagacacgtactactacacaagtgcattaaccccactgaaactcacacaaatgctcccctaacccatctttaaagaaacgagaccaatgataattttttttgtctcactgaaatctacaaactctttctcagaataaattcatttttcatccattctacataaatcaataaaaaaattagtagagtaccctcaattttaccaaattctaatataattatttcctactttatctagtttttgtgtgtttatctcctaattttaaaaacttcaataaaacgattgtttaaaattcaaattattttagaacaaataagagagtgtaaatataatattattttagaacgaatgaagtaatcctttgagagagaaaaaataataagagagaaagacttttgcgtcggaagcactacgtggtgctcgttttacgtcagagatgagggcaagattacgcatatatatactgtatttcgttgtgggttggtgactctgttcgatggagactaaaaaagttcttttttttttcttgttatgcatgttgtcatgttgaggagtagaaataactaatcttttatagatagcgcgatgagatataattcaagctaaaaaaaatactactccctccatcccaatatattaaaacctaggatcggatgagacatttcctagtactacaaatctggacagacatgttttatccggtcctaggttttaatatattgggacggagggagtatcagtttgatggtccaaataggtcagcggccactggcattatccctctttattttaaattcactgaaagacatgcgtgccctgtacaatagcagtgcgtgatcatcagatggtccaaaagcagttcagtgcttctcgtctgccagaatatccgatctgagtgtgtgattgcatttttaattgtcctcgtaagcaaattttaaaaaggggcatattcctgacgagaaaatttaaaaagtgcacaaagttggtttgcttcttatttaactcatgtacttgggttcgtccctcggcaacaagagggaaatcatggattcctcatgatcaaaaaaatattcacgttcttcatttctatcatgtggctggataacaagatcaagatggcctttacaatattgagcatctcacttgcttttctgctcggtcaaattattccatggagcactgatggatcgtgtgcctaacaaaaataaattgtaaaatagaaaaggtaattacaagtggaaaagtgccaacttttgttactagatcgatcggcaagatattgtacacagtacactcctccggaagtggcgatctaaagtttcgctttgccctatcagtgtacgctcctttccttgcatttctttttcgtattgcgcttgtgttgtgcccgcaaattgaacagtggccattctatgggtgtgtttagttccacgctaaaattggaagtttaaagaaaaaagttgaaagtttatgtgtgcagaaaaattttgatgtgatggaaaagttgaaagtttaaagaaaaagttgggaactaaaccagacctatgactcaacagttgacgcactgatcgcacattggcaatagctttatctcccccacaaaccaatgagattctttacaaaggaggtacaaatcacttgaaagccttggagatatttttctctcttttttttagtgatagaagatgtataaggtcatgtccaatgcatcaccatgaagagtgatatcaagcctcccgattggagcgtggtctcacggtaccgaacgtgacctatagaggttatagttttctccacgcgccttagctcgaagacatggttggggtcacacattgggggagtccaaatccctgcgatgcgattggtcacgagaagaaagagaaatggtgaaggagaggagaggagggcctaccaggcagggactaagtcaattgccaacgagctcgttcgcattgacaagatcagatctaacgctagcgagctcttccatgccgacgagttcctccgctctgcgcgcttgtccatacttgagccactgtggccaccggactcgtcgctgtcctcaagctacggtagccgcggggctcatgatcagatctagcgaactcgtgaccatatccgccaaactcgactagagaaaggagaggcggcgctggattcggcaaactcggccaaatctgtcgccaacacctagagagaaggagaaaggagatgggggatatgttggaggtggaaaaggagagcagtgtggcggtggaagaggtgagcgttggacagagagctgaggaggagaggggtggaggtgggcaatggagtggcaaggtgatggatgcgttgagcaaaataaccagtgggcagagaaatggtgaaaaaaaggggaaaataaagtgggaggggctgacagtgggaccgtatggaggctaggggtacatatatgtagtactttttttcgttgttgtaggttctaaattataaaagttctagttagttcaatagtaaaaaatcacaaggaccgatacacaaatacttatgggctgaaacataaaatacaattgattgtggtctccattgtggctagagtggtttttgtgtgatcttatcctatgtgacacgttgacaccatatatcagtggttttcattgtacatgtcttaattgtactacgacaatacttatatccatctttttcttgacttaaaataatcttttggctggggaggagaagatgatcagctcgtgacaaatgctagacatttacaaaagtagagagggtggaaaaggaggagacaagagacgtctgcattcttgactggctatcctatacttacatcggaaaccaattgtggagatggaaagcgacccttgatgctcaagttggatgcagggccaactcagcctctctatgaatgacaaggacttgtcaatggccatcaggcgcatgatgatcccgtttttgtacatgcaggattgtactcaagtaaagccgtggtttgttctgaacttttttttttcaaacttctatcatttttatcacatcaaaactttcctacacatataaatttttaacttttccattacatcgttccaatttcattcaaacttctaattttagcgtaaactaaacacacccaaagttaaacatggtcatgtcaaccttgaaatgaacgaaaactgaaatggcattttgcatcttgcagtgtggaatttctgagtagaaatatgaggcatgggtggtcttgaaggcaccatatgggtgagcaggtcaacttggccaaagtagccaggccatggcaggtttcctccctagcatatcaccgcatcccgtcagcagggcagcgatctgcactgcccaaacgtagcggtggccggtgagttcacgttgtcatctccaaagtcacccataaactgcaacctgccctgcccccatctcgcaggaggaaaaaaggcgacggcgaaagagactccaccgaaatccgcacactggtcaccaccaaaccaccactgctacaactaactgtgtggcccgcgccccgggtgacaaaggccaaaccgccaaaccgccaaaccgcaccgcaggatcgatctcacgctgagacgctgagttgcaaccccacgcgacgcgcgcgggcgattcggctaaccgctaaccacaccgaccgagcggtgtgcccgtgtgcgcgcgcctcaaccgattcccgagccagagagcgaacgcacgggagggagagtgaggtgaggcgaggcgaggcgggcgggtgtggctcacggttccattgattagccgctcgcgcggcttcgactttggaggcgttgattacacgattgatcggtggagagcaacagggagctacgtgtactaactccttttccagccgccgaggtcgacgatgattgagcgggttcggggagccatgtttggctcgttggttggttggcggcgtcggcgatcgcagcgggtggtcctctcctcgtggattttggcttgacgacgtcacgacgatcgataatcggattgactcttggaaagcgcaagcgcgcacaggggcgcgtacgttccgtcgtgccgtccccctctcgcgtggcagcgtccgtcgctgcggatcgctacgcgtcactgtggattctggcacgcgagcagcgtgactgcgtgagcggagtgatatatcgatcgacgcccttcggagtacaccattgagatttttgatggaaatggcccgcttggtcggaggaatcaggggtgtatggaccaccgacccctattccactttgagttgaaacaacttgtttggtttcatgagagaggacatgctatatcccgttctctaatatagtaacttgtcatctctgtgctaataagaaattagggatacttcctgcctcgctaaatataagaatgtctactatttaagccaaagataaattatttcgatttagttatcaatactagttattttggtggaggtgtctgtagtgacttcgttaatcttaatttatattgatccattatttcgaatgcgctcatagatatatgtttataagagtgagcgtgcacgtgttgtgagcgtctatgtttatactatatctgtacaaagaaataggttaagagggaagatttcttttcaatcacctcattggttgaatttttaaattgattagattctcctaaatacctgattggttgaaaaatacttagatttttttgtcttgtaatccgggataaatttggatcttataaatgattatatttagaaatggaagaagcacatatgaaatcaagtcaataaatcttaggatggtcatatcatgaaccatctacgcgatttcaatatgatactaaaaaactaactatagacaagcaggggtgagacttgatggcaattggggcttgccggcttggggctcgaggactaaagttaggtccttaaactcattgaactcctaccagcatgtgataaatatttttgagatataaagcatctctagacgctggcccgtttccggctccacacatgtatacatgctataagaggtaacagcaggcaaatgggggagacatgctgtgtgtactccctcggttttattttaattgacgttttggacaataacacggtctacaagatacatcttttaccttatttttctattataatatatataataaataaatgcatgtttacttttattatagtactttaaaagacaaatatatatatgttgttctagttcctttaaactaaatatttttaaagttattgatggtttaagttataaaagtttgatctcaatcttatccaaaatgttaattaatatggagccggagggagtacttagttgcacactgtagctggagcgtacgtccagctacagatcatcaatgcccaagtgtcgttccaaactgttcctgattccgatccgctaagtcctggtgcaccgctgtcgttggaacgatgcatttagtgcctaacaacacgtccatgttccaggtaagtagcagcatcaagcaacgggagacgaaagctaatctgtgtctggccacgatgtcgtcctagctctatgactgaccaccacttctatcaagtttgaaccaattgtgtgcgtgcgtgtttgggtgaagaggattaatgcgtgtgtccggattagcttttatggttagcaccagatggtattcatttagcaacctaaccgacagtattgtggccaagctggtagctacatggaaagcaagcagtaccatgaatcagcactgtgtatatgtggcactaaggggatgtttaattgatgcctaaccttgccataactaagtttaggctagttgtggtatggtggcacaagtgtgacttagaaatagttgaccacaagtgtggtatacttagttctaaatttgagagcataacatatgggtctcaaagttaagaaagtgtggcataacacaattacggcagcaaaccaaacacatgcgtaagaaactgtggaatcactaaagtgtggcgtggcaaagtgtggcaaccaaccaaacaaccatttactctcgcaactgtctcagtgtgcacgaatcattcaaataggataagcgagaaacgctaaaggtgagtgtttttttttttcgcgatagatgatgaatgaaactgagtttatatgacaattatttgatcgtgcaaacaaatgaattaaatattataaagttgataatttgatctataaaaatgttttacaaaaatcgtgccgttggtatcttacataattcgtgttggtgcgcgtgataagatccaaacagatcgccacaccataaaccagttggactctgtgattaccacaacaatcatgaactattaacagaacgaatatccgaactttttcgtaaggatcggaaagatgagcttagaagggcaagggagagaatggatattgttctggaaggacaaaaaaaaaaagtactactcacaaggcattgccaaggtaggcgattgtcgattggcaattagcaggaaaattggaggatttaaagggttaggcaattggcatcatgtggaggtaacaaataaatgcacataagcttgaataaacaggggcacacggttggaaaatcctaataagtttgcgcacaagccatatattaatcaacaaacatcatcagactgtatacctttacatctctgaatgaatgcagtattggataagaaaatgctggacagtggaaaaaaaatgtcgtaaccatcttagttgatctcggtgttaaatattcacatttaaattttcacctgtcaatcagtcaatctagctaacacgtgtgaatatgtacatcatgttaacttgcacaaattaaaaaatggatatgaacaagcaggaatggctgcagaataaagaatgagaacaaaccgctactatcagggtgtaggcctgcactagatgatcaatgtacacgcacaaggcattgccaaggtaggtaggtagatagaaataagatgttgctttgctgtatatgaagtcgtcagatttcttttgatccatgcgtccggtgcctgcctagccagtctaggactgtcagtaagctcagcggaatgtagagctgtcgtcacagagatctcatgtaaacagacataactgctttccatagaaatatgctggcagcatgtgaaaattttgctccttcagtcttcagtgaagctgcattgctcctaaagtggcattcatatacattctctctatttgctttcagctgtactgagaacaactctatcctggactcctggtcagaccaaacgttctaccggtgaatcaggacaacttgctgccgtttgcgcttccagaactctctgcattgcatagtgacacctaaaatttaaaaagaacagtacattagaatagctctaggtttttaggataaatcaatgcaaatgtaacggcaactgagtgagcatgcaactttcttgtgcgcagataaaaggcgagtttgccaaaagccaactagcaaaggcataccattgaattgtcaacagctgttgaaaataaatggttactaccgcactccaaaggaatcatttttcaaaaaaggttactaactcaaatcaacgtgacattacaagaaaaccccagtctagaaatggagttcctattcagagtatgaatacttcacacgagaaatcaacaaaattatatttgacatgacagacaaacacgcatacttgactgagatgcacattaaacataagaacacaatagggactaaccatcagttcttcattcattctttgtgtgttgttttgttgtcatatggtccaacaaattcttagcaacatagccatggaaaaggtactagcaacagtacattggctactatacaaggtactccctccgtcccaaaatataacaacttttagcactcggaatttgtcccaaaatataacaacttctctatcaacattctctacccaaacaatcacaacccttccaccattcacttttcccatctacttctacttctcaatcaatcataacatctccccatttaattctacctatttttttaataactgtgtccaactctaaaactttttatattatgggatggaggtagtacctataaaatatgctgtattatgtgtgcatttcttataattaaatactgttcgaatcttacctccatggtaggtgatccgtaaacatcgaaggagtaacggcaagatcagtgaagttctccctttttgcaaaaaaagctttatatggtggttcacttccctgcaagctccagcatttccaaagagggaagaggcttcttctttgccgctctatatgaacaactaggcctggaagaaacatttcaggaggctcaactggtatatccctataagatgtgtgacgctgttctgaaccagaatcgagcccatgaagggaaattgtctgggcatcacaatcagtatgtagaccctgagagctcataacatctatggatgaattagacccattatacccattgatgccattttgcaaaattgggaggtctggctcagaagtacaaggtgcatcctggtgaggaaaccgtcgttcagtagatactgccctccctgtaatagtgaaaatgaattcagaaagaaacttgttgaaaattcaaatgagattaaaaaaaggttctgaacagcatagaagattgattcgagtcatcagttcttctatatttgtccaaaaggaacaaaagggtaagataaaataatttccttcaaatgtgtggtgcctagcactatagtcctccattatgccaccatcaggaccattatcatgatacttgttaacattcaaaattctgcgagcaagtttctgtatcattgctgtatcagctggagagttatctgaaagagcccttattgcagcagaccgcagcctcagaattgagttgattgaaaggcgagaagaaaactcatcattgcacacaatgctggaaaggaagaggaaacgaatactcaaagaagttaataaattgtcaagagggcaacacaccatgaattgaaaaccattgataaatgaattttgtaattgattcttagtttagtcttacgttgtaacaaattgcgaacaggcttcagctattacaaagtccacacaaggtagtggtccgtatgcatatacatgcacgtttggatacctgccaaaaagctgtgagagaacaaagttaaactatggagaaccatggacaccatacactccaaacaaaagtaacactcattaggaattataggcagggaattaaagaaagtcaaaaacaaaaatacaaatcaacaatcatacgatgacctggtccagacaaagttcactgagaagttttggccttttgggcaatacgtcagatgcgcacacgcgaacacacacacacagatgactctgctgttcccgtagttcagacaagcttaatgggatagtcatagatgttctttatgttgtcgtatataatgcctatactacagtaacccacttttatagcggtgcagaaggatgttggtcaatagggaaatcagaaaaaggtaatgtcaggctgcagaaagaatatgattaataacaacatgctatgctaaagataaaaggtgaagattcagccagcattaccatcattccaagaactgtagcaacagaaccccctaaagaatgcccaacaactcgaattttatatccatggcattcactgccttcccccaccagtgcaggaagaaatccaactgttagggatgacgaattatctgggttggcattgtgacaagagaagagcagattagccactatagtcatttattgtacttaaattaacaatattaacacacacattgcatctaatcttctaatatgaggtactagtttcctaaaaacaaagagtacatattctgctgcaaacagtcaaatattgcaatatcagacaacaaacagtaactagactagcacctcctgtgcagtcgttgagttgcatgaaaagctccctggcggactctagaattccaccatgtccataatgcggaaaggtagaaataactctctcccttgtagttgcaggtaactgttcacatctgaagaattagcagtgtcaacaaaacagattgtggacagtagatagcacaataaaatggccagcatataggtttgctccctgaaaacgttgcacagtttctaaagtggtccctcaacctcatgaactaattaattctcatccttctatcagttttacttcaagatattatacactcatacactgtactaaagtaggtcaaatagggatgcaagagtatctggtttggctgacccatttacccatcctaggccatttacttcacaaacaattcgaggatgtaaacaaagtggactgccaaattaaatggaatgtgaacagacaattaagtaaggtagatcaactggacaacttacgtccatcactaagatcaaattatctgatttgattaccagtaacataaagcttgggtgtacatgttgtggactttgacaaatggtgatatttcagatgtattttcctatgagccttcaatagaacctcgccattataatcatatttaccacataaactccaattgattaacacaataaaccctataatatgcaattgaacggtacaaaacaacttgcattgcatcgtgttccattgagaaaactgatcatatgatggcaaaaataatcaaaactggcaagtagaagtaaataagaaaattagtataataagttcagaagagcaggagtttaaggatcagaataattaattttgaaatttcaggttaaatcattttgtgattgttcatgttcttctaatcatgtgaatgctaatcagagcaccacagggttgaccattggtatttaactatcagcaaatggcttgcagcaagtagtccgtgaggaaaaaaaaagactaattttgaccacaagagtagaaagattagataagaatagacgagatggctatcaagagggaattactttactagtccatccaaatcctccatagtaaatgcacattctctgcataatccatcggttatgagatcttctggtgtttcagttccacgaactccaataacaactgtctttttgtcatggaggaccacgacaaagtaagcagcttccctcttgctctgcatacataaaaagaatcaaatcaagttcaatgattttactgaaaaaccaaccgtgctatgctctttatcaagtatggctgggtttcaatgcctcccttcaactgtaagcatgtctaatgtaacaacaaaatcagcacagtacggcaaacatatttggtcatccacattactctcaggctctcagttcgttgcattcccagagggcatgtatgaggtaaatgtggcaatgtgtgcgttgggcaaaggcctcaccagccaggagccatagatagtgaactggtaataacatggctagggaggagaatgagcaggagggctgcaaaggtggtaaagcatgatagagccttcaatacatgatttgcctctattgactaaaacatagggatgcttatctcttaacctctatttatgcaggcccatttgcctgggtcaccaagcatggcatgtatacatgtgccgcacatgacacagctacttaaggtatgtgaagtacattactgcaacctaaaggatggcttactttaaccaattcaccaaataacgtcgaaatgtacataattaggtacaggcgggatccataaagtagatatcaactatgagctaaagtaacattaacatgtggcaggttacaaatgtcacttggaacgattgcataattggctgaaatatatttttcatcattgcaattttagtttataaattccaattttatccaaactcgtgttacctggcaaacacggccccgtagaagtgctgcagctggtatgtgaacaaatcgaaggaaagcggcagcatgccctcgccaccagttgtcaccatcaagtgcagggcgcctgcatgaagaccaatatgtggatgtcatataaggcaagaacagcataagatgttcaaacttatctcaatgtaacagttggtccagttcaaggaggattaagcaaaataaaaatcaaatttagcttgcttcacattttaccgaacaaaatctccagctgaactggccaaaaagaggatcatcaaccataggggtatttggcaataaacacacaactgagaagtataagagagttcaggagatataccttctgcgcgaccatggagttaaaacaccttgtctgtaaacccatgcacatggaaacaaaatagggtttctcccaacatcaaggagaggtccctgaaataataccacgtcaaatgcaattatacaaggaagggaggtattaaacttgttccagttagatagtgtttccaaccgtgtaacatgcttcagcaaagggatgaaggatagcagcttcttgcataaggttcagtggcgcttccgtaaggtcagtttgcaaatgaggcaaattttcatttttctgtaatagtgcaagccctaaaacatgcaccgtaaaaatggatccttagtatgctctcaatatagtgacaataacaaggaattccataaaaaaatcatatgtgatgcttgtacactcataacagtctacattatactgataaaatagtttgtcataaagtgacacggcaatacaacccatgcggagaatctggtcctgtttagtcaactatccatggtaacctaaccgctagcaggcaactactcaaagtagaaaagatgaaagcatggtgctatgtaatttaactccaaacagagcagcactttaagctctgtactctttttgcaatattgaaatttccgtggtctatcaagtaaattgcaccaaacccatctatatcctatgaagaatgtaacttatacatattcatttaaacatctgaattcacaatatatgtattatagatttttgcaatgagaggggtttcatcgggaacactgtattactgtcttacaatttactcacctccaattttctgtgctaaatagattcctctctagattttgtacataagtcatgtttttaggaggtggacagattgcacacatatgactacaagtaggtggtaacaaaaacggaagtttatgttggagttctgaatggtacaattgagcctagtagaatttactcactgcttattgaaaacctaaacacctacatagctgtgcacgtctttagaaggtaagtgacaaaatttagaatattcatgtcatcatgtgtgttggcatcaaatttaattttgaaagtccaaataggacacagaacatattcaatgtgaaagcaatgaaacagaaaactgacctgctaaaagttccaaatgtcctgtcccagaagcacgatatgcaaccaaatcacccagaagtcttgccacagagtaaacctcatcctcttccaatacggttctgcatcagtatgtaagacaactagctcatataggtaaataaatagtgatatttctcagcataaaaagaataggtagtgacctacagatactttgcacgccctaggcagcataaagcttctcgaattccatgatcgaacacttccctgtaatgagctttccatgccatgtcatgtgttgcatagaacgacctccaccttaatatatcagaacccgtgaagcattggacaacgaccacaacccaggaaagaataagaaacaaagcaattaatgctcgtttcgagacatgatcagcttcatcctgtcctagattgcgagcaaggcaggccaattattgaacagaattgatggagcaggacaaaaaatcataagcaagtaggcagtggataaaatactagtgccatcaaaacctatcataatttagtactatattaagtaaaggcaaaagttattgacactttttacccatatttttttttcatttggaaactctaaggggagaaggctccagtaatgtttatgtataaagtttacttggcagaaagatttcatctaacaaaggttcaccattcacagctgaaatgcactacagatatatgacaggatctgatcatctgactcaaacataccaaagaaacaggaagtggctcttctttcatttgaaatatctctgacaatgacaagcatgagataaattgccccaaccaattgcattgcacccactgccatgccgaatctagtccaccacaaccagcgtttatacctcacctgttgagcaaaacaaaacagaaatagcagtatgataaataagtgctcagtagaaattctactcttcttacacctactctagcttctatggcagaattcaaatatcccatcagtacccataaagaatattctgagccctcctcactgatacatcttaaaggatggtatccagattacagatttataatgctatgctagagagttaagaactatgaatccatgatcctcactgatatatcgtcaacaatattctccagatttataatgatattaatgcgtgttgtttattgtaaaaagtttatgattacctatatcaatagattaaatatgattacaaagttaatgaactcaatttgaacaatgcagaatgccaacaagtggcaggaaaacaattcaaatccacaaatatgatattagattccaattcgaaatcttaaccctaaaccctcatgtcaggtctctgtgatctaataaaaaggtgctcaagctcacggtcacagtgtaacactgagtcgcttcatagtgtttggctataagcacattgtcctccagccatatgcatcagataaaagctcttaataagatgtattcgcagttcatctaagcttaatacgctgtatcttagcaccattgacaactcccgtcagttacacgcatttgcattaactcgcctcaaaattctgataaatggtgaaatcaagtccacttgttcagattgatcgtgtctcaaataatcccgtattgtaaccatacctagacaaacaaacaaaaaaatgcgttggtttatccttgaacggttgaaccaactgaaatcaaagcacaatttatcacgactttacgatacgtcagagttaagccgagcaaatcacccaactaaagtggcctaagctagccggcaaggagctcgagttctcaccctgatctcgtggcgcgcaacggcgtcagcggcgaccgacgctgcggcctcgtcgaggtggcgcctcgcgatggcatccgccgtggcgtgctgcgcgcgcgcggtgccgatcatggcgagcacgcggatccccgccagcgcgggcgccgcggcgagcgcgagccccccgccgcaccccggtgggagcacgccgtcgatgaggtagagcccgagcagcagcacggccacgttgaggcccccgacgaggaacgagaccacccgcaccatcccgagccggaaggaggcggcggccgcgccagccgacgacgacgccgccgccaccgcagcagcggccacggggtcgccggcgcccgccatggcggcggccgcggcggccctccgtcgggatgcaggcggcggcggcggcgaggagggggcgcggcggcggcgggggaggagggggaagaggaggcgacgaaggtgggggaggaggagcgggggacgaggcccgcgggtggcgaggatggggaggaggggctttctaggcatctctctcacccggccgcggcggccatggaaagcggagagggtcgcggcctcgcgggtggttggaggcggccgcggaaatagaaacggggaaggctttcgggtcgcggtcgcgggaggtggattcgggggcggacgagacgactagaggagtcgcgcggcgtccgccgcccgctgtttgttctggtgcgcgagctgatgtgatgactggcatgtgacaactggtttaaatctcctcctttttttttctccttctgaagctgtccttcggaattcgcttttttagatctaggcttaaatattcgtggaccacgtgagtacttgacgttcattctaagcaatagtctctctttgtatactcctgcaatactttgtttgttgttactagcaaaatacccatattttactatggttatttaaatatataatatttgcttgttcgaaaaataaatatttgactatttcataatattaacaaatattattggccaatttgtaaaaattgcaaaaggaattatgggatactgggttggcagtggcagatccattgtcaccgctactaatacttcatccttcccagattctttctaaattgatcatcatataagtttatgcactaagactaaggataatttaaatcacatcaatcaacacacccattcttccacagagcatgcgtcgattaaaaacccatgccaattacaccctatcatgcacacagtctctcatattgcatcaattgtatttcgatgaaatccgtgttcatgcagttatatgatgagcaatttaagaaattttggattctattatatgatgatcaatttgggaaagagggagtatctttttaaaaggagtacataattgagattttgaaatgagtcggctgctaagggtccattcgatttaaaggatttttggaggaaaagtgaatgattcaaattaatataagtaggaattaacactattcactcatttggaatggagggttagggtataagagaagtggaggatttttccctttgccatagattttataggcataatataggaatctaaacatccactgtaacctctttttttttcttttcctttgttaggtccaaggaaaatcaatactcaagtgactataatttaacaacaacataagaaagtttgtttaatttaagaaaaaagttcaaatgtcctccaaaactttgtctaacaccctgaacattaaaaccaaacatccaatcccctaaattctacaatacccttcatattatcctccgaggtggttttagatggtggtcttccgtatttctaagcttaaactagtggtttttaaataactaatataacaaaattaggtatcatcaatataggttgtcagtttataccatacagtgatgccatactgctgttatgttggtacttgtgtttttaagtgagagcgaacaagtggtaaaatgaaatatcaaagtggagatctcatatatgtccaatatgtatatcatgtgatcaaactgattcaacttatatacaaattagataaaaataaacgctatccaaaatcacccttggggttatataaacaatattgtaaagtttagagggttgtatatctggtttcaaagttcgggtgctagatgggctttcaatcgaagtttttaagaaaaggttagtgcaacgtggaatgtatagacacgggagaaagatgggttaattcgctctgccaccatatcgaaatttttatgacactaattttttttggtgtagtagaagaccaaataattcaatctaaaactttgacctattgcgaagtgagcgtagttaaactggttaggttcccttgtgatggaaccaacccacctgagttcaaatcctagaattgacacggctaattactttttcggtggtagacaacgaggcgagataaggtgtgcgtgtgtcttcatagagttgactgtctaattatattttcggtggtatacaacgtatctcgaggtagggtgtgcgtgtatctttatatatgtgagtctcatagagttgactgtctaattatattttcggtggtatacaacgtatcctgaggtaaggtgtacgtgtgtcttcatagatgtgtggtatacgacgtattccgaggtagggtgtgcgtgtatcttcatatatgtgagtgtcaacgaggcgaggtaggatgggcgcctgcctctgtactgaattttggtatgctgaagcttagatggggatttggtaaagcgtcaaactaattaaaatcagcctaatacatcaatgccacttacaccaacaaaacattttgttatgaagtaaaatgattaaaaaaaacagtgatcctaccaataccagccaccctgtttcccagctttttctgtgagagcaaggaccacgtttttccaccttatatatcacatactatctagtcacaaaataatgtcattttagactctaatttgataagacgtaactttaaccaattattttgtttacagaaattaagaaaaattacctaacataaaagtatgtcaagtgtttttttaccaaaaaaaagaaaaagactttgatcgttgcttaattataatcttccctattgaccaccaatatcaccttccctatctatttgagttggctagcttctactccctcgattttaaaatataagattatatcttctggaacaaaaggagtaactagacaagtcaaactggtttaatttggactttaccttcaggtaaaaataccatctgatagtaatctttcctccattggctgaaatttaaaacattttaaccattttgactatatgatctgcatatataattcgtttttcagcttgccaaaagaacttgtcaaccgtttctaaaaaaaaaaagaacttgtcaaccctatgaacgaattaaacttctagacaatactattcgtgcttgacggcttattttgccgcgagccgttcaaaggaaaaacaagagtggcacgtccctggtatatcgccaacgccaattccctgtcgaacgaaacaggcgcgtgtgggccgcggcccatacatatcatcgcgtcgcgcctcgagtttgaactcgcgcgcgtcgtacgtacgtgtacgtggcatcgtttgtctcggctctctcagagcatctccaacagcctctccaaatctaactctccaaacacctatatagccaactctccatttgatttggctagtcaaactagttgttcactccaacagcctctctatctaccctctctactttgactctatgacgccgggacccatatgtcagcatctcccttcttctttctccccttccttcccctttttctcttttttctcgcgttggctggaagcaggcggcgccgacaagctgggagcgagcggacggcggccgcggccgcggcgcgcgggggccaacggccgcggcgagcgggggacggtgggccacgccgcgcgggggacggcggccgcgccgagcagagggcgggtggccacagcgagcggaggccggtggccgcaccgtgggcggggaacggcggcggtggcgcgtgggggccagcggccgcgccgagcgggggacggcggccgcggctagcggaggcggcggccgcgccgcacgggggccggcggcggcggcgagcacctcctcctcgtgctccttccgtgcggttgtcgtgtggggaactggggatggtggagatgggttgtgtggggcccaccattggctagctaaatagagtggccaaatttggctagtagagggagggttttggccagccggatggctatcggttggagaggctgttggagcatgattttttattagaatggctaaaatttagcttggagagtggaatggagagactgttggagatgctctcattaagctgaacgatcgtgctgctgtgtatgcagccgcccaatcgaagtcacgcgcgactcagctctcacacacgaagctaaaacacaagtgcacaagttacacaacaagccaaaacacaagtgcaccagttaaggccggagagcctgagagcgcgagcgacctacccttgtctcgcgcttggcgaactccaccgtcggcccctcgccgccgccgccgctgccccccgcggagacgacggcgagcgcggtcacctcctgagcgcgcgccgtgccgaccatggccacgatcctcaccgccgccagcgcgaccgccgcgccgaccgcggcctcctccctccgcccgcagcgctcagtcacacccacccactcggccgccgccccggccgccgcgaccgccacgttcacggccgccagcgccgcggacatgcggcgcaccccgcggatccggaacggcggccgcatggtttggcgcacgcgccgcgagatcgaggagaggcaggccgggcgcgcgcggcgccgttctctgagtgcacgcgtgcatgtgcgggcgcggccgggcgacgtttttgtagcggcgcgcgcgccgcgcgggggtgcgaggcgtgcgagcggcatcagccaggccagccaggccagtaggacgacggttctttgcttgggcgacgccgaggcagaatagaatattagtatcacgtactgtacattgttttggccctgccaattggacgaggcgtttgcttgatcaggggtgcattgcatgcatgactgcatgccatgatgcattggccaacgtaaatgccaagccggagggtgtggcagtgtgtgcagtgcactcttggcaccggtacgtccaggcaggcaggagatgctgggagggcgtggctggcagcctggcactggcagctgcccgggcttcgcgtcggtggttggaggctgcttggagctcgcggagtcgcgggaagtgaggcatctattctaccgcgcagtgtcgccacaaaagctggaaagaaaaggaggaagcgtctttctttatctccgttggggcctcggggccgaggagacgctgacatgttagccccagtttagttagatccatgccggtttagcggtttaggaccataccggtttaatacaatagatggatgggccagcccgcctgcctattccattgaaatagtcctagtactaccaaaaacacagcccgttatccacagatggacgacttgagcagcccatttggcccaaaaacctattgagattactcctagtactaccaaaatcataacgaactgttggaatcgaatcacttcgccattgaaaaggtttctaaaaaaacaaacgtcaccattgaaaagggctggtgctgaccacttgatctacgtcggaacttggaagaacactgatacattgatcaaaaatagataaattaagacactgataccaaaaagatctaactctgcaaattctccaatactggcaagttaaaattagggtgtcgatgccattagctgatggcagctacacaaattattttctttttgtgtgacacgtcggtagcttgcgaatctctgcttatggatctattaatccagttgcgtcgctttcaaggtctcgtcaacctaattaagagcaaaacagtttgaagttcggctgtgccatcatgatataataataatctttgcgcattccgtcatagaaaaggggatatagtattatactagccggtgtcgttctttgttgatctgccttttcagatggcacgcaagggtaactttcgtaagggattctttcagctgaattcgcataatctatatatttcctttctttgcatgcgtttgctaggttacgtgcatgctgatgcttgtctccgtcagctccgatcaatctcgtacccttttcccttactcccccccccctcccctcttctctacaaagtgcaaacaaataatattcgatctctggcccaagctttctttcatttgcttggcttagaatttaaggtttgcatctttcagtgagccatgattccggcgtaccaatcacatatcctaggacgttcgaggacgacgcctccatatgctgcttggcccagttctccgaactttaacttttccatcactggtggagaaatgctttttagtcccggttcgtaaccccggacaaccgggactacgaatccgggactaaagatcgctatctttagtcccgggtgaaataaccgggacaaaagatcgatctttagtcccggttggtaactccaaccggaactaaagataaggtctaccaaccgagactaaagagggaataacagcagtacagatggtcatctttcttttttttcttttttattttctcccgaattaagtggcatgcatatccccaaatcccaaatcaaattaacatcccaaatccacatcacaaatctttaagttacttatacacataaatcaaatacatcgcaaatcctaaaaaaaatacacaaatcaaattacatcacaagttctacaaaattcatcgcaaatacatcacaagttcacatcgcacacaaatcaaatagatcacagaatcatgcaataaatcacaaattttaaaaaaaaaagaaaaaaagccacagaggcgccgctcggccggtcgctgtcgcctcctctccgcaccgccgcccgccgccgcgcaggccgccgtgtcacgccccgaactagtcccgaccggaactagcccgtgacgctccaaattaacctgttaatcgataccagtcccaggaaacagtgctggtatcacagggagacagaatatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggaattatttatacagagcaagggtgagtacgggagtactcagcaagccatgggaaataagtgtttaatgcaggcttcaaggaaaggctggtgtttttgcaattaattttatttgaactcttttctgaaacaactaagtgagtgcttctcaaacgacacggatgagacagtgcgtctcgtccggtcggagtatgtgtaatgtatcagtctttagaatttaaacaaggttggcacccggccaacagctttttcaacggccacccgggccaacaacttttcaaacggccacccgggcctagctcatcccatcagctgcagatttttcaaacaccgaaccccttttcacacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgctaggaagcccaggggtcctccccgacaccaccccggcgaatccacatgtctctcggcatcaaggctcccctgataagctagttactcagccaggggtgtcccattccacccatgtggtcatacttgtcttatgtttggatgaaattccaaggaatcggtccttaagtgcgagagcgggaaaccgtacacccggtacgtttcccggtccgcggttttggaaattcatttagttcgcaagcgccgacccaggtgtcgggttttccaagtcttttgtaaaactccagttttacccaagttattactcagattttaagtttgaaggcgaccgtcgatactggcacagggtgcacgaatatcgaggcgcaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcgggctcggaaactatacgcaaaacgggacaactcaacaaatggcgaaaataaagccctattaatgacctctaagcgtgccattagatagatctcgagatttgagaaattttggaatttgaacggagtcaaacggatttacggttgggaagatattgaatttctaagattattggatttttggtctaaaggaaaaggatttaattaaatccttttttttggaaaagaaaaagaaaagaaaaggggagagggagggaatatagacttccctcgggcggctagggcgcggcccgagagaaagggcggctcggccgagcttaacgggccggctggcccaagaaggcggcccagagcggcccaagacgcgcgcgcgcgggagggaggagagagagagccggtggaccgggctcaccatgcgcggtcccgggtgggacccgcttgtcagcggctcggctcaccgtgcggagggagtacgcggctcatgcgcgcgggtgggggagggacgcggtgcacgcgcgcggttcgcggtggacgcggatgcggcgggcccacgcgcagcctcacggctcgcggtggaacgcgcgcatggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggagcgaaccacggcgatacggacaaaagcgagcacatcgggcggttgctcgtgatgaggggagacgagccaacggctcggatttgccagaggaagcttgacggcggtgaatcgcggcggcgacaaccggcggggagggaagagggaaacggcggcgaggccacgaggggtcgattcccggcggtgagagcatctacgcggtttcgggaactcgatgctagcgtcggattggacggagctacgccgagcgaggctggcgacgtgtgggtgctacggagctcgagcggcgagcacgcggcgagcgacgacaacggtcggggcggcgccggctaactacggggagtctactcgagctactaccgaaagctagggggggagatggagcgaggaggaagaacggagggaggcatcaccgagatgaggaggggcgctgtgacgagaggccgacggcgcgggagtaatctctccggcctcgggccggggaagaggaaggagagggcgcggccgaagtccccttccgcgtccttgctcgtgccgactccttcgacacgcgcaacaacgaacggcgacggcgaacagagcacgggggcggcagctatggcgaggaggcgaaaacgagggagattggaggggaaggagctggggtttaaagggggcggcaatgtcggtttgggaaccgacttagggcggtcaaggcgcgagctgcgctcggcggtcgcggccaaagcggcgacagggaggatgacgccggcgggggaaaaggggaaaaaggagggggagaaaggggcttgcccttttgccgattcgggaaaaagaagaaggggagcgggggcgacgcgacagagggaggaggggcgctgcctccgtcccttggcggcttgcgcgcggagtggcgggggccgagcggtgacgacggcgatgacggcggcggcgaccgggcggtcggccactcggcacgcgcgcgcggcttgcaacgggcggtgtccgcgcgggcgtgcgcacgcgaacacggcgcgcgggaagtggcagcgagggagcggagagggaggacttggctcggcgcgggcggcttacgcaggcgcggcagagcgaggagaggggaagggggcgctcggcgcggcggctcacgcgcacgcgcgcgggcggagcggaggaggaggagcactcggcgcggctcttcgcgcacgcgcgcgcggtgagcggggggggggggggagc

SEQ ID NO: 76199 - DNA, 511 bp, Oryza sativa
aaggtacgtttataaagcttacttccctcggaattttttgctttcattagttcatcgagctaggtcaaaatcacgctgccctcatctcttagcgcgctgttgcaatttagtttgtttgatttttgtttcaagttctactttcaactgcttatatacctgtgcgatggtcttaaactatttaatattggttggttgttcgtaaatcagaattatgagttgtgttattattttgaaaagacacactttacatcaccttcacagtgcttcgtatgttgctttttccaggactgataattctataaagaatcattggaatagttctctcagaaagaagcaagatatgtacaataccagcaataatatggtagttccgaaactgcttgttcatgataagttcaaggataaaccaaagctgatggctatggagggtcatcttgatttgaacaaggcacccattatcaattcaaaagaccaacctggaacagctcatcggtctaattgctcagggttt

SEQ ID NO: 76200 - DNA, 672 bp, Oryza sativa
ccgcttccgacaaggagcgtcgctgctcgacccgtcgctcgccggtagctggtggacgccaccggccgccgccgtctccgcgaggagggactggctgctcgccgcgcgtgagagcttcccgccgccgtgtccggcagccgccaggcacgacatccgcgcggcgcgctcggcgatcatggcgtccgccgcggcgagcagggaaggcacaggcggcgccggcgcgggcttgcacggcgagcccaccggcgtgctgtagcacgacgcgtaccgcgacgacgacggcggcgacggcaccccgccgaccccgagcccgccgccgcacacactgaagtgcttgctcgtcagctcggtccttagtccggcatagtcacctaacacaccagtgttttaattaagcatttcgtggttctctctctctctctatctgtgtagaggtgattatcttaatcaatcatcgtgtcctgtcacctttggcttttgcagttgacagccacatgatcgtggaggtcggcgcgggttaaggaccagttcgtggcgtggacgtaatgccgctaccataatttgcgagccgtctcagagagagagagaagagaagagagaagttgtatggttaattcggtgtccatgaccagccaaccgatggcagctaagaaacatgtccttaaattaatt

SEQ ID NO: 76201 - DNA, 998 bp, Oryza sativa
cttccggtatgacttgctgagtacagtgggtagtactcagtcttgctctctttttccccacaccagagctgaagatcttcctagttggagctgttttgtcaaagttggtttcgtcgctgccgtcaaggattgcctgtgaagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttagcatcagagccgaccttgaccgtagggcaagccaactagaaaacctaggagccctctgaaccctttttcatatgcatatgcctttttcacttggattttgtttcgggaaaatttggggtttgcctctttggttggtgggaaaaaaaatcttggtcgttcattcggatcggatctttaaaattagctcagtctagggttttagtaaaattttatttggagtttattcgacagtcagtcgggaatctattgggggttatgcattaggtcgtgtctatgttcgatggggcaatgttatgcgcatcattttccatgcaactagtctatgcattaatttattgtttagtcagttgcattagtgtcttttgtctcggttcgtggaaaaggttgttccatgcataaaaatcaccatgctaggttatttatttgagtcatttgttgctttgtttaatttggatttgagcatgaattggttcctatcccttgtctactttagatgtcagtcctatccctcgattgcaagcgccgccccgagcttcagagtcgccgcccttagctttatcgtcttcttagtctgtttgcttgctagttttcgtgtttaggtttgttgcttgagggttagtcggtggtcgatatcatgtgtcagtggtatga

SEQ ID NO: 76202 - DNA, 7714 bp, Oryza sativa
  unsure (1)..(7714): unsure at all n locations
acttcagcagcgggcgactccactccacaggcaatccttgacggcagcgacgaaaccaactttgacaaaacagctccaactaggaagatcttcagctctggtgtgggagaaaagagagcaagactgagtactacccactgtactcagcaagtcataccggaagaggaggtatgatgcaggatataaccaaaggaggctaggggttcttttgcataaagctagcatttaaaagcagtagttgaaagcagtaaaacagttgtagtaattatcaatattaaccaaacactgtccaacgctacaccacgttgcaacaggcccaaccaaccacctgaactacacccgttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtggcggtcccctcttgcgccgcagtgaatccggcagctggacaaccggacaccccggccgacccaactccatcacgcccaccctcgccaccggtgcctaggaaagggtcgagctatacttcagatcaagcagttacccactcccgcttggggtaagcacggtaagtctcncagggtttcccgtgaaccggtccttaattgccatgggtgcgaccagcaaaaccatgcacccacagcccaccattcagtgtattttaattaaccaacacccttgcggtggcaccaatccaaagctattgccaataatcaaagtctatgctttaatgtgattccctttttgtgtactagtagaactaagcatggctaagcatttcctaaatcaacatctagtcattttaatacccaagttgtcaatggcataaggtaaacaatatatggctgagtagtaggacccatcccacatgatattgtaaaagaatgcaacatttaatagaaatgcgggatatttgtaaattgggtacaatatgatcaaacgtattgcatgacttgccttgctctcgcactgatgagacctcagtaacgtcttcgagaaaccgcggatcgacgaaacggccgaaatctacgcgacaaacaaagcacacaagcaaaacatgctataagactactgaaacaggaaacaaaactatttttaatggattctttgcatttttcttgatttactgagacttgaatggacttaaacggagctcggatgaattacttatgaattttagaagataaactgtgtttttactaataaagaaaaagccttaatcactttattgcgcaataaagcccagggctgacgtcagccaaagggggggcgccggcacgtgggccccacgggtcagcggctccaaagggagggaggtggcgcctggcaggtgggccccaccaggcggtggctcaaaggggaggcgagggaggcgccggccgggctcggctcggcctcaaggccgaccggccgaccaaggcgaggcggcggcgaggcacggccaccgacggcggtgaccggcggtgcgggaagcggcggcgacggccgaaaggtggcggcgcatggccgaaggcgacggcggcggccgaagacgacggctcacgcgcggagggcggcggcaacacccaaagaaggggaggagaggagttagggatggagaggacgaccgcgacgacccaaaatggccggccggagatggaaacaatggtgagctcacgagggaatcggagctccggcggtgattcgcggcaacgaagcggcggccgaggtgcgggctggctcagtgagcgcgacggcggcgactgcgcggcgcggcggtggctatagtggcagcggcgcgcgaccggagatgggcggcggtggcggagctcgggtgtgacagcgcgggtgcggtaggggatgtgggagaggacggcaaatgggggaaacgaaagaggggactcggggcagcgatttataggtgcggaagggggcggacgtggccggggaggtggccgaaaccgccggcgacgtggggtggagagagagacagagtgccgccctctcgagcgcgtgcgcggggcaggagcgacagggcgtgggcggcgtcgtggggaggacgcgggaacggcgtggcgtgggcgcgggaggagcggaggaggtggggcggcagcggcggttgccggcgtggggcggcagctggaggaaggggacgacctgacaggtggccacctgtcagcgtcccgaagagagggggaaggggaaacgggccggcccaaggaaggaggccgaacacggctaggcgagctggatcgggccgacggcccaagaaagaaaaagaggaaaagaaaagggaaaaaggaaaaaaaaaggaaaaaggatttttcctgggattaaaatattgcgcttgctcatttttaattggttaaaattatttccaaggctctgaaaattccactaaaaatcttgttaatgcattggagcatggggaactcaagaaaaattccaccatgctatttccgattattaattgcatttattaattagagaattagctctaggttaattaagataatttcttcggacgatttatttagccaatttttaaagcaaggagagggggaaacttcagggcgtgacacgcggcgacgacaatggcggcgggcggcagcggctaggtcaggcgaggcgaatccggtgcggtggcgagcggcgtcgacgagctcgggcgccggctggtagggttttttttttggacttttatttttttcgcgattttttctttttgtatgcggttgacttaagtgcccgcatgcggattttcgcatgcgttcggcctagccgcatgcaaagatcgccatctttgcagacgatttggcacatgcggttggcgctaccgcatgcgaaaatcgctcccgcccgtatgcaaaaaccgattttgtagtagtggcggcggccggcaggagaggatcagcggttcacggcggccggagggcgggagggagaggagcggccgtgcccccgtgctggcgaagggggcggccgacgggagcaccgcgagggaggaggcgagctcgtcaaggcggccgacaggagaggagcgacggcgcgtggggaccaacgggagatgaggcagtgcgcgccagtcgacgggagggagggagaggagcggtggcgcaccggcgggagaggagcagtggttcgccggcctctccaccctggtcagtatccctgtctcctccctccccgcccgtcactttgcaatctagtggaaagctagaggaaatacaaagagtggaggagtgggtcccactatttttattttttgttttgactgacggatgggtcccgcatattttattttattttattagtttttgttttgctcacgtcaatgcaagtaggacgaagacctagtcaaaagagtcacataggcgtcacgtcgaccaaaccagggtcaatactgccaagcgacctcgtttggactagttttgtaagttggaggacgggttgtaaccggttttccggaccgagaatgaaaatcagactgggcaacaaatgcaagtacctagaatgaacttattcctcctgctgttttgttctgttccgcaggcctcggcctcagcaaaggccggttatgttcctccctctgtctcacacggcccaccctggctgctgcgcgtctccgagcggcgcgatgggccgcaccacccgtagtccttcccatctgctcggtcgtccctgaggcagggactgcccgcagatcgcgtctcgctgtctccgcgcggctttgggccgatccactacgcagccgttgttcagttgctgcgtgcgtttctctgcaacatgccggttagaagaatcaagaatatacgataccaaaagcatgaatgtatagtagggaagtttcatcactcatttatattgttccatttatttattccatttgattggtgtcgtcgcgtcttcttttcatctacttttgtttcattctattgcatttggactttgtgtcacaaattatattataagtgaggcactaataaaaaatgtgtttttcttggcaccttctttcttttttttcctctagtggataaaattcgaaacacttgtgaaaatataactgaacgcccttgtttaatgatcactagttgtcgtcttaaaacaattgcctgtaaaaatatccccattttcacaagctatcttcctagccaactacttttgaaaatattttgtcaccatcggttctgctacgcaattgcgtgataaataaaacgcttcacggtattaaaaagggttaattggatccatgtcactgcaaatatgacatactaaaaaaataccactactattcttgaaatttgttgcgtgccgctagaatttttaaaaaattagaaccatgtcactctgtagatggatgccaagctgtctcgccagtgacctcgagcctccgccccgatatcaaagacgtcaccgctcgtggatgctgctattgctattcatgcggcccaaagcagagccaccccttgaggcccatgccgcagatgccatggacactaacttcctccttagggttgcggcagctttggcggcgacgaggaagagaagtagaggaaggaccagaaactcttcatccccgggctctcagccgtcacggaagatggcggagggttggccactggcacagcagagggaccgtggtgtgacgtcacagacctttctccgctctagcccaccgccgaggagtagagcgggggggcaccgctgcacggtggaagcatggcgactaggtagagggcggatgttttggacgccgagagggaagaagaggctggagtgctagacttggacgagaacacgagcctgcccagcttctcccgtaggcagtaggcacatatccctccgctagccatcgccaccaccgcttgtagggatgctcgctagcttcgctgcagtactgaatccatccaggcatgctgccactaccgagccatcatcctcatcctcatcatccactcctctctccgcttcagtaaccttctcccccatccttttccttccttcttggtcggatttaccaacagcacaagatccttcttctcttcttgatcccctatgctgcacgacgaacggacgaacaaaccaatctatgcaagacgagagagaaaggatgaaattgaatcggtgatatagcaacaacttggcatctatctctatgacagaaatcatgacggagtggcatggttcaaattttcaaaaatttcaatggcacgcactatgtttcacgaataatactggcattttttttatatatgacatgtttgcaatggcattaatccaattaatcctattaaaaacacgacatataaaaactgccatctctctccaccttatccttatcgcttcactctccccaccgctcatcccttcactccccaccgttcccatctttcttggtctctctttgtcacaccctaattttcgttcgggatcaaaaattattaaatagcgcatatctagaaattatgtaaaagttaattttatcaagtaaattaatgagggaattaaaatttccttttaaaatcatggccgaaaatatttttgcaatatcctttgtgccctaaatattctctgaaatttctcttgaatttttggagctcaagaagtaattttaaataaaacaaagttcattaaatcaattaaattaaattgaaaaccattaaagttctcccaataaaggtgcagtgttaggggtaccccaagacgatgaaaagatggatggaatatttgagagtgatatcatatatggattattagaactctataaccttgaaagttatgtggaaaatagtgaccggaaacaacaccctagtggtgtgaacatggatcaagaatggttttacttaatttaaggcaacagttatagcttccagaaatcatttcaatgcctctcggaagttgactaagaaatcattccatacatgggtcagaaagatacaagggtcaggtccggaaaggtttagccagcagagtgtacgacagagaatccttctcgataaatcatcccaactcaaggtttgaaagtggagttattatgatcaaagagaaagagcagaaactcttgatagcgccaaagtcagtttccaacagtcatacagattgcagtatttgttggaaagcaactttagagcttatagtctatcaacccagaggagtcaataaaggataagcaaagaagtgaaatgttatatcgaggaaataatcttttgagcttgatctattaagtgatcagtgcttatttcaagatatcaactaagcagcccgttcaaccagttgacaccgaagtcagggcagaacagaacagtcatgcagatggaaaggtcaatcaagagtctgtatgttcggaaactgaatgagagtcacttttgtggaacttcctgtcaacaactgatcagtgttatgttccaagccctcttggaatgaaagtgcaccggcatcaccttatttgaactgattgatgaagcgatgagttctccaagtcagggttccaggaaaataaccgaagtttggttattttcaaggatagcagtttaattgatcacggtcaggcaaatgctcaaccacttgttttaagggtaagtctcgaagatgatttttgtcatgccccgtaaccgtttcaattggatgttcagataagcagggaaagaacagttatagctcaaagaagcctattgccaagttaacagatttaaatctaacgtgtacacccgggctgccgtgtcaacagttcagcctacagaagaacagggagaaatcgtaatccaggtgaaatgccgatcaagcaacttcttcaaatacttgtttccgggtcaagagtagttcaaagcaaagtaagcatatgaggattcacgaaagtcagtgcaaaagatgcaccaattccttgtcagcaaagtgagttatcagtttatcaagtatgtcagcactaacagttcagtccaagatcgaaattaaatggcacaagaaactgcattatgccgctctcatgtaaatagtattaatagttagcgtaaataatatgacaatataaattattccttcgtacgttaccatggcataagtgaattagatgtataataaaagaaagaaaaaaacaaaacctatattatgtttgcgaatgatggttgtagacgagtttacatataatagtgacaaagtgatttttgtttgcatgtgatagacattaacattcagtatattaaagtctatgttctatttcacgttataaattaatattttcttcttgcataattataacatattcttcttattgtgtatatgatgagaactggcttcttttaatatactttttacaaataactagttgggtggccctcgcaattgcgcggttagcatccatataaaattatatatattttaatatgttttacttaaaatttattaaatggttatcttgttgtctcaagacattgtaaaaccaaaccttatcatcctcatgtttttaattttattgtttttaaaagtcacactagttgctaccccttacttctgtcatatccttctttgtttgcttgctcgatc

SEQ ID NO: 76203 - DNA, 4483 bp, Oryza sativa
tgaggcacatctggagttcattctactttacctttggcatccgtcaacccagcagcatagctcttatgtttggtagttggtcaaataggtttaatccaagaatccaaaagttgatttttgtgggtatagctgcaatttgttggacggtttggctgagtgggaataatgtggtttttattgcttacaattttaactcgtttttgcaagtaattttcagcgtagcacattgggcaaggctcttgtcactgttgtgaagttgatggcaagatggtgaaggcttattacaagctcctcgaatcaagagtgctgaagttttatgctgcatatggctggaattttaagagaaggattcacgcttagttctgtttctttccttttgagtgagcatttgtttgatttgatattgaactccccatattctgggtgagtctatgtacttctttccataccttttggttatcactactagaaaaagcatttttcccaacgtaggggtattattttcacagtcggacatgacctttgaagccaaacgactgcctacaaaaatataaatcggggtgaagttagctgttcgcagacggaccacttaagcggcgcggcggaccacttaagcgacgcctgcgaaaatcaattttcgcaggcgcatgttaggtggtccgcttgcaaaaatagtacctacctccttatcctctcctcccccatccttatcctatcctcacctctcctctccaccactcatttccctccccacctctctctctctctctctctcacttagaaaaaatctcctctccacccccacctccgccgcggctggctccatcctcggctccccacccccgccgctggcgacgacgacgaccgcgacgccgcctccacgcgccggcgacaacgacgaccgcgacgccggctcccctcctctcccaacgtccgcgcgccaccggccggctccctcctctccaacgtccatgtgctgccggctccctcttcggcgacgacgacgaccgcgacgccggctctacgtgccgacggctcccctcggccacgacgacgaccttcgcgccgccggctcccctcctctccccacgtccgccgcggccgactccctcctcggctccccacctccgccgccggcgacgacgacgactgcgatgccgcctccgtgcgccggcgacgatgacaaccgcgacgccagctcccctcctctccccacgtccgcgcgccgccggccggctccctcctctccaacgtccgcgcgccgccggcttcccacctccgccgccggccggctccctcctcggcgacgacgacgaccgcgcgccgccggctcccctcctccccacgtccgcgcgccggcagctccctcctctcccacgtccacgacgagcgacgacgacgacgacggcgctgacgaacacgacgggcgacaacgaccacgacggcgccgacgcagcagctcggctcctccctggccggcggcttccatggtgaggccggcagcagcgcccgtgttttgtttttattttttttaggcccgcctgcgaaaatggtctattttcacagtcgatgggttagcggcggtcctcctccctgcctgcgaaaatggttttgggccgcctgcgaaaatcctttttctagtagtgtatgtgtacataactgtggatgtagtggccgggttttttgtgaatcacatagttttttagccaataatttgaatggaactataccatccacagtgaaaaatgagatcttagtcatcgattgcaagattgtagcactattacgtatagtatcatgtttcatctgtggtagcatcgtagatcaaaagtgcaggtaatagaaagctatgaagatatcatatggaagttgtattataaaactgaagaactccatgatgaggcatttaaaaaaaatagttcagggtagctgtaccgtacatcttcctgttttgaaaagagtatagtataatgattatactcctatgtaagatgtacatagatcactgctaacatacaaatcagtgtgccctttaacacatatcaagagataattaaatgtccaaatgccaacattcaatagccaaattaaaacccgtttacagaacaaatacagagattgctacgggctttgaaagacatatagtttggatccgataacgatccactgaggcatgtgtcattctacagtttaactcaggttggaggttactttcaacggatgaaaattattttggatagaggaagacaaaggctgagaggccactaaaaaaagagaaaagggtgagaggagaacgcgagtcctctctgggggaagagttcattacggagctactccctctgacccataaaaattatatttctaactaatttaggacaaaacagtaggattagaaaataaccacaatgacattatttaatgaacccattgcatacacacattccatatatacaaatgattaaaaggaaatttgagagaattaacccatataattagcatacttaaattacaagctgagagaacttaaggaaacttatctagatgaatcaatttgctgggccccacatggctagaaatataatttttatgggacaaagtcttagagatagaaatgtaattttttttgggacggaggtagtacgatcctatgaactcagagaagtcaagcgttcattaagttcattttatatgttaatttgttcaccaaaaaaatgttcaattcacacgaatatatatcattaaaggaatcatcatttttcaataggacttaaaaatggtcaggataagtgggatacctgatcccgaaaggttttatctattcaataataacttgtataatagctaaaaaatatatcgaggcaaagaaaaaaaaagacgagaaaacgtttcaaatcgatcagtacttctgatgtttgattaatcgctagtttcattttatccgattgtagtttgggatatggcctccaaataaattaatgtcggcgatgtcaaatgccataaatcaataaatatatttgtgatttggctattgctaagttccaggtgactgaaacttttagcaatttcacgaagtaagcaaaactcaactgggtttttctggtttttggtgatggaacttgctcacccggttttaaatcctaaacataacacatgtgctcgcatttatggctaatgagacgtccgtggtgatttgtcaatctcaaattaaatatatcaacctaattttttttgaaggttcacatagggggaagggtgtgagtttctgcatttgtagggctgaatattcacgtgttgtgattgcattgttagcatttgtactatgttttaaaatgaatatttaaataatttcaatcgcattcagcctaacacccaattcaaggaggaggggagggactcactagtgatggcgacttaaatttctagagatgtaggctggaagtgtgcgggatcagcggtgggggtgaggtaggccatggggttagacgccataactcggaatatgagccctagtacaaaactcaaatgagacttatacttattaccagaaaatgctttatactattacctatgttctaaaatagaaatttgttactgtatatctgaataagagtatgtctaaatacataaccaaaatttgttatatattgagactgatggagtagtaaatatcaatttaaataaaagagtaaattgcatcgatgccggtggcaggaaaaatagttgcgtcttaattaatatagtaattcagttttctttattaaccggaaaatataatcatttgcgccaagaacgcgcgttaacagtgtcgttaactcgttataaactaactctttgaggttttgatgattatcaccaaatatttgttgaagtggaagaaaacaaatcgcttatagccaaatcactagagtaaagtaggaaaacttttaaaaaatataaccggagatcatttttttaaaggactcagacagtacgaagttcatattgatagagtagaaaaatattacaagattacaatcctgagaggtcatagccaagaaaatgaagaaaaaataaccacggcccacacactaacaacaccaacacacgtaatcgagagaaggccagcaagcacaatcgagagaaggccaacaaaaaattaccttgttgctaagttggcattttagatgaaacttttgctggctagaaagcacaattcttgtacctatatgcatagtattaagtagttctttaattaaaaaatattactgttataaatgtttattggtgataaacacccctctcaatatctgtaataaaacgaagtgtttcaccatacagtaatttaaattaatgccaatattttttgagattaataaatgaaaaaatggcacacaacaccatgtataataaaagagttgaaacttgaaagagcagtgcagattaatcacaccactatccatccattattagttgatatataatatgcccattaacccaagtcaca

SEQ ID NO: 76204 - DNA, 39567 bp, Oryza sativa
cccccccccagcccccacgttgtctctgccgctgcttgttgacttgatccactcggctgagtcagcatgtgggcttacgtctcacccgttttgtgtttagagggcaagaatcatactcagatcatagtcgagagagcaaattaatgtctctcaatcacaaaaccgaatatttcacgatcccaactaatgaaaccggtgcaaaaggagtttttttttgagagctctccactttgagaacaagctgtagtaactgaacatacgtgcaaacgcactccaccacgcacacacactccacacacgcacccctacacgcatgctagacctatcaactatacacacatgtgctaatgagatacacaaagctacctaaggaccttgtgcgtgacgaggacgtcactctattattgtggcgttggcacgggagagctggaaatttatttgggaataaatcccggtgagacgcgcgggtatgatcccagggatcgaacccgcacgggctgctcgctcaccagcaatgctagccaaccgagcaacgctcggttctcagtgcaaaaggagttttgggggcggtttcatccgatatggctcgttgacttgatccactcagctgagttagcacgtggactcacgtctcacccatttttgcgcttagatgggaaacaatcatactgggatcatagttgagagagtcaaagtatactttatatttcctaccatcccgtcaggggacccaaaacacccggcccctccgactagatgtggcccaacccaactcgtggccacgtctcgccgtgcatttcagccgctcttgccgtgccacgcccactcccacccatttcacaggacgcgcgcggcgcgcaacggctggcctctcgcgcgacgcgaggcgcgcgccgatgccaacttggcgaggcgagcaacggggcgcgtggagttggtggcaatggaggcgtacgcgtggtgtggataagccgcttgtggccgcctcacacacccgctctcctccaccacacgccgcccaatcaccacctcatatacctcgcgatccctctcaccgccgatcgatcgagacgacgcatcacccatctcattctcatcatcgtcgcgtgagagagagctagagctgagctaagaatcatggcttcggtgggattcgggagcagagtggcggcggcgggcgtggcgccgtcggcgtcgtcgtcgtcggctgggcggaggcggccgtcgcgggtggcgatggcggtcggcgccacgagggggaagccggcgccggcggaggaggagaagagcctcgccgacttcatcttcggcttcatcttcaagaaggaccagctcgtcgagaccgacccgctgctcaacaaggtcgacggcgcgccgccctccggctccactgtctcccggaaggcccccgccaagaagcccgcggcgagcgccgccgacgaggaaggcggcggcggcggcttcaacctcggcgccctcttcgccaagaaaggctgaagaatcctttcgaattctacgtacgtatatactccaacgcagagcgtcagcttgcctacacgatcgatgtattaccctcctcctcatcaaacagtttgattcaaactccaagcttaatttggaggatgatttgcgtatacgtagcaacatgtgaggtgtgactcaaaagtgattaattttttatgtgaaaatgtggtttatatacttcatacaacacacatcatttgttatttcttttcaactcaacatggatgaatggattaaaagggttaagcctgctgatcatgttgtgttttgtctcacaaagcatatggtaaaagattgtgtatgttaacttagtgcctacgtgtgaggtgtggtccaaagtgatttttgacgtgataatgtggtatactacatcatttcttgttctttccaattcagtgtgaggaggattaaaagggttaaacctgaatacctgatgacattgttttttcttatcttacatacatatactccaatttggagtgaacttttctgtcaagaaaaaaaatagcaactttaggtgttggtatgaaactatgaatcaaataatctggagagttttgcacaaagattggcagcctcatcttcacatgatccctccggccggcctagagcccgcttgattggcgactcagattggaagcaccaagccttttcttttattttgcacaatttttttctgttcaacttcatgagcagacagattgcagagagttccaaccggtggctagttttgcagaatgctttctgcctcaccacaattatagaccaaaactgaacgcatacacaaagtgtgtaaccttatgaacaaggactatgcacaaaacccatgaatgatccaccaaaaaacaattgaacattgaccatatctctttacagtatataattgttgataggtaaagcggcagtgagacctcttcatgtcataaatacacattaggacatttttgcctttgcaaagaatatcccagcaaaaagacctgttaagtacaatcaggagacatgttatgtatacacacattcataaagaaaattagacagcaattcagcagtgatgaagcaagtactcaccaaaaattatgctaaacaaattttcaacactcactggtacgttgaaaagcaagataccagccaccgaaataggtatcttgttcagtgaaccaacaaggctgaaaacggaaaccaaataaaaaaaaatatcaacatgtagtcaactttgctggagtgacaactatgcaaatattattttaatgcaaatgcaaacatgttttattggcaacttgaaggaagagagttagtagtatcatatcacctgtaagttgttgggccagtccgatgtaaaaaccacacagatgagaagctaattgccagacctagcaaaccactagctgttgcaaaagcccagaacataggatctctagtaacttcactgcagatgagaggaaaacatcgtgtataagtacaaatggagaagcatggacaacaaccaattctgcctttgcagcaacagttacaggagaaatctaacatcagggttctcccctgatgtattcccgttaaaaaacaacatgtggaaacaacgaaaagttcattgatcatctaacttcatattcaagttgattgcaataggctgaagcttcatttatgagcaaaaacagaacatcttatttatcgaaacgaagccaagtttagaagcagagtagatgtacagcaagattttcatatgtccttttgtgttacttgcataactggtaaattttagggcagattacttttgaatggttaggttgggagtgaagattgagttcttacacttcataaacgtattgccattcgtcgaagataacaatcaaaatgagtgctaaaggtatggagagcgcattgttaagtaacaccatagaaacttcattgagggaaccggattttgttgattgtttggctacatccatcacacgtcttagtgtaagctgtaacaagaagtaggaaaattatgtacaacccatgtgactagtaggaggaacaagagaactgaaggattagaatacttcccaaaaaaaatctgctaagaagttcatcaatatattaattgtaaagaggcttgcaaagttgcaatatactgtggatgcaaaaactatgatcagaaaattcgactaaccgagtagcctgctgtcagaaagcaattgaaaagttgccacatgtagccaaccggatggaaagaaagatctgtaatccccccacatacagctgatataacctgcatagcacaacagagataagcacctgctcagttcaacaactatgctgttaaggtgtaaagttcttaatacaggccaacaattacataattagctaatatttggaagtaaacaagaggcacgtggagcagaaaaggacataccattagacacaaggcagcccaaacctttttgttctgacccttcctgaaaatatatatttctccaacagctgtcaaaatgtttgtcatgttctttaatatcgtcaccattgcaacatttatgtacttcaaactgaaaaaacaggaatatatagctctgttatactttgtgcaatatcataaaaataaagttcatttggattttggatattggagctttagggtgatggaccgattgtcatatatcatgtcgaagaattacgtacctgtacattccagttactaacatcccaacaaaaataagattcactggaatccagactttaatcaacttccatgtaagtttctccgttgaaatcacaccaaagagctcaagtaccagaagaattatcacgcttataagattctgagccacaaaaacagccatgatcagatcgatgatagaacttgtttgccaatgcaaccataacatcacaaatgcatatgaatgccgttatgtgtaagccactgaactaataaccaactcactgtgaatttgtgattacttcaatgtcggtttgtgattacgtcagagtgaatttgtgattacctggtacagcataagcgatatgccagcattgaaattatagttggagagtacaactttgttgagcaatatcatactgcaagaggcaatacagtaacaaatccccgagagtagaggtccagttttgtttccccacttgctttgctgcttctgaattaagctgtcaaaaacgtcagaagtcttcctcgacaacctggaaaatagcattcaaaacaatccaccagtcaatttctccttccttccatatgaagctgagacacaaagaaaacaagtagtactactaaattagattagattacttgttggaagccgctttcctggcgacattggcggcgaccttgatgatggagttgttcttctgcttgaggaagccgtggatgatcttgtagacggaggcgtcggcgttcttgactgcgacggcggcgacgctggtgttgggggacttggcctcctcgatgtcatcgtactcgggcctgtagtccagcgacatggacgccgcacctgcaaacgcgagagcagtcactcactcctcacagctcactcaccatgtcagacctgagatcgaacagcaagcgagccgccattgccgttacctggaagagatcctcggaagcagaggagggaagaacacggagatgatgagtcgatggggggagaggggaatgggaggagatgctaaaatggaggaagggggagatgcctttcgacggcatgaaggggcttggagacgacgcaaagaggatgaggcggtggaggccgcggggggtcaacggatcggggcgcggcggcgtgcggcggaagggaggccggagagaaagtcgcggggcggcgggagagccgaggaggagaaggtcaatttggcggcaatgggtggaggagaattgttggagtcaaacgcaagtcaagtgagacacctcaccctggagaattcacacactcatcacacgggtttgaccttgttattttagccttttagggtaagtacattgtttacattgttggcatatgattatggtgatgatagtatgtaacatgtccatctgaccatttcacatgtttcttcctctcgtgtaacgtgtaagtacatgtttttcatgtactttagagcgccgagaacgttttagctaattagctacatgtaaaatgagaaatataattaacttataattaattgagtattaatttttaaaacttaaaaataggttcatttgattgtttaaatcactttttatataaaaaattttctcacgaaatgtatcgtctagtagcctgaaaacatgttgacaacatgttgacagaatacgagcagtagctaagctcgattagctcttttgagtgcgctctaaattttttttgttatcatggtttagaatttcgggttttaaattgtaaacacgacaatatgtatagactatataggggaggatctcagtgtttccatcagttaaaaacctctattattcgtttgcgcatgtgtttgttcagcctctaaaaaatatttcgatcggtcactgtgcctacatgaagtttacacgcaaaatatagttgaaatggacaaagaaaacattcacttatttatcctgtttaggtaacttcactcgaatcattttacacggtgtttacttgtgaattaaaaagttaatccttcgtaaaaagctactacctccgtttttgcactttagatgtaatgaaagtaatttgatgctataagtcaaagttaaagagatgtgtagttcagggttcagaattccgataaaaatcggtcaagttccgtgaaatttcgaggtttcgacgatgctcaaaagtagaagccgtctaaaatttcgatgagtttcatccagatttaaatttgaattgataaaaaaaagaaaaataaataaataatataatattcgtaaaacctattaggatataaatttttgaaaaaaaaagatatattccatgtatttactaatttatagtaggaaagaaaagaacaacaaattaaaaaaaggaaatcactttcagttacctctcttttttccagttatcgattgaaatttcgatggtttcattcggaatttcgtcaaagccgaccggttttcgcaagcttatcgataaactcagtgtatttgcattcaaattttgatttatgaaatttgttcagaatctaccagcttctcattctgctagagcatgaaaaagaaggccatctcggaatcgtaaactggtgcagttgcatgaaagaaacggagggaatactgttgaaaaaatcgtaaaactagcaagacattttctgtccgttggatctgcaatcgacggccagacataggccaggtagctgacctccggacgggaaccgaccgaccttcctggtggtggatgttctagccaagaaccctaaaaaaaaaattccccatctcctcccaatctgattcctctcgagacggcggatccgagcaatctctccggcggaggcggcggcggcggcggctgacgagggaagatgaatcctctgacgcaggtgaagaggacgcaggtaatcaaccagaaggaagcgcttctgggcatcggcgaggacgggtcgtggcacgccaagttcaaggactccgcctacgtcttcgtcggcggcatcccctacgacctcaccgagggcgacctcctcgccgtgttcgcgcagtgagtagtaccagacccccccactttttatgtctatgttgctcttcgatcaatcatggatgcagcgcggaagatctgagcagtgtgtgctctctccctcaggtacggcgaggtggtcgatgtgaacctcgtgcgcgacaagggcaccggaaaatccaagggatttgcgtttcttgcgtacgaggaccagaggagcacgattcttgctgttggtgaggtttcttatcctcttatttttcacctaggtcgtttctgtatgtagctttttgtgcttgattccttatcgaattgaagtgctgatcatcttggtggtgtttgtgtaatggcgaagataatttgaatggagctaaagttcttgggaggattgtaagagttgatcatgtgagcaaatacaagaaaaaggaggaggaggatgaggaggagctgcagaagaagagggaggcccgtggcgtgtgctacgcgttccagaaaggcgaatgcaaccgtggagcttcctgcagatattcccatgatgagcaggtaggcttcctgcttgtgtattaaccaaattgttgtacattcactagaaaaggttgctgaacgaatcagaaatcactatcctacgtgtagggtgtagcactgtagctgtttgcattagccagcagaaacatatttctggatcagttattaggtagaaaatgggtaccgtgttgtttcactacaagttttttggggtaaatggaccaatgttttctcatggtgaggctatgctggaaagttacatttgcaagatgcaaggcctttagtaggttcttacatgactatgaaatcaaatatgatctactatttttagcagaatatttgacaaggcatatgttcttttttcttaattgttcctggactatgtcgtggtttgtaattgtagccaagacttatgtgcactttaattgattgagctgattgggaattctatagtggatatgtgaattaggaggaacatcattgtgtatgttgtacgctgttggaaatgcaagatcaatttcattttgtccaagatgcctagatacaactatatggtacagactatttccctgcaccagatttctgttgttttgcaagaaaaatacaatataggactgccattgtgcctttttataatgtagtatggaaatgttttccgttaatataggattgtcatagtttatgaatagcttcagtaattttactgtctcagtttatctgtctggtgactaacatggatgcacatgaactatattctatatatacctatacttgcagaggaatgcaaacactggttggggttctaaggaggagagcaaagcaagatgggagcatgacagacaccatgagccaccgatgagccacaagaagttcccttcgagtgctggggaacaaaggttccctgacagagctaaagaggagaacaaatcaactggcagggaagggcagtcctcaagatcggaggcatacaaagaccgtgattccaggcttaggcatagtgatagaggttcaaaagatcatgacaggtataggcatgatagatcacctgagagatcaagaggtgataggcagagaaacaatgacagatatgcccaaggaagagatgaaaaatcagaaaggtacagatctgaagtgaaacatgatgaaggagaccagaagcgatcaaggcgggacactgattctagtggacattatgaaaggaggggtaacgaagattcagaaaggtacaggaaatcacggagataaaatttggatttgttgttgcttcagacgttgttctgatctgttcgatgtttgttcttgtacgagatggataagatttttgtttgatccttgggtctgatattagtctaatagatgccatagattacatttgagatgattttgaacgcactggcccatagaccatagacgagtttgcaggatgttaactcaatacattaattaatcatttgtgatcaatgttaatacacttgtctgatgaatcagcagcttggagcctttttaagaaactttttttaaaaaagaaacttttgaatattgctgacgttacgaagagaacataacggcaatttccttctcttttgaaaatatgcatttgtagagcttgttcagttctttattttaaaaaaaaacttaccatttgttggtgaagtcaagatttaatgatgtgaagggtagtgtttagtttgacaccttatcaaattttagtatagttttgtgagtagaagtttctaaattactgaatataataatataggtagagattgggaaggttgtgatggtaaaatcatgtttagtttgctgtcttactaaaatttgatattgttggtgacactcaagaacacgttctacagctcatctccagctatcgcatcctgaacacaggttaaccagctgtcagacattccatctgctatacatttattgaatttattacgatggtttaatccaaagcagcgaaatcctacagcacaagggccggaatggtttctgctctactagaaagcaacagaacataaaacaaagctgtcctaaactgggtgatctttttttatctgaaaacctaagctggatgatctactcatctacgaatgtagactcggcaagatcgatggcacgagcaaggccagcagccttgttcaagcactcctgatgctcatcgtcaggcttgctgtcagcgacgatcccagctccagcctgaaggtgagccacccactcctgacgagcattcttgtcagtgtaggagtacatggtgtcgaagcgagatcccgtggggaagacgatggtacggagagcaagtgcgatgtccatgtctccacggaaagaaacccctccaaagccaccactgtacggcccacgcatcttcccttccatctggtcaatcagctccatcgctctcacctggttgaagacgaggatgagagattgagctcggtggaacatgaataatgcatggtagatgttactccctccgtttcagtttataagactttctagcattgtctacatccatatatatgttagtgaatctagacatatatatgtgtttagattcattaatatttatatgaatgtgtgcaatactataaagtcttataacctgaaacggaggaagtagatgaaacgaaggaaaggcagtggttaacaaactatggtcaacagtcatgtcaatatctgatgaatatgatggcgcatatagatatattgagttggcagagtgtttctcgttttctttctgaaacagcattcaggtgatgcaaccatacggtgccaacatgtatttccttacctttggtgcaccactaactgttccaacgggcaatgctgctcgaagagcatcccaacaagtcagatcatcacgcaactctccagtaacctacagaaatgcagaaacagaccttgtgagaactattaataagtaataacacagccatgacgaatcttagtagatatgacagtaagaaggatggttcctagctactagttactccaacaactgtacacaaacaatacttgattgtccaaggatattggatattgtcaaagctgtatatcatacaggtagacttactgttgagctaatgtgcatgacatgtgaatatcgttcaacgttcatcagtttctccacctttactgaacctggtttggacacctgaaaaaaaaaaggcaaaagtttatcacagatcagactagatgaagtcagaactcagaaatgtaatgaagccaattataatagcaacaggatgctcaacataaaaaatagagagtccaccttttctaattaaatcaggcctttgttatcactaatgcacagacctatttttctaccggatcttaaaataacgcattctattattctgttacctgttatgagggcgtcaaaaacagtagactctttagctgctctgcaaacctattgtttacataaaaatgcagcacataaactagtttaggtgagaataagacaagtgaatgacccttttttgtgtgtgtgtgtgtgttttgcgagtggacattgagacatttcttgtcacattctggtaataacatgataactatgctcctcggaagaaactagaccatcttagatagagaagcaagggtcatttacaatatcactgtattatagtgattgaaacaaaggcaggtgctgctataagttgtccaattgaataatattgttttttttttgtatgcagaaaacagaggaatggaattgattgagaacaaaacaaatgcatggaaaatcaaacctttccaacatcattccgtccaagatctactaacataatatgctcagcacactgctttccatcactcaacagcagttgttctaaaactttgtcttctgctttcgattttcctcttctaattgttccagcaagtggcctgttaacaattgtcctctggcagacagaaaattcactctgcattaatatttctagagaacttttacaggtgctacagttagggagatcatagtaccttcccttttggaaacacaaactgcaagaaatggatagttttaaaagggaattgcaaggagcagttctctgtttttggagaacaaagacacagaatagtaaacagttcagtatgggaagtccatttcagagtcactacacttgtttattattgttgttcttgcagaaaatcacacccaaagacccagtatttcatcagatactagaggttagtgcagataaagagactaaacacagaaagtgtctttgtcatggcacataagaagcaataattagatatgtgcatcccttagacaataatgtgttattcaattttgaaacttctcaagaggaataaaactaggagtgatggtatataaatactaattaggtgcctgttagctatggcatatcaaaaggaatactttaaacatcacatgcttctacccaacagaaagctagtcacagccctcattgcagtgtttcacctgagagatgccttttccgcatcacattaaaggactcactagttccttaccgcatcagccaactacacaaatttagaacttttggattcagtgttacatttacagctgaaccttccttataccaactatgggttttcatgtatcttttctgttcaaagatacaagttacatcacaatcattagatttagacggccacataacacatagaatagagtataagcccctacttcagcgtaccttttccacccgggtaagaatttcaggacttgatgctaccagaatacaaccacgagcctgtgacgatattataggatataaagcatgttgttcagcatgacacataatttaccataagaaatttcaacaggagtactgaaaatattcgtcacctgtagataggccatataaggactaggattgacaatacgcaatgcacggtacacctcaaaggggtcagcaaatgtccgcctctcaaaacgctggcttaagactacttgaaaaatgtcaccagctagaatgtgctcttttgcttgaacaacagctttcttatagtcctcccttgacattgatgatttctgtagtgctgacccaaattgcccaacgttaagttttacagaaccagcagtaagagttggcctacatataagttgattgaaatatgttagtgagaagcagaaatctaggacaaaataatagcactaatcaaaatggataaatggaaaatggaggttgatcagtcactgtaactcacacattaacactatgtaatcttgataacaaagcttccagctgattcttcccgtcctcatatgcttcgtcaactgactcatggcaatctaccctcacccaatgtataacatgtgttttctagaacaaacaaaacagaaaacgtgaagccgatggttacaagtaactatactcgtagttccaaaagtggtggttatagtagacacttagcaaaagctgaaaaaatgtgtcttattttttatggcgttaactatttcagaatttgttgttctctaaatgggccttgttcatttgtgaatagtaagagtctacataggttggtggtggtcaattatgaaatggtgaaattttgaatcaacaacagagggtggcataataataactaatcaaaattgaaaagtaatacaatgacataaaaaaaggaaaaaaaaattaccccatataagaacatgacataaacaaacagttgtaacggcatataaaagataaaaccagaaggcataactagcatacgttctttaacaatttaacctttacttcttaaagcatatttgtaagacaaaaggcaggatttgcggttcggatatgcttatgtctaaagtacaggatatatgattacctaaattacacacagttcataaaagtagtcagggtaattattcataccttttcaacatgatcaaacacaactatgtcattgtagaggcctaaatggatgtcaggaaggttcctatcatcctctggcgcgttagaaaatggaagcttctttgtttcaacataacgcactgtgtcgtaagagaagaatccaacccatcctcctgtaaaataaatcccaagatgcaacagaataaattatcatggctttagagggaatatatttgcaagaccactttgttagctgaaagaaaaagacaacaacgctgtacaaagccatataaatctcaactggctgatgtcgacaaccgtacaaagccgtacaaatccaaactgactgatgtatcattttcattgatctactagaataaaagcgatcggacaaaaagtactaaaacgaaacacgtgtaccagttggtttcggatgaaaatgggtccaagagaaccactcaatgatcaaccaccgtttatcgttatagcttttgtttttttgctgggacgtttaccgttattgcggttaccattatagcttcacagacaatcaccaacaagacaggtgcctactataagtagaaatgcaatatcacactattatagccaacaatcatcgcattctcattccaggattccagactaggacagataagttaccacaaaatgcatcagggaggccttcaacaatctgtgggttccactgttccataatgctccttggtatcttcatcgggtcaggcgcaaattgctccctcctagacttcatcttatgatccatgacagtcacatggttggccttggctacgatctccatcgcaggctgtgccccaaccacactgtacctcccctgcaaattatccaggaaaccctcataacactgttggaacaaaagggaacagattaagcggatgaaacagtaccacattggtgccctcggatccctgctcgacggactcaaacaggaagctgggcgcctcgcggtcgtcctccctgacgaggcagcggtacgcgagcaccggcgtgaggtggtcggagaagatgcatcgcttgagcggcaggatgttgcaaccctccgccgcccccgccttgaacttggactcctcctccctcaccgctgcggccacgagaacacacatttcaaatcaaaccaccaatccgcaaaccaagacatgcccccccacatttgatacggagactcaccgacggcgtcgagctgctggaacgtggcggcgcggcaggcgacggcccctcgtcggccgcggaatcgccccccgcccagccccagcggcggcgtggacggcgcgatgcgcagggagagcacgaggctggccataggtgggggataaactctactggaccgagccgttggtggggactagtgcagttgagagaatgcgggatcggggccgcatttaaataggtgcgcggcgcgccgcgcggaggcggcgaggggctcgggcgcggcgcggcgtgcgcgcgcggtgcggtgggacacgtcgcggccgagccgggcgtttcgccgagcaggtggtgggcgaggtcgcgtgcgcagccgccgtgccgctccaagactccagagaaagggattgagttagccgcggaataccagctacggttacctctgcttcttggaaaaagtaagggctttatttctaaagattattttttccttttctttttttcctttttgggacggatatgcttatccgccacgacattttgttgttgccaaatcactgaattaatcgtttcggggcagcaagataaacacgtgcaaactctgacacattatacattttttttgccacattatacggttcttttaacgactagataacacgaaatttatattgataaacatgaaaaagtttataagatcacaactatgagatatgagatatcgtaactagaaaaacgaaaaaaaaaaactatcacccacacactgatacctgaatacatacctgaatgaatgaagactagcatcggaccgatcgctgctatgtgtaaccggccgccgctaggccacccacattatacgtatattattttataaacacgtccaaataccattgtatcatgaagcgttgatggagaaatacaatgcattaaccagcaaagctttatcggtgacagtgacactcaatacaacagatagcataattatccacttctacaattcctaataacgtcttctcaatgaaagtgtgccactcaatgacaattatccagggtttattgggcccttctaatgggtgctcgatcgccagctatcacgctgggcgatcagttcatccccccctccccatatactcctccctcttctccctccttcctcctccccttcttctcttcctattacagtacaccacacaaattttttttaaaaaacaaaaagttagaaaaattcatgtatagaaatactctatataaaaaatttgaattcaaattcaaatttgaattgggtatgtaaacttttgacttataaactttgggtctataaactttaggtgtataaacttttagatgtatagaaatactatatatagaaaatatttgaatttaaatttgaatttgaattcaaattcaaatttgaatcggatatgtaaacttctgacttataaactttaggtctataaactttaggtgtataaactttagatgtatagaaatactatatataaaaaatatttgaattcaaattcaaatttaaatcggatatataaacttttggtctctaaacttcagatgtgtaaacttgagatgtataaattttaggtgtataaatttactaaaatagaaaaagtaatacggtaaaaaaaaaagaaaccatgtgcaggggtgaaggaaggaagggggaaggggatcgatcgctacccccatccccgtagcgatcgatcgtccatcagcattcctgggttttattagccgtaattaaatgttggtgctctaactcgtttaggcctcgtttagtctgaaagagatgctactgctgccgaagcaacatttcatggcccaagtaaggcccagtgagaacttgggctgcccatgtaaatttctgtttggggatatgggccgagccttgttgagtactctgtattttgggccgcatcttcgcgtcatgacatgaatggaacgatttttttttttgagaaatacgaagtcgaatgagcgaatcgctgatgtaaacaaggtagattagcttaacttgcacgatttggacgtggagcagaacaagcctttcaaaagggtagaaaaaaatttcacgaggcgtagaaaattactccagattgatcggatattctgctggccacgcatatgctgctcatctgacctttcgattgcctggtcattttcacagatacattttattcaatcttttgccgtgctagctgaattaactgcggacaaaagtaattaagttgcaatggacctctccttttagttttcttttaacaaggataccgtgacagccatgtggtttgtgcttgattaatgatgggtctcactcttcttttgcaagtatatgtttgtcggtcccttagaaaaacaaactaacgaacaattaaataattaagaacagtatgcctgcaccgactacacccctgattattggcatgcaccgttttggatgattggctcatattttctattacaacttgcttgccatgtgtagggtttagttttatatagctcttacaagaattgaactatttcatatgaaattacaacatttctggtgatttctagtctctacatcctctgtaaaaaaacaattctagctataaacctaccagagacacacgtgtcaggttcatagttagaattaagtttttctataagatggagcaagtctttgactgaacccattttaattccattggttatatgtggtgtttaaggggagaaaaggacgtataagtaaaccttaacagacaatagttacaaaagacttccaaatattgaataaaaaaagaacagggaatagttggtgtttcctactcctaatcattgtctttttactcaacaaatgctgatcagacaatctggaggaatcaaggagacgatgtttaattgtaatttaagaatagcatacatagctacttaaaaggcaagttacaaaaagacaaattctaactctcttttttagatgaaaattctaaaactctgttttttatatttcacaagtctaccaaacatgtggtttgtgagagatgaggcatcctggaatgaactgactatagtgtaatgttagaaaaatttcgaacaggtactcctacttgttacgcctctttctcaatgggaaaaaaaaatcgtacttgtcatgataagattccaaaaaaacacacagtcgtggcaaatcctaatctgcaatctgcaagtagatttttttttacataaatctgcaagtagatggttctaaggcaatctctcatctcatgactaaactttgacaagttgtattagtataatcgaaggttaaaaaaatgcagtatttgtaaaatccgaattaactaactgataaatactccatgaaaccaacacatggatgcgtgtggttgtcgcatagttccaatagaaaagagaaccccaagaaaaaaaaatctttagattcctgtaatagcatatgctttcccattaggtagagagagcaaaagagagaaccttctccgacactgctccccggaccccacagaccagtgaccccaccagtcagcgacacattcaccaacactcgtgggcccgcgttgcggtgaaccgtgaacgcagcgacccccactgactatgacactgggtcccacctgtcaggcggtaactgctttccaagtctaaagtccaacccccgcacgggtaggaaaggaaagaagaggagaggagacacgcaaaagcaaagcaaaccactcgccgaacaccaactcctcgccgccgccgccgaggaggaggaggagggagcgagcttgacgccggcgccatggcgggcgggggaggtagggagcggcgcggcggggggaggctgctcgtcggggtgctgctcctgacgctggtggtgtccgggcactgcctggagagcacgcaccaccgcgggctgaagcggcggcggcggaagcacgagatccactcgccgatcaagacggtggtggtggtggtgatggagaatcggagcttcgaccacatcctcgggtggctcagccgcacccgccccgacatcgacgggctcaacggcacgcaatccaaccgcctcaacgcctccgacccttcctccccggagatcttcgtcaccgacgaggccggctacgtcgactccgaccccggccacggcttcgaggacatccgcgagcagatcttcggctccgccgacacctccgccgtgccggcccccatgtccggcttcgcccagaacgcccgcgggatgggcctcggcatgccgcagaacgtcatgagcgggttcaagccggagtccgtgccggtctacgccgccctcgccgacgagttcgccgtgttcgaccggtggttcgcctccgtgcccacctccacccagcccaatcgcctctacgtccattccgcgacctcccatggcctcaccttcaatgcccgcaaggacctcatccatggcttcccgcagaagaccatcttcgatagcctcgaggagaacggcttgtcctttggcatctactaccagaacatcccggccacgctcttctaccagagcctccgccgcctcaagcacctcgtcaagttccaccagtacagcctcaagttcaagcttcacgccaagtggggaaagctgccgaattacgcggtgattgagcagaggtacttcgattgcgagatgttccctgcaaacgatgaccacccctcgcacgacgtagcgagggggcagaggttcgtcaaggaggtgtatgagacgctgcgagcgagtccgcagtggaacgagactgctctgatcatcacctatgatgagcatggtggattctatgaccatgtgcctacgccggttgtcggggttccacagcctgatggaattgttggccctgatccttactacttcaagtttgatcggcttggagtgcgcgtgccttctttccttatctcaccatggatcgagaagcgcactggtaagtacttgtgctgtttgcatctattccctttcaagaagttattccttgaattttgatgtctataagtaaagactattgattagcgaacttgttaagattagtctctgttagtatgaattttactgcaatattcgagggagaatttgtcattcattctccacagaaacattcatcgagtaacataggtgtgtaggctaggtaatatagaccgagcctttgagtttccatagtagataacatttcaaaaagttgcatatgaataaaaaagtgcaagacatttttagctaacttgttctatgtagcaaacatgagttctatgtttgctctttgcttgtaaagttgtacttgacaaaccaaggaacttgaacgttgaaccactgtaaggcacaactgtacaagcaaagagccaactagcatgtatcatgctgttttatgttggaagggccagttgtgccttacacaaccatagaaatattttaatggtgttctgttttgtatatctcttagtattaactggtcttgcttttcatttctgcagtgatccatgaaccaaatgggccgcaggactcctcacaatatgagcactcatccatccctgcaacagtaaagaagctatttaatttacattctaacttcctgacaaagagggatgcatgggctgggacctttgagaactacttcaaaatccggaaaacacccagaactgattgtccaggtatatagttttgtgttcattatgttattattagaagatatatgtactctactacaccaatgccattttgttgacgctgacaattatttagggaaagtatcacaaagttcagatattgtagagcattctgttctggaagctcccaatgcttacagttgcttatcaatgcagagttttggaacttagttaattattactgaaattgcattgcaacctaattatatatgttattgtttcctaacagagaaactcccagaggtcacaaagtctctgcaaccgtttggccctaaggaagattcatctctgtcagagtttcaagtggagttgattcagcttgcttctcagctcaatggtgaccatgtactcaacacctacccagatattggcaggactatgactgtgggtgaagcaaaccgctatgcagaggatgctgttgctagatttttggaagctggcaggattgctctaagagctggtgcaaatgaatctgctttggtcaccatgaggcctgcactcaccagcagagcctcaccgtcctctgatttatcatctgaactctgatggattgttctcagatttatccacaattctgcatcatgatttgcaccgcgtcagcttttggttgatgagaactcgtacaatgtgctaagaaaacataggtaggttggtgtacggcaaagtgtgctagtattatgtaattgatagatcttaaacatggctttgtacatagacatcatgatacttgatatctcaagcttttacttcagctgtcctctgataacgctgagatatcagctcagaagtatctgataagatcctactctggataagctggagagggaatttgtaaaccatcgatattcagctctgtacctgcttattcagcagttgaactgcacttctgatgaaatactttatgtacaccagttatagtggtattgaaagatttggcccgtatgaatgtatgatgtttgtaccagtttgcatctgttatttctagctttaaacaatctgtgcgttaatctgcccaactgtagtactgtactataggcatagtatgaactggttgttcaatgctgattttgtcagcttgtcaggtgaaaaattacaatccctcccttccaaaatataagaacctaaaattggatgggacattattcgtaatactgaaaaatgtcctattctatccagatccgtagtattaggaaatgtcatatccggtcctaggtttttatattttcggatgaatagagtactatattcctgaaaccatatggtattagggcccgtttagttccccaaatttttttcccaaaaacatcacatcgaatctttggacacatgcatgaagcattaaatatagataaaaaggaaaactaattgcacagttatgggggaaatcgcgagacgaatcttttaagcctaattagtctgtgattagctataagtgctacagtaacccacatgtgctaatgacggcttaattagtctcaaaagattcgtctcgcgattttcaggcgagttctaaaattagttttttcattcgtgtccgaaaaccccttccgacatccggtcaaacattcgatgtgacatccaaaaatttccttttccccaactaaacacacccttagattcttaatttcaacagttttagttgcttgcaatttaaaaaaaaatgaacttaggactgaacggcattgcttcttgctcatcaagtcaccagccaaacataacaaaaacgtgggatggaaaaccaagcaaaatctcaattgcaccttggctccagttgtacaactccagtacatccctgatgaacacaatgtcgagggaaaataaaagatgacacttgcaggctctgctgccaaatgtttctgttctggcagtcggaagagacattggctgggctggaagaggagttttgcattgttcaaaaagaaaaaaaaaagcatcaattgatcaatacatggccaagcgcatttgcctggtttctaatccatccataattctcgatgtatagcatttcagtgtttcaccatttctccacatataagaatgtgtacaggaaagcagtataaacccatcagcgacaaggggtgtatagaagataaattctcggtcaaaactaatgtcaacggaaaataagacgaaataccagtttcatgctctaccaaaaaaatccatgtttcctttccattttactggcgtgtgactgaatttaggccttcctctgttgccatttgagaaaattccattttactggcttgtgactgaatttatgcctttgttgccatttgagcaatctaaccctaatgatgatccactggattttcgctactgcttggtgtagatgaggtacacaagagcgcccagatgctgtacttccaggcctgccttttcgcattcttcgaagaagagggactggtccttgccaattcttctacggcagctcatcagaaaaatgggaaacttaacaggcacttgagttcctgcaagtggagaaactcactaaaggtattcttatgtaggcaatatgtacaagttagaagaatgcattatgtaggcagtacctgatttgttcgtgatggctgtactggcacttgaaccagcattctgactgcagcccttgtattctttcaggagaaaggataatgttctggttaggtttggatattgtttgacatctaaaagcagaagtgtatatcatattagcatacagcaccaaagtaaggtatgatgactcgagatattaacaatgaacacttacacaataaaatgtcactggcgataacaatgtcccaatctggtatgagaactggaaactgatctccccatgtatctgagggtacaaaagaaacaataggaatcaatttttcccttttggttggtgcatcttccctgcacctaaaaggcataattacaagtctagaagtacttagttttcttacgccggatatgaggaaggacacccaaatcattagctttgcagttgtaagctatattctcctggatctccccatcatcgtaatcagtggttgtgatgtctacttgaaatgccttccgcaggaagatggccaaagctcccgtcccactgaacagttaaatttacaccatttatcatgttaataatctttgagaaacagcctagttattatcaagacaggtatactgaatctcataggcaatacaatcacaatcaaactaactgcttagttaacttgcatactccctccgttccaaaatataagggattttgaccggatgtgacacacccaaccaaaatcccttatattttgggacggaggaagtacatcacaccgctacatcttggcagcatgataacatagatgtttaaattattatagcaggaaaaaaaagagagaaccattttcagatatagattaaatatatgatatatttattcattggttttctggtgacaactaacagaagtctaataaatagcccttcagtaatcacctagatatagaaaccactagccaaatgcttatcaatcagtatgagcagaaaggaaacaacacattttcatacagcaaggcatagcctccataccttcccaattccaggatccgccgtccatgcagaatcgatttattctttaccagccaatcagcaaataagaacgtcccaggccatagcatgttagcattcagctgatgacttgagaattcccttattttcagttcctgcatgccatttccaaaaggtgaacaaagagattgatatcctgcctgcaagcagtatgaaacaataatctacaatgtatgaagtactacataaggcagggatatcctgcctgtcacttcatgtacccttaactgatattgtgtggtagcacatagaatcgcaacaactattaaactatacaatacaaacatgagctccattacatgcagacaaaggcttatcttgaagagagaaccaaattatcttgggaaaatttaaacggtagttactatgctcctatacctttacaaaaacaaatcagctcaatcccaacaaagtaatagaatggactgctttgaactattcagcccataaaaaatgtaaaaagtttgacaagctattcatctacataacagaaaggccttgagagtgatagtatttaggccctttctactagtgcatctataggatgctcatccacagatagaaatttgattcccacaggcaaacagagatagcttgcctgttactttgttagcatcgagacacattaggccagtactggaaacagagacataaattaactagaatgcagctctatttggggggctcaatgatccttcaactttcaagtatcacaaatgccaaacaaataaatttcctacttgttcaattcatgtactacctgaatttttagatgatgcacaacagattatgataactagtaactaccacatctaatcttctttctgagatgcactgaagagttgggaaacctacacgagatgaaggcattgttggttccagcacttttagtttttcctttcaaccatcttctttattgaatttgctacaggcatgactcatggggataaagcttagcaatcaattatcaaactaacaaaataccaaggccgaatccagacatgataagaacaagccagttcttcacccaaaccgatctaccctgtctttacaagattaaaccctaaataaaccccagaaattctccaacaagtcaaaacatgtcccgttcatcaaatctaaccaacacaaccgaatcgcaaaatcggagcccccaaccactacagaaacacccgaaactagatctcaagacggcaagaacccaaccccgtaacacaccaaacactttcttgattccataacagcaaagattaccacgagttgcaataccaaaccagaattcaagaatcgctaagctcttaccatgccggggaacttgtgggctctttcctcgtactgcaccgactgcacctgctcatcggcgtccacctgcatctcatcttcagacgcgtcgcagcaaagaaccaaacaaacaaaaaaaaaacaagaaccaaagcgaggcggcggtcaggtggaggaggagcacgggggaggacgcgaagaggagaggggagagtaccctggtcgtcgtcggcgtcgcggaagagggaggcggcggagaagagggcggtctccatgggcgtaggcgtgggcgtgggcttgtgcagctttgggtctcgctgctcgtcttggctttgcaatgccctcttcctcgcggtcgcggggctccacgacatctcggtctccgagggcaacatcgacatttcctatctggttaactagtatctttattattatcttccgctaaataggagattactactactatcaatgtgcgatggtttgatactcctagagttagttttcttcgtttatttcttggtggcctacttgttcagatgttgcttgggatgggagattttgattttgtaaagtggaggcagcttcactttcatgattttgttctctacaaaaaaagctagttgaaaagaagtatgaatgaaactatgaaagaagctatccacgttttccagagtaacctgtgttctcatatccacaatcgagcttaaatagattataaattatattattttgtgtgtataagcctgtaagtgagccaaattatactgctagacttaaaaagtacaaaagaaaatgtttacataaaaatattccccctgtttttaaataactgacaacgtgtgctattcacagtttctctttcttttcttttcaaaatatttaccagcactgacgtgttattaaagtgtattatgtcctaaatataagcatgaaattttattagctatggtctaactatttaaaaaagtaattggtggtcaaagtttaaacggaaaagacaaattcatcagttatttgtaaatggacggagtgtataaaaatactttaaatgctcagatgcatgtgataggttgagtgtgtgcacgtgtatatggatatgttttgaaaagaaaaatcttagttactttcagccccatctttttgctaatgattacacttatcagctaaaatttgaatttttaactttaaatttggagttgatttttggttttttcatcgaagtttatctttcagccttcacttttagatcactaaaaacacatatataaaaggtttttattcacaaattatttttcgtttgcaaactattaacttattaactaggttaaaccccgcgcattgctgcgtgaatttagtatgataacaataaaaaaaatagcatgtaagatagctagataaagattaagtaaattaatgtggtttatgataatttaaatttaaatagtatgtagaatggtgattcaaacataaaaagtaaaatggtatgactttatggaaaaagaaaagtagggagatagtttggactgtagattaatcatttaaaggctaaaaacaattgtgtgatatgacttaattagaggaaaaaaagagaaagataatttggaccatagattaatcatttaagcactaattaactaagtgagaattaactatataagtatatagaatatcataaaacacaataaagatatacattaaaacattatgtgaattatgttggatgataatttaatatgtttgtatttgaaaagctctggaattataaaaaactataatgatataacatgtttgcatgatatttaaatgtgatgattgttagtagatgatgatgtggtatcttgttaattagtagatgatgatgtgacatcttgttagtggatgatgatgtgacatctttgcatgttaagtttaaagagttagtcggagataactttatagtaagatagataagccaaatgacggggggcctttgcaaacagactgaagttatctccgtacacgtacgcgcaaggaagagactggtggacccaaaaggccctccgtgggagagataggcttaacgaggctcaaatacacctaattaggctcaattggacccatcctaaacgagccccctaattagtatccttagcgaatacatggctcccatgagttgaatggtgaaatttcaggcccaaatctgacaattgcctatagaaaggaagcgcacgtatgcgtcttgcagtatcagaaattcaagagaactttctcaaaaacaggaaattcaagacaaaccagcacgtgacaatggcccaagaaagatcctgcaatatgcaaataccattacatggtagcttcttttttacacgctgtcttaacagcttttgcatacataggacgacatagcggtatatgtacatatacggatgcacgtatgtacatacactgatgcaaaatgacccaaagaacgcaaatttaatttactagtaccatcatatctctctctagtcctactctgctgtagcgtggggtaattatcaaacgtaatacgtactatgaacacacaccaagccaagccccacgtcactcgcactggctgatcgattgatcaatactactactaatttatgctatatgcgatggtcgaggggttgtggcgttgttcatgcgttgccggtggcgatccgggcgacgtggaactgcggcgcgtagttctgcgccttgccggcgatctcctcctgcggcggctcgttcaggaacgcccagttgctcctcgtccacctatccatccatcacatcatcagttcatgaattctcataaaaaactcaaaatataagcatttctaatttaaatttagacaactgtgagtttaaatttatagaaaaaactattatattttaagagggaagtagtatatagatactactgttgtgcgtaccagtcgtggctcttgctggggctctcggcggcggcggcgtcgtcgtggggaaagaagccctccacgcgagtcgccgggtcgatacggccgccgcgaggcgacgaggcgtgcgccttcgagcggctcaccggggccgaccgcgccatgccgccggcggcgggggagccgagcggcgagcccgacatcatctcgccgccgtgctgcttccagaacgcctccacctcctccctcgtcagcgacttgttcctcctcgcaagaactacacatatatccaaaaatcaaagtcatgagcaaatcatgcatggattgacacacatctgcaggtacgtaaatgaaaactacgtacctctgttctcatcgccaagaacgggtgaatcccatccagccatcagagaccccatcttttaattcactactcagagataatttctctgaatttggatcgatcgacaaagttggtctgatttgttatccagaaagaactgaagatgaaatcaagctgaagctactagcttgtatgattagttatcaactttaatttgcagatgcaaattgtagcgaatggataaacaacggagagagcagtgcagtgaatgatggctaggcatcgatccgatccagtcgttttatatacgcaattgacgcttgactttggagcgattaaagcggcactagtgcaggggcaaagcacacaggttttataaatcagagtggtttcatctccaaaaccttggactactgaatatgtcgttgtctggttcttgcccaacttaatctcgtggccttctcccagccgtccgattgtggttagcctttgatcggacggtgcgtgaccgagttaggaagcttaatcggggacgaaacatgatcgagtagccagctaggcccgtccaattaggtggtgtgtaagcagcaaggagacatgctcgtactgactgatcaataaacaaagttgctgggcctatctctccacgaaatatctatcgaactatctagccttttctgagcgagaaaaaaaatatctagcatggccttaattaaattcacggggttttggtttgattaggatgtgacgacgtgtacagtagtgaagtccagtggacggatagacttgacagtccatcgtgtagcctataaccgattgcaagttgtaaaaaaaagttgtaacatttattaacgactaaggataaattatgagcaaaactataataataatatttaatactatttttgtttttaatataggacattgttgattttacatttatcttatttaaaaatatgtaattactattttttcctgtaagttatttataaaaaactctaaacatgatttatatcttatatatgcatttgcacaaaaataaaataataagaatggttagatgggtgaggcaaactaaaagtgttatctataaaaagggaaagagtatatgtgttattgacgactaattaagttcatgctacaaaataaataacgatatcaaaattaactttagaattaatatttagttttaaaattttgattgtgatcataatctgaaaatggaaaagatatactccctccgtttcaaaatgtttgacaccgttgactttatagtacgtgtttgaccatttatcttattcaaaaaatttaagtaattatttatttttttatatcatttgatttattgttaaatatacttcatgtacacatataattttacgtatttcataatttttttaataagacaaacggtcaaacatatgttaaaaagtcaacggtgtcaaacattttgaagcttaggagtacaaagtacagcgatggatggataggcgttatccgttgctgccgtgccggaggggcacacacgtcgctgcgtcagtggctacgcggcctcgtcatcctgtgctcgatcaataatctccagaagccgctggttaattacttaattagcagtgcgggttaaggtcgttcttatctgttagcttcccaggtgcatgcactagctgtctaccactgtagcacgtacgacaatgggttagtatatatgcggcacagctagctaagaatatgggcctttttgtttttactcggtgtaagatcgaattgatctgggttgtgcacggacactgttttatagcgtggcacgagtctatttgctggataatttgggactcacatctgtcacagaggcagtcaggcagtacgtacgtagtaggagagtataaattgggagtaccccatccttaaaaaaaaatttaatcgtaactataaacctggacacatgcgtgtctaaatttattgttaggattggctttttttagggagtagtacttgtggacaagactcggcaagtgattatatcgattgaaatttttcggttttctcaaattttaaagaatttggtcaaattatgttaaaatttaaaaaaatcagtaaaaaagtgttaaaaataccgaaattctggccattttggctctaccgaaatcaaaattgaaaaccctgatagagagtattgaaatgtaagcccctaggccatggctagggaataattaacctcttatataatactagcctcaatatctcgtgctaaaagaaaatatttaccatatggccaaatagcgtatgcctatatatactactagtactcatttagaattttattctaatttttcacctggtccccactgaaactctcctttgggatactatttttatcttttcatccatgttacgcccgtcttatatatatatcagatgagatgaaaagacacaaattaccataaggacccacatgtcaactccctgcacactcttcttccttccccattctccttcttcactcatatgtacagcatctcttaaaactagcttaagattaaattcttaataatatataatatcacattaattcgagctacacatggagagaaaaggactacgtaataatgaatccaattgtgaaatcaagccaacgttgtatatactttttctccttatgcgtacgttcattgaatttttgacattatattgcacgtttacgaagagatttatatctattatatactaaaaattcattaaacttcttacaaacgcttctaagccgccacgtggtatcctataaacgctactaagtcgtcacgtagcactataatttagaaaaatttataaaaattctctagccattgattttcattaaattaggtggacccattatttaccaccattagatttatcttttaaaaaattgcctaacccccaaaccgagtccaccatgggccgtacgtattactatatgtatacatacgtatttttaaggatagtacgtacgtacgtacttccatcccttccctcaatttcttcatatttttgcacacatttattctcctattatcatactttattagttagaaaaaaaactcttgtgctgaacaattccacaactataacatctaaaaatcataccacaaatttttaatccgccattgacaatatagtttaactggcttacttattgataaaattatggttcacgttcaccttgaagagcacgactatatcatgggacacatgaataaggcattagagaaaactccttagcggctatagtcggcttcacccgattgtcagaggagcattcatatacaagtttaattgttttatcctattaattggtagaagcggtatttttaaatatttatatataaatttggacatctgtgagacatgggcacttgggtatgatgtggagattaactttttatggtattaatgatgtatttggtttatttttttgatacaactgcaattctatctattaaaacgatactcatgtttcaagacaataaaaataagttgtggtgaatgccgaatttatatataatcgggataaagtgatttttggttggatatgataaccattctgatcatttagtacatatcaaaatctatggtctatttattatagtgaatatggtgagatattgcttcttttagtattgtttttatagataaaaaataaattgcccgcgcatctgcgcgggcatccgtcctagttgtataaatttaatttcgacacttttagtaaatatttagacggcatatacacatgaaataaatacaattgccatttgagatataatccaaaatagtttctggacctacagtacgtgttccctcgctcatattattgctgggagtaggggtgaaaacggtatgaaaatttccgagattttcggttgccgtttccagtttacactgaccgtttcagtaaccgacagtggtggaaatggaaacggtaatatcttctggaaatggtagcgggaatgggatggaggtttttccgaccgtttttgtcggtaaccgtatttgtatggtaatttccatcaaaattccggaaaaaatccgaaagttctccagcgactcagcctggccaacccatcgaaagcccatgaatgaagtctggtaggcttgcaatccataaaaaaaggagaagtgaccaggaaaaatgttgttaaccctatgacatggcatgtggattttgctgaactttggtctcctcgagttatcgatgttgaagtattgtagaactttgtttatattgttcgtcaagcttattatcctatcattaaccatcatataataatgttatgtggagtgtgatgatgcaagaataatattaaagacatttacgtgcatagttaaatgtgtgctatgccacactccgctgattccgacatgaatttcgactttccgatataccgatattactgatcgttaccgttttcgagtctaccgttccgatttcgttttcaagaaaaatatctgaaaatgaaaatggtatatggtttttccgaccgttttcatccctagttgggagaagaggaaaaaaaaagaatgaacagtgtaacacagttgaaacagtgcaaatgatttttagttttttacatatatatatatatatatcatacattaagaagtcacagaactactcacacacacacacacaaagtacagtcttaacacaattaactatctatataggagagactagagagagtatatacatgagcagtatctgtatttacacggagagctgaaggattaaaagctctcgaacgccggcccgatcctatacacttctctactgctctttgtatagtaatattctacacatacaaattgcatgcgtacttaaccactactacagaacacactactctcttagaggatcaggacgatgcagagctgcaaagctaagctagctagctaaccagcctaagtactaacgtatatacgtacgtacatacgtacatgcatatgcattccctgacatgtggctagctataactagctgaggcctaggcgttgccggtgacgacccgggagacgtggaactgaacgcaggcgtacgtctgcgacttgccgaacatctgctgctccggcgacggcgtctcgttcaggaatgcccagctgctccgtgtccacctataccaaattaacatcgtataatcaattaattattggccggtgaaacatcagctgttaattaaataaatttaagtatacgtaccagcactcgctgctggtgctggcgacgtcgtcgtcgtcgtcgtcatgatcggcagcgaacgacgaccgctgatgacgatggtcgccggcgtgaggagccgccggcgacggcggctcgctgtgggagtacgactggtacgggtgatcgtcggccctcgtcatgacggtgcgcgccagcggtgacggcatggagttcatcctctccagcctcctcaacgccaacgtgcaacgactactactcatctcctgctgctgcatgagagaattaattatattaattgattaattcagtccaagaatatatcgatgcatgtttaattagtttaattacataccgcgcggccgggagaggcggcgagcggcgagatgtcgccggcggcgcggggtgatgcgagcggcgagacgacgttggcggcggcgcggggagaggcgagcggcgaggtggtggcgttgggctccgacgacgtcgacgacgacggtggctgcttccgttgctggcgcctccagaacgcgtccacctcctccctggtcagcgagcggttcctcatcagccgaactatactcaacaaaaacagatcaaattaattaattacagatcgattgaccgatcaatacatattgaattatttgtgtgggtatatataactaaggaaataatcttcccattcagttcgttatcgtcgatcgatcatattgttaatttgttgcatgtacctttcttctcatcaccaagaactggtgagttccagccagccatcagagaacccatctctgataggagtattcaattctcaggtcgagatggacaaagaaagtgatggatgagaaatgatgatagagatgatgatcagccccagtggatctgtaccgttttataggcgctcgcgcatacacatccagtgttggggctcgctccactaggagctgatggagcaacaagtgagctgtagcacacaggttgaactgaaaacctgcggcgtacgtgcagctagctatactcgtagcactgatcgcctaatttggcaatcgtatcgatcgcaacgacgatatatacgtgcaggtgcgcataggtacgtgcactgagcaaatccatatcacttactcgatccgttctaaaatatatgaaacacatggtagtactgtccaaattcatagtaataataatatgatgtgatgtctatctatatctgttaattattatatatgactgctgttacgtttttttttataacgaaccgctgttagacagtgcacgtagatatgaattgtacagtaactaagccagatatagataacacggtgacgaagttgtaacaaaaaaagagcgatacgtgcattgcatgcaacgacgcaagctggagggggccaaatgaatgcatgcatgtatgtttgtgcagagaggttggttgtgacgatatgggatcgcgcgcgcgcgccgagtagagtggagtggataggcttgagctggattagcttagcgcgcggccggtcgcgcgcagcgatcgatcgatcgtcgttatcccgaggtggcagcggcagctagctagtgcgcgtgagcgtgcgcgcgcgtggcgtaagaccctgcagattacgacgagacgagacgacgtctctgtgcacctggagagccccatgccggccggtgccccggcacatggcggcgcgccactggttgggttagcgtcacgcgtcacgtcacccgttggcgccgttcttatcgatcagctaggagcccgtaccataccgggccgggccggacaggacggcccgcgcgcgcgcctatcgtatactagttgtgttgtgtagtacgtacgtgttcagtgcaacggtgcaagacgccaactaagggcgaaaacgctaatccgccaccagtcgcgcgactggacacgtgttgcgcgtggagagaaacggcggacggcgcgtgtacggtattctttttttttgtttttttcttcctgcgcgtgtacggtttcttttttttttccgttttttctgttttcttccgtatttttggtttctttttcctttgttttcgtttttttgttttctcccgtatttttggtttctttttctttttttcttttttatcgttttcagtttttttcggtttttataaagtttgtatacgtgtatataaagtttgtatatgtgtacataaagtttgtatacatgtatataaactttatatacgtttatttttttgatttttatatgtatgtgtacaaagtttgtatacacatatataaagtttatatacaggtatacaaagtttatatacacgtatacaaagtttgtatacgtgtacataaagtttgtatacgtgtatacgaatatacgtgatgttttttttatattttttaatatgtacgtatataaagtttgtacacattgtatataaagtctgtatacatcatatataaagtttatacacgttgtatacaaagagtttgtatgtgtgtatttttttatacataaaaaatatacatataaatatataaataaataaataaataaataaataaataaatatataaatatatatatatatatatatatatatatatatataatactagtagtagtatagaagtagtagtactagtaatagtagtatagtagtagttatagtagtagactactagtagtactaagagagtagtactgtagtaccagtgggggctggtcatgcgcctgggggccgcgcgactagtcacggattagcccccccccccgggggcccctttgaatcgcagggttgaaaaatagaggaataggaaaaacacatgattctgatagaaattgaagtgtaaaacagaagattgcaaaatacagaaaaaacatgaatgatcgtttgattggaacgcaggaaaaacacaggaatcggatgagagagatagactcaaaggaaattttccaagaggttggagctcttgttatatttcctccaaaatccacatgcaatgtgccattccataggaatttcatgggatttgaaaatcgtcaatcctttgaatcaaatggccaaataggaaaatttcgtataggatttgaatcctatgaaaatcctatataaatcctttgattcaaagggccctaagtttcgtacgtgtgcaactgtgcatccagcacgtactactacgtactcctatgtacttgtagtggtgtagcctatacatatgcatgaagcgttccaggaaaaataggagtctcagtaatttgtgcaggcatgcggcccatggagtaatagaccatgctgaataatttcagttcaaatttcatactccaactgtaataccatacgcaaaccatcaacttacaatactgatatacttgacatttcaaaataacatagcctttggttttagctgacgtagcgactgagtaagctagcacgaggctcatatgggtcccacatgtcagcggcccaatcttcttccacatctctcctctcttcccaatcctaatctctctccatgcctctagggtggtgggggtgggaagaagctcgacagcggtggccaacacatacgcaaggagaagctcgaggactgcaagacgactttcttttcgcctaccactggaaggcaacaccttgtttccctgccttctagttgagcgaggacactgaatgcatggaggtgttgtgacccaaatctacggcagaatccctcgccggaagttcgccggagatctagcagagaagaggcgagaagaacagggtagaaaggggaaacacgaggaagcagctggggaggaggatatttttcatttctttcatgaattgttttctcaatacagctggagtatatatactcacgcactccacccctcttgcccttagggcccaccttgtcatagacacttctatctataaagagtagaagatgtattcacttctgaaaagcgtcaatgtagaatacgccttcaccctgttgctcgccattgccgacacgctgatcgcttcacacatcagtcgtgacattcgcccctccttgagtcggagcttggccccaagcgacggcagatggaaacctggtgtgcaccacatcgaagtcctcccaggtcgccaaagcagcaggcaaagtaccccactgaaccaaaacttgaaaaacggcagcattgccctttttcaccatgtggcgatccaaaattgccgtaggcaccaactctgcaatgtccaactgagcagcagacgacaattgagaaaacactggagaatacttgggaacatacttcttcaactgagagacatggaaaaccggatgaattaaactaccagccggcaacttcaaacgataagtcatcgagccaacagatgcttcaatctcaaaaggaccaaagtacttaaacgccagtttaggaaatggtctggacacaacagacttatatgcatacggttgtaacttaagaagtactgacttcccaacttgaaaagcacgatctgagcatttgacatcagccatttgcttcattctattttgagcacgagccaaatgatgtttaagcaaagcagaaaacatatctctttcctttaggactgcatcagcttcagatgagtcagaaacatcatcctcagattcagtcacgggaacagccggcaatatcccataagttggctcactcccatataaagttcgatgaggagaacactgcaaagaagagtgatagctagtattgtaccaatactgagcaagagacagccatgcacaccacttagttggaactgcagcaactgcacagcgtaaatacatctccaaacattgattcacacgctccgtctggccatcggattgtggatgataagcagtggtcaaattcaaaggaatctcaaaccttttaaacagagtttgccaaaacttgctagtaaaaatcttgtctctatcggacacaatagacttaggcatgccatataatgccgcaacatgagtcaaataagcttcagccacttgtaatgcagtgaaagtgtcaattaggcctaaaggggggggggttgaataagctaattcaaaaattcaattaaaagcggaagcagtaattttcggatatttccgaaattttcgaatatatccaaaaattttcggagtcagcactgaaagtgcatctaggcccctaatgattttggtgattaattacaatgcgattagagaggactaacatttttatttaagcaaatgtgaagtttgttatgttctcaatgagttaccgtaatgcatatcccgccaaatacgttgatgtgatgtgatgcggcaaaggagcaaatggtatattgtaacttttcttttcatttgagtcaataggaatgccgcactattaagagggatgatgcattgacatatgaggagtgatcaaagtgctcaaaatctttttttaaaagtgtttcccctcagtttgatatgttctggaaatttttggagttttccgaaagtcattttcggactttccgaaaatgcacagaaccaattttcgcttctggaaattttcggatatgtccgaaagacattttcggacttcccgaaaatgactgtgaaggcaaatgtggttctgtttagtttcgtacttttccgaaattgattttcggagtttccgaaaacttcagcaaaggcaaaaatcgcttctgtgtattttcggacttgtccgaaagtgattttcggacttttccgaaaacatccagaaccatgttttggtggtggaaatttttggacttatccaaaaaattttcggaatgtctgaaaaatctttcgttgactttgctgtggtgctgagctggaaatttcgacaagtccgaaaattttcggaatatccgaaaaatctcattattgtgcataacggcagaatttggctgtggcaaaaatagccccctcccc

SEQ ID NO: 76205 - DNA, 684 bp, Oryza sativa
caatttgtggaaataattttattttggttgagggaagatcgagtaatcaacgttggaacaggacacatatagatccttccattcttctcttccaataaattgggattgctccgctgctgtctgggcaggaatgcagctcgacattgttgccttcctgtgcagggtgaagcaacaggtcctcatggaccgtgtacttccatctgtggcatcggcatgtgcccagccgaaccaactgcagtaccaccattcattcgagcttgagaatgtgcagacgtgcagatggtcgagctcgtcagcgtgctgacagccacaagctcgagcctcgaggatggcatccggttggcgttcattggaggaggaagaagagaaaggagaggggggctggaggtggaagaaggagagggcacggctggtatttcacatgtttttttttaaaaaaaaaggaaaccgatgagattctaacagagttgttgacggaatgctaaatatgagaaacagagctaactttcgatgctattctagtaagctgtgaactttcgatgctataaaagtaaaaatgggaactttcgatgctacagaaccaattttgcctataaatatacccccgtagtattagttttcagaagaaggaaacagaaagaagatacaagaaagccatcaataaattgtaaattcttaaagaaa

SEQ ID NO: 76206 - DNA, 23174 bp, Oryza sativa
tttaatccgaatagttgaaaatgataacaatatttgatcacgttgtaaagttatacataaggacttaccttgtttatccaaaagcttaaactgacgaggaaaaatgcaattgtgattgtaatcatggaatgtgtggatgacatggcatggcaggtttcttgacaaggcggccgtagtggagcacgacggcggcgaggagcggcgcggggcgtggcggttggcgacggtgacgcaggtggaggagacgaagctggtgctggcgatggtgcccatctgggtggcgacgctgccgttcggcatcacggcggcgcaggtgtccaccttcttcatcaagcagggcagcgtgatggaccgccgcatgggcccgcacttcacgctgccgccggcgtccaccttcgccatggccgccatcggcatgatcgtcgccgtggccgtgtacgacaaggtcctggagccgtacctgcgccgcctgaccggcggcgagcgcgggctcagcatcctgaagcgcatcggcgtcggcatcgcgttcaccatcgtggccatggcggtggcggcgacagtggagaggcagcgcctccgcagcgcctcgccggcgtccatgtcggtgttctggctggtgccgcagttcttgctgatgggcatcggcgacgggttcgcgctggtcggtctccaagaatacttctacgaccaggtgccggacagcatgcgcagcctcggcatcggcctctacctcagcgtcatcggcgccggcagcttcctgagcagccagctgatcacggcggtggaccgcgtcacctcgcacggcggcgccgccgccggctggttcggcaaggacctgaacagcagcaggctggacctcttctactggcttctcgcctgcatcggcgtcgccaacctcgtcttctacgtggtcatcgccaccaggtactcgtacaagaccgtcatggccggcggcaaggtcgtcgacgacaaggccggcgacatcgagtgcgccgccgccgcagctgctgctgcctactgatcaatatcaagcagtagctgatcgattagctagctagctagaaaatcatggtaagaaagaaaatggcatcatcatgtattatgatctgctttcgtggtacgtgacaacaacaaaaaaattgtaaggattatgtcgttcgtccatgtatatgcttaatctgcttgtgattgccatctgatcgtgtgatctactgctactgctgatgttgccaagtcctgaactgattcagtgtagcagtgattagtaagttacgcgtgtgcttagtgcaagaggcgaagtgctgagtagatggattacgtgcacttggagttaagagtgcgagattgagatggcccgaaagcctgcttaattcggacccatgggcggagccactacgattcctgcgtattccgaggaatatacttcagtatacgcacatgtacacatattagttagccaagtactcttcctaactgagatgcgtatagatgaaaggtttagaaaagtgaaaaatcttcttaatctttccattatgattgttgaaacaaagttgcacaatagacatgagattgtttacaagcttctcaaattggttatagtactttcagtagtaacagctagtgttcaaataatcttttatgccatgaataatgtgaagaataaattgataaacaggctgggggatcaatacttaaatcattgcttggtcacatttattgagtgtgagatgtttttgaaagtcaaggactgtgatattataaaccgctttcaagctatgaaggaaccaaaatagaaaattagaggtaccatgtaatatttgtagttttatttcttcgattatcggtattgacatactgtgaaccattgatttttttttactatgaactttttttttgttaaacgggaatacccaacttcgaaatcctggctccgccacttcggaccgagtttgcagccttgcgctgtgaggaaaaagtccaatgtatgtccctctaatgattgagtttcgatcacgtccctcaatcacagaaacaggtacaacgcattcctagtcttccaaaagccagtgcaaatatagtccaaaggcagcactgaggtcgtttttagctgacgtggtgcagtggtgcttatgtagcgtattgactaggttttcgtcttacaagacatctacgtaacacttacattcaagaacaaaaaaattttaggacctatgtggggccaacatgttaggggttcttcttcctccaaaacctcccttctttcctctcttccccatctctctccacctctatcctctcttcctaccttgtcggtagggtggtggcaagtagaggccgagatgatggcccaacacaggtagacaagatggtcacatacaatgagatggctaccatcactatcgagtgtcgcctgccttagttattatgacgtaccactttcattcatttcagcgagtcgcgtgtattagatcgattcaatcggtttctagtgcatatcgagatgacatggcatccatggagatggatattacaatgatacgacaagaagagcaagtcacaccgccctggtgtgatactgtggctttatggatgactacgagcaaatggaggacgatgaaccaccctcaccgtgagtcaacaagcccgggtttttttttccttatgccactgccggagcagaaggtgtccgtagcatatcatgcgtagctttggcgtacgaatgcccgaataaacaacaagtatgggtctcgtcggcccaatgaaaagaggaggaagaagaagaagtccaagcattatgtgtcgccgttgtcgtcttcaccatagtcgaggtcgccttcgccagcctacgagatactccctccgtactcgtaaaggaagtcgtttaggataatgtttaagtcaaaccttaggaatataaatcatgaataactctcaggttgttgagtttgaaaatataaaaattatataaatagatttgtcttgaaaaatactttcataaaagtatacatatatcacttttcaataaatatttttatagaaacaagaagtcaaagttttgtttttagagaccgtgtcgctatccaaaacgacttcctttatgagtatggagggagtatctccaaccctcgaacccaacgacccatactagataccaagaagaggggggagaggtagagatagatggggaagagaggagacagggtgaggttggaggaagaagaaccgctgacatgtcggctctacatgagccccatcgggtttttttattaatgtaagtgtcttgtgggatgaagacctaatcactacacaacgtgagagccacattacctagtccctacacaacgtcagtaaaaaccggcttcagtactatctcaggattacattttcactgattttagaagatacagatgtgttgtagccaattttatggttgagcgacaggataaaatggccgttaattagatagagacgtaaaagtagacttttcctgcgcatcaacggctgaaacagcccaaagagtagttacggtgctttggttgggttggactcgctgagtcctggtattgggccatcaagtcgcaatggggaataagttcagtttagacccctcactgttgtccagtctaaaattgataccgaaatggatacaacgtgtccatcaactcccaaaaccaccccaaataagatcacaagatggtttggatgacgatttcaactgatgtggcacctacatgaatggtttgattatcgccatgtcacgccacgccaagtgcagtgcgggtaatagttaagggagtcgaaagcccaataaaaagttggattttggcccaatagtaacaacaggttggatttaggcccattgtgtatgtaagctacagtaataagtactccctcaccaaactgcgtgacgtgttcaagatacagtctctcagttgacccgtgaccgtatgctcaccaaacttttttcttaaaaaaatcgccctgttctgtaagactgtaacggcgagttctgtttttttaaataaagaaaaaactgccgaccagcttggctaggctcgttactagaatcaaaatattgcattataatactcgtattctgaatctgagaatacacagccgtgctacacgtttgtcttaaggacgtgtcattaaaattctgattcgattcctcgtgtgtttggtttggataggtcatatgttaagaaaaaagaaaggctttattaccatgtgggacacatgtcgcagttgttttaaaacggttgggagttttggcttcggactggctttcacacggccgtgaatggacaccaccaaccaaacgatgccgcggaatattccttgcaacgattttcatcagggtcaagtcaattaaatttgtttatcatctgggaaaagtaagctaaagcgaagcaagagcaaaggagattactgctaatttttctgctctcttcatccaaatatatactccaacagtctagaacatatttagtagagctctgacttctaaatttgactccaagagttatgagtagagttgtagagccgccgaaaaccgtcgaaactaagctctatctctttagttcattagagtgttccactcagtttcacttctattttagatggaactaaaactctgtttgactaaagctgtagatgtgccaaacagacccttaaaataagattagatccatttaagaactacgaatataaaaataggatttgaaattagcctatttccatattcatagttctaagctagtccaatcaactactttctctgttttataatataaaatttttattaacgtctatataaatgtatgtgagtacgaagagcgtatattgctatatattgagaacgaaaggagcattacaaattgcactatttttgtagaaaagaaataaactaatctccgcaccaagacaaaagggagggagcaaccagcctcgctggaacggtagcgtccttatcctcctcctgctattgattattttgcgttcccccgtcgccgcggtcccattccgacctgttatcgcgtacggataccggccaccactcgcggatcttctatggcatcttcacttcaagagtatcatgtgcaatctttttcgattaaacagaagaggcacaaccgcacacatcaaatgcacatccacaagtatgacctcaacatgataagatcaaatataaacaaagaccaatagtatatatccttaatcccactaaatttctattaaaaacacatttaatgtgtaatattcgtgagtatagatttaaaatctagcgagtgagagttatgcacccaccattgcaccagtgcaccaccgatgtttcctcaatattatgtacatattggtgaagtgaagaaagtggcggacctaacaaccaagaccttacttttgtgttatactcatgatagtaattcttttaactaaccataacacttttacgatatagacaaatgcaaagcatgattaacgaagggtcgataataatggtgaaactgcattacatctggtagccttatgctcatgatagtattttttaagccaaccatagtgctctagcatctatagagtagtagagtccaatgtaattcgttgctatattgcttagacaatagaggtaacaccatgtacgaacaagattactatatcctgacactagcatatcacaattctttagatccaccactcccgataccggtaaatcataatttctgggatccacgactagttggtattaccttcatcctaaaataaaagagattttggttggatgtgatacctctagtactcgtgatactaggatgtgtcctgtacatccaaatttttttatatttaggatagaagaagtaagcagcgttaatagtaccaactacattagtaatatcacataaagtttcagtcatatggtgggttagtgatactattatccattgatttttataatagataagtatattataaactgtaagtagtagcacggtatataaatagatggtactggtacgagattaggtgctactaataagagtgtgttcttcgcagagcacagcacgggtggttttgtggtgtactatggccggcacagagaatcccagatggcattgcaggctggaacacctccgagtgggagtggcccatgaaaggtagtgcttcgtcgatcttatctccggtgactcatttccgcatgtgaagtggcgcgacgctccagcttatcaattgtatttcggatgtgttttttcacataacccctcctgttattcagtttctgctctgcacttccctaatatagaaattgaaaattaaggcccaagtttgcttcaagtttgtatcgtagacacacttccaactttccaagacattttacacaagagaattagagatgatattgatctaagcttgcaagaacatttactagtttgatttggaatatgtcggcatctttcatttaccaaaacaaggttgtgttcgccagtgtgagttcctaactccacattcttcattttctgtgtgcacgtttttcaaattgctaaatgatatactttttttaaaaaaaactatacgaaaattactttaaaaatcatattaatctatttttttaaaaaaaataatactaaattaatcatgcgctaataagtcgtttcgttttgtacgcaaggaattagagcatgtttaatagtatatcgaacgactaacttcaaatcatctatagtcaatttagtagccaatttatacaatagatacctataaacatatacaacactagtaatatctggtcctacctgtcaaacacacattatattttataatctaggtacaaatttatagcccgctgctcttctctcttcttatttatctactcgatatgtgttaatagttggcttatagtatgctgttgtactggctcttaggtcccatctgaagctactgaacacaacctaagtgtgatctaagcttgcataaacatttaccagtttgctttggaatatgttagcacctttcatttaccaacacaactaagtgtaatcggggtcatcgttttcttctaggatattgggttgtacataactttgtatttcaatgtacgtaagagagaaaaaatccattaagtagttttatgtgctatgcatatctttgtattttcctctggataactaagggctcaaattatgaacatgaattatttgtgtcctattttcggaaacttcatgtagctaatttttttcttaaaaaaatatagttttaaaatctagtaaactaggagttggttcagattctcatcagaaatttttagaatcaagctcatggagccttcatactccacaattttggggaaatgtagtggtcacacaaaaaaaaagagaaatatggcgataagaatctcctaattctatcacaatataagggcccctttagaagttgtacacttatcatcacaccacacacccctatctatcgtcaacttggtggtttctcagtgggcaggggagcagaggggcacacagtttagattttgtccctataagagcagacttctattagccgcgtacagatagatagacacaacagcaacaacaacaagcgaattcttcttgcagatagggaaaaaaaaacgaaagcgagagatgaggagcagctcggctctgttcttggcctttgttcttctcgccgtcttcctcgcggcgctccccttcgccgaatccagcggcaggcaccaccaccaccaccactcccatctccatggcagaggtacgagcaaaagcagaggaatcgaaagatatttgctttcttggagcgacttcttgcttgggtcaggagctaaattgaaggagaaatatttgggcttcttttcaggggaaggcgagagaggaggagaagcacggtcgctggcggcgaagggggcggcggcggcgtggccgtgctgcgacaactgcggcgggtgcaccaagtcgatcccgccgcagtgccagtgcatggacgcgaggccggcggggtgccacccggcgtgcaagagctgcgtcaagtccagcctcagcgtctccccgccggtctaccagtgcatggaccgcatccccaacctctgccagcgccgctgcaccgccgccgcccgctgacctcccccgccgcccatctgacccgacccaccggccaccgccaccgaccggccttacttaattaagagtggtttttgtttgtccctttttttttttggaaaagctgaagaagtgaagaagcagtagtacctactgtactggaggtgattggagggagcagctggtttcaggtttatgtgctggaatcagcctccagttttcatctcctcgctctgctaactacggagtaattgtgtagagattactcgccgagctatatgtacaaacggcctgtgtgatgagacgaaattgtaatggtaaattttttttcaccttcatatgttggatatgagtgaaattgttgctagcgaaatgatgatggatgcgtgcttggttcatattttccgttgctgtttgtctggctctgatgctttctctcctcttctgtattaatctcaattggattacaaggatgcctgtaaaagcttatgacatgctgttggttgattttgtctacttatgtcgataagggttaggagaggacgccaaaccctaaatctaattgcccgatcaagtgcgcactgtaaggagtacgtgaggttctctgctgtttcttttcatcaacaggaaatcagaacgagaaaagcaaatgaacaaaagacaaaactagaagaatcattgatggcttcaaacataggtcggtagattgattttataattaggagaggtgattgtttataggctaaagcttaagatcttgtaatctagaactctaacatgatgagggtaatacagcatgaacctggacgcgatccggcatgctgttccggggtgtatgaacctggacacgattggggacgaacggtcggtgaaatttgggaactgcacatcagaaggcttgtgttgctgtcaaccgaattaatcaggacgattgccatgaacaacatccacgatagtgagcttgcactttgcttagtggaggacggtctgggcctctggggattcgcatttccacaaggatatgcgttgccatgattttcactaggccgcttgtttaggcacgaaaggatgggaaagtgaggaatatgctcggcaagaagccaagaaccaatctccaatagtgcaaatttggggtgactttacatgtttgaattcaacattgcagtcgcgcaagtttgcaataccactatctgaatccgtggtccaaatctgaagagacctgcagtctgcacggtctctagagcaacattgccagtactaaagaagaaagagttccactaaattgctcatgtggtgatgttttggacttagctaaaaatatgtcgacaattttttgggctgatctcagtcggcttctctgtgcgtccgattgctctgcacgagttttcggttgtgcttgccggaccgttcgatttcttctcaaaatcatctcctataaagtaaggactgcatatgcttttgctttttaacttttccaatgtaagatttaaatttacatctcacttacacaccacttacatatgtaattactatgtaattttaagacttacatatgtaattttaaaatttacattgtaaatccattaaatttacatatctaatttagtaacttacaatgtaaatacatgctgactattttttgataaaaaatatggcgctataaatatagctactcccgatgttttttattgattcatcatgtggtggtgtcgtggtgatgttgaacagttgaaggaacagagggagaagaatctgagacaaaggacggcaagagagagacacacgtgctgaaaagaacaggaaaaagagttgtccaggcccaagtgtgcttctctcgtactagagtgaggcccaggaagtagcttacccgtcgcagcctatcaatgtgggcctcttttgtctccaaaccagtagactacggcccatgcaggcccatcttgccgcctaccgaaaagaattttttttatttataattttttttattaaaagttttacaaaaataattttccattttgaaaattgacggaagtagttgcctaccgctctctgggagggcgatttttaagggcggcgaaaatgacgtggcagccggccgttcgctctcgggcgacggccgtcaacgaaatttgcaggcggcccccttgccgccctccgctagggcgattttatactgtgcggggggccgcctgcaaatgggcggcgaggggggcatggaattttgcaggcggcccccttgccgccctccgctagggcgattttgtactgtgcggggggccgcctacaaatgggcggcgagggggcatggaattttgcaggcggcccccttgccgccctgggggagggcgattttttgcctccccctataaagcccagtccctcctctgttaaatttcattatattcactaaaaatccaaaaaaaacgaaagagagagaggggagggcagcagaaggggagcggcgaagccctgctggttcgctcacttcatcacaggtatgctcccatacatcttttgcatttgtactaatatgttatgtttgagtatatatgttgcgttttagttttagttccatatattttagcacatctgtagcacagagcacatatgtgtagatccagagcatagaatataatagtatgaattgagacatagacagtagtgttaattgtaagatgtagttagtttgatctggagaatgtaacgtaattttagaaatttagagaacaatattgtagagaatgtaacttagggcgtagtacagaaatgcaaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgatgcttggagacggtatgtggaaatggcttttgaacggtcatggcccctcgttatatttgtgttggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggactttactttttattactactgttaaatacttgtacgaaactgatggtccttgtccagcaggattcgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttaagattatgtagaacattcttcactacaattttacattttggcagcaaaccaaatatgatcaaatgcaattttaccttaccaaatatttggtagtgccaaaacttgcttatattttggcacaaacaaaatatttgtacggtaacaatccaaatatgccctaaaaataataaaattgtattttaccagtcttggagattttaatcttgtataattttcaatataaaaagatttgataactattgatatttattaaaaaatatagagcacactataaaatcgccctcccccagggcggcaagggggccgcctgcaaaattccatgccccctcgccgcccatttgcaggcggccccctgcacagtacaaaatcgccctagcggagggcggcaagggggccgcctgcaaaattccatgccccccctcgccgctcatttgcaggcggccccccgcacagtataaaatcgccctagcggagggcggcaagggggccgcctgcaaatttcgttgacggccgtcgcccgagagcgaacggccggctgccacgtcattttcgcctcgccctcccagagggcggtaggcgactactcccgtcaattttcaaaatggaaaattatttttgtaaaacttttaataaaaaaaattataaataaaaaaaattcctaccgaaaacgggtggaagcgtcggggattagtaccacctcgcggagtcgaggaggtgcgggtgggagagatggctataagtagagagccccgtgcactattgctccatacttacctggacggggtcaacgggcgatcaagaaggctcgtggcctaggccaatggcccacattgcacttggtgggcgcgttagcttaccatctccccaagtgggagagtggacgtcataatttgtggtagagggggtacgcgtccgcgcggcccctgccaactctcttagattaaatttcggtccttgctattgttggttaagtttaagttctttattgcattcgtatgctttcgcgcggcctctaccaattctcttaaattaaattttggttcttgctactgttggttttggttcttgattgcataggctccttgtatcctgaattttcggttttggtccgttgggtttacgagccatgtcaatctcttaaattaaaattttggatttgggtttgcgctggtaagttttgcatctatcattaaacattgttatttttcgaagagaaggtccaaatcaagcagagttcattacaggaaacaaaacaaaacgaacacagcaaccacttcaggaaaactggggaataccagctaaactaggacagcactagaacacacacaaaaaccaacttctcaaacaaccacttaaactacttctggggataccagctaactaggacagcactagaataccaggcaccagctaacgagggcggaaatactcttcatcctttggagaacgtgattggccaggcttcagttaaaggcttggtggtgtttaccttagctgaagcactgctccccgtccgacaaaccagcgataatcataaagggaagacaattggcatgaaaggaaggctgaaggaacaaggtgctcctgggaacttgaatcatcagcgtcgttgctcaatgtcgttggagctttcaacccagaaactggtagaggagcaatcggactcgtggttagaaattcagatggacaagttctcctgtcatcttggaaattcctaaggcgttgtgtagaggcagaagaagcagagctcctggcttgcacggacaaatcatctacttcctccatttcatattataaaactttctagcattgtccacatttatatagatgttaatgaatttagacatatatgtgtaagatgatgccctctaaaagatggcaaacgagaattcaagtacgatgctgccctgatgtttcattgacaaaagaataggatactagtgtctactcctttctgaatcacgacacagcgagtcatgaatttaatacatcagatacccgtaaattttcatggaaaatgctatgcataacaatcaagtttagcctgcatatgttttcttggaaatatatgccagatatagttatctgaagaaaataaaaagtaacaaataaatggcttctctaatgtaagcccaacacaatcaaacccgagaccattaccggtccaacccaacagattacacctgtctaggattgcaacggcctgtaatacaaggtccattacaaaccgccttattttggcagcccaagctagcacaaaacctctcagaagtcagaacacgagatggaaaccgaaaagaactctgcgttgctccacattagtaccacctcgaaagtttgcgtcgattgcctggtgctctttcggtataagtacagaaccccgagatccgttgctccatacttacctggacggggtcaacgggcgatcaggaaggctcgtggcctaggccaatggcccacattgcacttggtgggcgcgttggcttaccatctccccaagtgggagagtggacgtcataatttgtggtggagggggtacgcgttcgcgcggcccttgccaattttcaaaattaaattttggtcctttgctagcgtttgcttgcaattggaaaactaaacagtccctgctttcgttttttgtcgcttcttgaactcactagaagtaataaatttatgaaaaatttgctcaatttttagaaaaattgtggtgtttagattaagttttctaaaaatatgtggtggtttttgtaatgtggatatgaatagattatgaacgattaaagtaattgttttatttctcgcgcgagcacgaggtgaggctcgattcactttcactataatcgcggccatggcggcgaaggttgggttgttcccctcgtcgtcactcaccaccagcccccacgccatcgcggctgcgccgaccaacgctccccgcccacgcggggctcgtggattggcgtctccaggtcgatccgcggcggcgatggacgccttccacgtgtcgtcgcaggccgccgagccgctcctccgcaccaccggcgccgccgccgccgcggcggcggcggcgacggcgacctccaaccccaggctccgcgtgcggaatcctgaccctaatcctccgcgccctaattatagccgtcgtcgcttcttctatcctggggcaaggtgctggtagtggtcgtggtttttgacgacatggaggtggatgtgcaggtgcggacacatgcgcagggcggcgaggcgccctccagcggtggcgccggagatggcgcggccgggaaggagttctcgtggtcgtccatcatccttccgtaagatagctcccctctccatctctttggtcagtgacatttggggataaaatcggacagtgataggtgataagaggaatgcatttctagtttggttctagcttcccaatgttgagggatagcattggcacctaatttcaattcaagggagagagaatgctttttaactgttcagtagatattgcttgtttcatcgtgttgatgagaacaatcatattaaattagggcagactgtacaatgcattgtaagtaagatgcaatataattctgcactgtcttctcttctctgctttaatgctagataagaacatattataattcaggagatgataggtttgcatagtattttgattacatactgaagacaaatgttatagttggatgtaaaccattggtggttattatattaatacggcttggaatatggataaaaaaacaaaagcataaaggggaaattggaaaatatatcaagctttaactacttgtgggtcaatgtttggaacctaggttcttgttccctgcattgggaggactcctttttggttatgacattggcgcaacctctggagcatgcatatctctgcaagttagtccctattttggttggctatgcaatctgttatagttgtcatgtattgattcactctaatggtgtttattcctccagtctgctgaactcagtggaaccacttggttcagcctgtcatctatacagctagggctcgtggtaattttttagatattttcatgcttaccaaactttttgttttcccaatcaagaacactactgtctttaatgtgattttttgtcatccaatttaggcaagcggttcactctatggtgctcttggtggttcgcttcttgcatatcgcgttgccgattttctaggtgattcgaaaaaaaatgtttttcgttttttttccttactgtataatctttagcaagaaaattgactgctagtctactactaccatccttggttcaggaagaagaatagaactggtcacagctgcagctttatatatttctggtgctctggtcactggatttgcacctgattttgtacttctgatcataggccgtctcctctatggtatcggtattggtttggtgagtaactctgaggcaaccttttttctccccaaaatgcaatgccactgttattgaacaagtaaaagtataaattcatgtagatgaatgtcagaggaccaatagttatatatctttttgagttgggtagcacatgaaaactttaagagaggaaactgaactgcataatctgtatacttggactgcaaatgactcattacttccagatttagtaacagtgtagcttgatgaccacattttggtggaattaattataaaataagtggaaaggaaccatgaacgcgtttgatccttccagatatggcaatattgtgaatgcttgtagttgaaatccatcatttgggacaaggtctttccatatgaactttggacattgttgttactcagtgttgcggcagatatctatacctaattaaaaaaatacataaagcttccggtaaaaatttcgtccgtcaaaacccatgtccgagagactcttttatccccgcacaattagcgaagtcctgtttctgttaaccaaattaacaaatttaagttagaagcccaaacacggtcacgccaaaaagaaggcctgacctgggccttgaagaaggcccgacctggtttgtggcgttggggaaaaagatgaggaaaacagcctaagccagctggtaaaaccatggaaaaaatttgtatataccaaaaataatgaacaccacgtataagtggaagagatatagaaaataataccatctaacataaattattacaataatgggataattttactaatcagacccaataaatttaaccaaacattatcaacacagacatcaaataatctttacacgcatatttctcggtggtctcagctcgggttgggggaggaagaattactaataaaagatacacaaggattccgcatatttcttttcgtacgctgtccataccaatccactgcacacgaatgatggccagccggcgagcttccgagcttcccctgacctttttatcccaagttttgtgaatcactccgattttgagggaaacggaaagaaaatatcgtgtgggtaaaaaaacctcaactaattttgggagatcgagaaagatttggccggatttgatatgatgatcagcttcggtattgtatagatatgggactgtctcccggaggttgaagatgctactaaagcgcgtgggtttggcttggcaacgagagaagatatatgactatgctatctgagcctgtggctccatttgtgggctgggtcgaagagagccgagccgagcagagatatatagaggcagcagactgagctggggcttataaggaaggaatgattttagtgaaccttttgcattataatgtatagtgatttcaatattttaatttattgttcaacttctaatagatgttgtataaaaaaacgcttttacccgttgcaacgcacgggcattttttctagttaatactacaaacagtatatttgtttactgccaactaaaaaaatccgcaaatatctaaactgccgatgctttgttagaaaggtgttaataataactgaagaggaacataaatgcaaatgaacatattcatatcaaactaaaggtttggagataatgaatcattgttgtgtccatgtatattacatcatggggttatgttacatcactgaatcaccatgctttgtgccaagcgacgcacggtgcacctctttatattgcagagacttgtccttcgcgaatacgtgggacattgatatctttaaaggagttgtttattgtattaggaatactggtatatctctcttccaactgctacacacttttaagtatacccatctatcccctgctgactactccctctgtccccctcccccccccccccccccaaaaaaaaaaaaaaaactactgggtttgaatctggacatagcctatgtccagattcaagacccagaagtgggttttcttctaggacggagggtgtacttgactagttgactattaatacaatattttgcagactggataccttgtagggagtcttgaaattgatgtggtaggaggatggcgttatatgtttggttttggtgctccactggcagtaataatggctattggtatgtggaatttaccgccttcaccaagatggcttcttctcagggcagttcaaggaaaggcgtcagtggaagataacaaaaagaaggcaattcaggcattgagatcactgagggggcgctttaggagtgacagggtcttagcagatgagattgatgatacccttctctctattaaggctgcttatgcagaacaagaatctgaagggaacatttggaagatgtttgagggagctagcttgaaggcactcatcattggaggaggactggttctcttccagcaggttttgtcctcatcagcccacttggaagcaacacatctaaatatgaaatctgaccgtgctttgatcatccttttaaatttgaaattatgtgccctaagttcagtgaaagttattatgtccaagttgaggtagaaaaagaagaaagataatgacctgtctattcatttcatcctgctttggtcatttcttgattttttaatagttgactaatgttacttctttgttatatggaactaaagcactgatattaattaaactattatttcagataacaggccagccaagtgttctatactatgcaacttccattcttcaggtacctctgagtttcttttcatacaaggacagacagaataagacttagttctccatatggctgtgtgccctgatacatacaattaaatccattctatcttcaacagactgctgggtttgcagctgcatctgatgctgccaaagtatcaattttgattgggttgttcaaggtaattctatgaagctaaattatttttataatctagtatatatatagggagaattagatatctattttgttatccagatggtaggtggaaaggtatagagcttacacttttttttgaacctctgtgtaatatttctattatttgcagttgttgatgacaggtgttgcagtatttaaagttgacgatcttggaaggcgtccactacttataggaggcattggtggaatagtgagtaattcttacagacttgtttaagttctatggatgcatggaaagtgtcattttcatcaccttggcacctccccagttatttgtactcattgatagtcttgcttgatgtggatactaagaaactggatgcttaaccaagttttgatcaaacatgttctgaataaattatgcttatgctttctattccctggaaatgcaggctgtttcactgttcttattagcagcttactacaagattctgaacagcttcccttttgtcgctgttggtgctttacttctgtatgtcggttcttaccaggtcggtgcctttactttctgtagaaacggtctatgactagtgcaagaaatttatgttgtccttgtgtttgcaggtatcgtttggtccaataagttggctaatggtttctgagatcttcccactccgaacaagaggacgtgggatcagccttgcagtacttacaaatttcggctcaaatgcactggtgacatttgccttttcacccttgcaggtacgttcacccagattgttgtcacctcacatatatatttatctcatgatgtttccccctccaaagccagcgtttttttagcccttcccatttaaactaaaaaataagtttaaaaaaatcagcctcttcttctatctagaatcaacactacgtattttaccagtttctcccccaaaaaatagatgaacaaactaaactcttttgccggcaatgcacgccttgtttggtgcaggaattccttggaccagccaatattttccttctatttggagccatatcgttgctctcccttgtgtttgtcatcctaaaagttccagagactaaaggacttacattggaggagatcgaatccaagctcctgaagtaagctcactggtactcaagttgtatgtgtgtgtgtgttttttttgagggcaagttgctatgtgttcattagatgaggttgatacgtgtcggtgtaaatttgttcagtcgatttatgtgattaatatagtcgtacatgtagtattttgtacatgtaaattcttgtttggactaaaaatattctagagaaatccaaaaaagctgttcttgaagtgctattttttttggtcaacactggactggtgctatttttttttttgccagtgtaacacagttaattaaattattactagcgagacttaatgtggtactccgtagcagaagagtacgcgtatgaagtatgaactaactcaacatcgctgtaaatggggacatgaagttggaacctgtcgctcaggaaacgttaatgtctatcgctataaacccattaagcatttgcctctagactaacttaacattggtggaccaagcttatatcacgatcaacgaatttaataatcaaacaaaaatgctgaaaatataacatcttttgcccatattagaattgaactcagctgtagaatttttgacgtttgttacgtgacaagacgatttgcctgacgtgcttggtatggcgccctggttgtaatattattgtttatgaagttctttccttcggtccttttagctcaatacggtgtttcttttttatttctcttccttgatcatgaagcctaactcaatcgtctaaccaatcagtgattattcccaaaacaagagttgagctttcatggttcactgatgctttgccatcatgatggtaacatcatggcaagcaagaatccaatcattctagagggcagtagacgagctgcaacatcaaacgactgaccaaatgcagcaagccgaacaaaattgccctgctcacacaatggtagaagaaccactcattcagaatccaatcaaagcttggcctgttggaacgatggcatgaaaaatgcaaccctccgatgcgaacgtggccgttacttaggctgaagggcacacgtgtaaaatgttttttctcccacagtgaaatttgttcatagtgtagcttttttttttaatttaagcaactttattagagaaagacagagttaaggagctaaaccctagtacatcgcagaaggatataacacaaacaaagagaccatctctaataaggtagaggctaaccaatctaagaaagcaaacttccagatgaaactaaatagcagtagaggaccagatcgacggagctcagcagccgctacgaccggatccttaggcctccgtagacatgcaccctgcttgatagactggattaaacaaatcttataacttgtcattctctgatttttaagggatttgaggagcatcacatcttgtaggttcacatgtcagcgatccacgtcaattttttctgacgtggcaagctaggcctgacgagtgcttgcacacttgcaagactcgagtcatgccgtcgtcttcttctctgcaggacagccaaatctgaaactctgagaccagcaacgaggttgtttagactgaccgatcgatcgacgggagctttgggttccctgcaggaaggacaggaccggtgcaaccaccgggataaattccgtcttctgcaactctgccgttctcaactccgcacgcgttccttgaccagccatggctgcttcttcgctgtcgccgcaatgggcctcacgtgtacctgtccatcatcgatctatcagttcactacccccatttccttcatgatttcatctctccccgtgaataatccgtgatccgatcagcttccaacgccccggatttgatcctgtgtgcaggagatatactctttaaaaatactaggtatagtagattcatttactttcagaaacttcagatttcttggggtaaaaaaagaacaccacagatccagtaggcgagtcatgcgagcacgtaaagtagagaattatcccaaggatcccagcgttgcacgttggcacatgtgaagaatccatgctttccaggcatgaaaatctcgcgaatcaaacaaaacaaatcattttcaggacgtgaaattctttaaaacattcgcgtttagcagaagatacgatcacatagtggagatggacttcgtctagttaggtggtgacaatgatatcactggtagagaaaccatctttggtcggtcgacccatatccacaatagtcccggttccattaaaaaccgggactaaaaatgatttttagtcctggttaataagaggaagatctttagtcccggttgttgttaccaaccgggactaaaaatcatctttactcccggttggtaactccaaccgggacaaaagttcatttttagtcccggttgattccatgtcaggctgtgtcagggccctatgatctttagtctcggttagtaacaccaaccgggtgatgaactactgtaccatatggtaggtgattt

SEQ ID NO: 76207 - DNA, 730 bp, Oryza sativa
tcagccttttagaaccgaaaaactccgatagccaaaatgttaatataaaaaatcacataaaccattttgtgcacataattactaatttgtcatagttagcatgagctacaaaatgacctgagcctttcttgtaagttgtagatatcagtgatatgttatagcccatcatttttcccttatagggtatttcccatgctccattaccagaaggaataagcctacttcaccccctaaagtacgaaaccggatattctaccccttaaagtatgaaaaagggttcaaataaccccccagagtagttttttaggtggttttgccatgaaaatgattacgtggcagcggtattggcttgcatgacacaaagattagtctagtaaacccaagttgatctaactattgcttttcactcattgatcggcaagcctaatcccttcatcctaatataaggcatggtcaaacttggtacggttggcttataatttatcatgtactataatataaggtttatagcaagaaaattataatcatatgaaagtaaattcaaatgtcaatccaatgataattttctcaacaaataaaatttaattcatattatactaattattggtcaaatattttagaagttgagtcttgaaatgcttgcgcgccttatattatgggatggagggagtatatattaacactaatttacatcattctcagcccgtttcacttgtgaataaaatgctta

SEQ ID NO: 76208 - DNA, 2703 bp, Oryza sativa
atattataagtcgtctgacttttttcttagtcaagctttgttaagtttgatcaaatttatagaaaaatttagcaacatctaaaatgtcaaattagttccattaaatctaacattgaatatattttgataatatttttttttgttgaaaatactactatattttttttataaacttggtcgaagtttgactaggaaaagttcaaaccacttataatatgaaaaggatggagtacataagagtatacaacacaatagtttgttcactgctccttaaaaataacatcacaattactgtccagcgtccacatctcactccaacaaacgtcaataggcagaaatcaagagggccacacgaagtgacggatgatacacagaaaaaaacgcgcataaaactggtgttcagtatcgcttagttagaaaccagaatccaacaggttaggaagcagagggtttaccctgaggtaagtgagatcgtagagcgcatacacctcggatttgttgatggtgatgatgaggggatcccggatgggcatctcccccgcctccgtgccgttctcctccacctccgccacccgcgccaccagcgacgcctccccgccgctttgatcccccacaccgcaaacgttagcgaaacgaacagtggcgtggagagaaatttggggggaaatgagagagagagagagagagagagagagagagagagagagaggcggagagtcgagcgcgattaccgagccactgggcacggccaggtcgacgacgatcttgctgtcgcaggtgaggcggtcgcggccgtcgtccgagccgccgcgggcgcagctctccaggcgggacttggcgaggacttccactccgccggcgggcgcgaagttgttgacggccgcggcgaggagagcgaggaggaggggacgggatgagcgagcggcacggcggcggcggcgaggcgccattggtggttgcccgcggcggagcgagagcgaaggggagcggggcgaaactgacagagaggaggggcaatggaagaagattaaccgttttgagttcaaaatactactccctcgtcttaaaataagttttcttttatcatttattctaaaataaatttatttgttagtaattattatatcgaagtttataaaaacatgtaatgaatacattaaaagtagataaaatgatgaataattaatttaagattttaaaaagtaaataatattttagttacttttcaatttcttttgaaggaccaatacctataggtgcattgattcataaaatagagtaggaaaaaattacaatactaacactgtagttaggaaagaaaaaaactatcaccgcacactatgttatttttagttttgcgttgatatatacgatatgagtaaaaagataaaacttatttttgaatggaagtaaaacacgtcttgcatcttgtgtggctgttgagtggtttgatggctttgcaacttcacattaaccgcaccatttggaagtgaggatgtattgatcaaaatcctaataattttctgtgtgtgtgtgtgttttttcaaattttgtgttttacaaattatctgatttttcatgttttttttcataatatataccattattcaattaaaccattttactttcacgtgaaacaatatccatcaaacgagctctacgtctgcatgtctgcatttgtacttctcttattaatacaactatcatggtggattgcacatttgcataactagacttagttttaagattcacgatttgtcgtgtaatgtacaaacaccatgctattcatgatccacccagcgagagtctcgccgaaactcacatccatacatagagctcctagacatgtatgtatgtactgtctactttttgttcttttccatgtatgttctgtctattttgtttttttccttgctgatttatgctccctccgtttcacaatgcaagtcattatagcatttttcacattaatattgatgttaatgaatctaaatagatatatatgtctagatttattagtatcaatatgaatatggaaaatgatattatgaaacggaggaagtaatttgctggtaacataaatatgcttcaggatctctgcattactagtaactagtaacacctgtgcttacatgagttcgatcataattctcatattttaatgattcgactaatggtgcaaaactgcaaatacttcctttttaatgtggtaatttctagtaccttcatatagcaaaaaaaaaaagggatgatcataattctcatcttttaatgattggactaatggtgcaaaactgcaaatacttcctttttaatgtggtaatttctagtaccttcatatagcaaaaaaaaaaaaagggatgatgcttccaaaaatgaacgccgtccgtggggatcgaacccacgaccacgtggttaaaagccacgcgctctaccactgagctaggacggcgttttgaatgaaaagaaatagatcaactataactacaatgatcgtttagaattgcaccatacatcaattgctttgtctcttcagatcaagagcatttgaacagaccagaatgcatagaacaacttttctgcaatgaaggcatttgaagcaagaagtaacgggaaagcataaaaataactagaatgctcaacctatataaacttcagtggccgacggaacaaatttacaggaagaacaaatcgggctgcagg

SEQ ID NO: 76209 - DNA, 840 bp, Oryza sativa
aaagttcatatatgtggaagtggaatccctttccactggaaggtgtagatgattcctatgaaacaatggaggaaacattagagtacaaaagcaacaaacctgagctgcattattgggaggtctgtactcaacagctggtgacgatggttccaaggatgcgttacctaaaaaaaatgcatcatgaacatgtggtaagtgtagatgccagttgagtacagctaatgaatgcacctcaaacaaagcaaaaaaaatggtgaacatgtggtatgtgggagtagcactataccagcaaattctcttgtagcaatagcatcatgtgcattctcctcctcttgcaactgcctagctaaagcttcatcagatgccaaccaggcctcaatcctgtgggtttctgaggagatatggactgaataggtatttggagttgccattgatgaacctgcaatgatttgctaattaacactgacaatacatcaagtaaatcaaacattacaaatcagaacctgtctaagaatccatcttaattcagaaaaaaactcagattagatgttcatgcttccaccagaagcaggaatgtgcaacctacacttcctgtaatttccatactacaatgtccccactgaccactgtgcctgatgctctattagaataccacatcctccatggctccatgtaaatgcatataaatttgactctttaaattagtaactacaatttaaaatttatcgaacattgttcaaatttataaacagtttccccaaatttagatgctcccaaatgtacacagctactagtaaagcaccatccagtttcacctgaacaggactgacataaatgtgt

SEQ ID NO: 76210 - DNA, 2831 bp, Oryza sativa
ttgattgacattactcggagagatacagctcgcaggcacacgagattcttctgcctttccaattgccacgaacccacatgtcacacgaccaaccaaaaagagagaatttttctttgcacaaacaaaaagtgagatttttttttcgccacaaaggtgcgaactttcttctctctcccactttccaatcaagaaacgaagcactcaaaccaagaacaaaccaaggaaggagagatcgctccctctcccagagcaaacgaaaggagagaactcagatggatgcgaactactaccttgcctctttccccggagaagcagcgaaggagaagagcgcgatgccgccgccgccgccgcctccggcaacctccggctccggcgagtccgcctcctcctcctctctcacctctctcttcccaaccgtgtggtgttcgagaagcttttatgcgagcgacgtgcagtggaagcggttgctcccaagtcaaactgatggagaccacctactatcttcctcttgttttcttctgcttttcttttctttatcttttttctttcattttattttgagcgatgaacttgagaacagtttggttgtgggttaaattaaacggtgcagaattgcaaagctacgtccttttcgtctgattaaggtggtatcagaatcctaatctgttagctcagcatttgtttttgtgtgtttaattggccatgacatcagatggttcagaccggtggcaggtcttcatcggagaggagaatgagagcaatgcaagttgcaaacaacaaacaggtccttccaaacgggttggtttcattccacagaacaggatagcaaccagagcacaaaccgttcaacaatatatatatatatatatatatatatatatatatatatatatatatatatatatatatatatatatatatatatgatttaaaattatattactatttttaggatacggaactcttaacacatgaaaatctaaacattttcaaccaatcagaactactagaaagataatctaactacttcaaaatttaaaatttgacaaataaaataactagttttttctaaagctatcttcactggacaacttatgaatatttatatttatgaagcgagtactctcctagtacatattacatatatattcttcttctcatgaaaaattaacttctcgctataaatccgaacatatattatgcgtagcaagttgttttttttaacgggtggagtaatattagagtatttaaattccttcaaattgccatccctctgggactttgctgctgttgttcttccacggttgctgtcagtgtcacccagatttgcatcctttccagctcgtagctactgttctgcatgtattggacttggattaagatcaaatgcagttgctattgtaactgcacaatagcaactgcacacaatcatgtccattcgttttcagatccaacggctctagatgactgctacagtacatgcataatagtacatctctgctacaggttttgctgcagtaccacttcatatcctggccttccgttctagatcatgtgatgtacatgtttttttgaaacaacccgcacaagacattgatagagtaggaaatgtgatgtacatgttaacggcttaagttacagttacaataacaactgcacaggatcttgatccattggacttgtataatatctcatctcgtgcttccattatcgtggtaacagttggcaacttggcatccagtgctggaaactatgccgtgtgtacatcaggatcgtcctttttgttcagttccaagatagaacaagtccaaaagatggccgtagtttttttagtcacagtggaagctgacatagccgtggaataagttctgcacaaaagttgccattcgagatcaactactggtagtagtagtcatcttctaccactgcgaatattcgaagggacacaaaaagatcaacgagtaaattagttcaccggaagacgacacattatcaccacaaaaagactaaaaacaaaaagaaattgccaggccaaaaaaggcaaaaaagaaaaaaaaagatggcacgaggcccagggctacggcccatcttgtcgccggcccaaccgcgcgcgcgaaacgctctcgtcggctctcggctcgccgcgacgcgatggagagttcgcgccgcggcgcgcgcgcgcgttcggtggctcacacgcttgcgccctcgtcctcccggccggcgcgggcgccgaccgcgcgtccgccgcatgcgcgcggcgtaggtgagcaacgcgggcctcgccgcgcgcgctcccctccttcgatcccctcctataaatcgagctcgcgtcgcgtatcgccaccaccaccacgacacacacgcacgcaccgtgcaggcatcgacgacgagcgagagcccctcggcggcagaagacactcacggcgatggcggtgacgaggacggcgctgctggtggtgttggtagcgggggcgatgacgatgacgatgcgcggggcggaggcgcagcagccgagctgcgcggcgcagctcacgcagctggcgccgtgcgcgcgagtcggcgtggcgccggcgccggggcagccgctgccggcgcccccggcggagtgctgctcggcgctgggcgccgtgtcgcacgactgcgcctgcggcacgctcgacatcatcaacagcctccccgccaagtgcggcctcccgcgcgtcacctgccgtaagaaaacgaataaaatcgatttgctatctatcgatgattgtgtttttgtagactaaactaaacccctattaataatcaactaaccgatgaactgatcgttgcaggggctgcaggaa

SEQ ID NO: 76211 - DNA, 5529 bp, Oryza sativa
ttttccacgaaagccgattgaaacgaaaccgcgaaattttgatgcgagatgaaagcagattccgagtgaaattttaaatggttttcaagaattcaaatttgaaacaggaaattagaccaaaatttagcaaaaaccgtcattaccattaagggtcaagatccgaagctcaatcaggaaggcgaaccctgctttcgaccttcttgagcttcaagataaaggggcaatttctttgccactaaaagaactcgagcaaaataaggaataagcacaaagtagaagctagagtttctgtcgtttgccctgtttgatcaaactaaaaacaaaagagaagaaaaatcagcaatgtgcattgccacaatgaaactggctcaggagaactgtcccatcgacactctttgaaacgaacaatgtcatatggttttaactaaaggtatcatcatcctataaatatcctggctccatgttgtttatggtttaccctgacattaacatcgaactcaaaaggagagaagtatcaacatcacggcatcaccgccatttcacaccgcagaagaggactctcaactgaaccataaaccagtttgtactatttttactaacaaaagcaagatgcaagtataaaaaaaaatgtaaaaacacaactttctgagggtgtccctaaccatgactaaatctttcttcactattctgtaatcttttctagaaataaggcttcctgcttgcttgttaggcccagatcactaaatgacatatcgccctcaccagtggtgaaagcacgccttgggtacgaccttacctgcatgtcacagaatggtacatgtatgagttccacaattgtctcagactacacaatttctaacagttccacaattttaacaagagtgaaaaaggaaatgcccactcaaatcaaatggtagcagctacactgtggaaatggttttccaagcatggcagtagcctattagttttaaaaactttgatttagcagaagcccttcagctaacaagatcagtagcctattagttttaaaaactttgatttagcagaagcccttcagctaacaagatcagaagtcgcacatactactagagtatatcaccagaaaagtcagcgaaggagcagcaaagaaacactttaatgtaccctgaaatgaatctccctatcctttagaagctaaactatggactcgtcgttctcacatccacaactagattcactcttctgggagtacagataaaatatatgtcgtcaaataaagggggtgaccttcaaaaaagaactaacagtagcgaattaccagtctgtaggttcctggcttataagtcctgccaatgtctaagaaatcaaaaaggaactgcaagaggaaagcatgtattagtggttatccacataaaacagaaggacagaaagtaagcctacctgaagtttatgagatttcagaaagcgacgcccctgtcgactaccatcaggcatgcggactacaagtgtgacagcaccttcctcgtctgcagctggctctgacggcaatgatgcttgtttggatgcaagactggactctagctcctgtttgcataaaacgtcaggaaccacatcacacacattacaaatggtgcagaatacaagtgcaatatgaattaaggaaataatggacaaagcctcaatggaactgcagaaagaaagcaccaggtttgtcatacagctttataagaacttgatactgctttagcgaattgcttgtcaacaaaatgtagaaaatatcaatataataatacaaaatgtcaggaaagaagatgccatgatgctaggtagtatccatctagactttatgcagagtttcatcaagtatatcaaccagcagctaagcctcaaagtagaaccctttgtaacatataaaatagagcagatcaccagagcaccaagtttcatatgctcaaaatgtgaacttatgatctaaatacctagcattcaagtattgaaaagactgttgttgatgatcaattaattccataattatttttaacgaaaggtttacctcttcctccagttgttttttacgcctttcctcttcctcttgcttctgtttttcaagggcagcttctcttgcagcagtttcttccaggcgacgaagctcggcctcctgtagggccttcaactctttttcttgatcagcttggagtgatgcaaggtattcatcatcctgtaaatcaaattaacagtcatgacaattcattgcatataccaacaaataggtcaaactaaagatcaaacctgctgctcacgtaacaaccgctgttcagttaatgctggtgatggagcatgctctacatggggataaagacttgggcttctatgagatggcattgagaacggatacatgggtccttctggaattccaccaaacattgcagcctcaagcataacagcttcatatgctcctcagaagaaatgccaccccacttttccaaaggaagaggcaaacagtgaataacatataatttaaccttagggtgaagattagtattacagaaaagaatacctctgatggaaattcatctccattattctggcgatcattcaaatttccttgaggctgagaacttgagggaggactatcgaccgtgtacacaggttgtgctgactcagtgttccagaagggatgcgtctagaacgacgtctaactaatggctgttcttctacatcttcagtctcctcttggagggtatcttcatctattggctgcctagatgatccaaccttttctgtagctaatccttgcctccgaaaagaaaggacacgtataagggatcaagtgctgggtagcaagaggattaaagagcatgttagtaaaaattaatattcaccttccagctgttccgcttgcagttcccttgtcctcttcatcaaaagaatgttctgtaatgtttactccctctggcggctgtgttattccttgctctgctgtctaacatttttgaaacaagtaggtaaggcacatgaaagagaagtttaacaaaagcgtggttgaggaaaattaatacacttgcgaataaaggatcagctgtagcaagctcattctaatcattcacatttttatatgggagaaaagaacacatggcagactaaagcaaaggagatgagggtgtgcaagcttacaattgtcattgcctcagcatccctttttgaagcttcaattgctgcccggatcatttcctcttcgatatcattgtcatagtcagtaacatgaaccaatggaggtgcagttggaatagaagggttcggctgcaatgagctatcaatattagcatgaagagaaggggcagatggctgctcatcatcatcatcatcaattacaatagccccacgaacttcaggaccatatgaagattcatgcccagtgacatcctcgataataggggcctgaccagaagggcctgtttgcgggttgctatccttaacttcgataggtatctctcgcacctctctagggtgtgaaacctgtgggccatgaccgaaagtatctgtggaaccaactctgtcaaaataattttgctgaaagtttgtgtccatcagtgcaaaagggtcacgcaaagtttcagggaacaaagatcttctaaatgcattatcaagtggtccatccaggtccatcatatcatcatgactctcaggtatattgttttgactggctctgttcctgtagaacaccagcatctcattcatcagttctagcagtacagtgtgggcatatggaaagcaatcttatatgtaaataaagttggatggaaaatagtaaaggtgtacactgtactgtctccttcattgaaatgtgcattgattgccgtgttaaggtcgccaccatgttcctgagttacagtgatgaggtaagccattataaatagatgaatatagataaacccaaaggaaaaatatcattgcagttaacaatcatttcagaggtactccctcacttactaattaatcatggtatattcccaaatgatcatcatattagtattcattaccaaagtctatttgttatttgtgcatgggagtaaatatccgcatacatccatgcacacaaccctctacaaccaacatgcaatgtcttgttttgttattatctaggaagtagcggggatggtgcatgcattgagtttgttaccggagtaaatatagtccagtatttactccaggagagttattggctttccttggtcttggtgctctcatgtaatatgatgatcaattgggaacggagggaataatacaacagagcatgtctgaggaatttgcactaagctcacttaccttttttttttcctttcctcccacacgcgactaagcccaggacagatcacactagatagaagataagcaaagcagaagagacagggacagggatggctagattgaggtgaggggcgtatggccattcgaaggtactctagatagcactatacccagctgtgttttttgtgttcaagttaaaatcaaacaaccaaatatcagatccagtaatccagcacaccggatggtagggactatggacaaaccatgaattgacagcttgcgaaaacctaactacctaagttgagttattgaacactctagatgagcaatcacaagaatttcatacaaactctacaagccccaacttgaatgcgcgtgaggaagtcatatgaaactggaactacaaatctaacagggatatggtatcaatgccaaatcaatccgagattccgtgaccaaaacccgcgctcccaccaaaatcagagcgcgataagctcgcaatcagacagagctaacgccacgagatttgttccaagcgaattcaattccgtaaaagcgccttcacagattcatcacgagttcacggcaagtaaaacaaatcgggcgcacaccacacctccacctcaaccccccacatcgcgccgcgccgcatgaacccccgcccggaggaggaggaggaatcacaaacctagctagctccacgcgaccacgcccccatcccgactcgcccaaatccgcaccccctccacgagcgcgcacgcgatttaccgcacgggattacaaggggagagatgggaggtggggaaggcggggagggggggcatgtgggatgtacgcacctcgagcttgcggacggcgagggcctcgtcggcgccggtgatgctgacgaaggtgtcgatcgcctcctgcggcggcctcgccatggttggttgggttgtggaggcgacgcgaggagaagggggaaagaggataggagcgatcgatctgtttgtgtttgtgtcaatgcggtggagcagcgatgcgccgatgattcggtatgtagttgtacgggtgcttctgcgtcattctcaccgtctcagcggtcgatttcgcgataacaaaaccaaaaccgacctttgggcatggcaatttggcaatccacgattccacgtgtggtggaaccatggaacgtttacaaagagtagagatatgtactcctactagagttggagaattttccaaggaaaacatgtagagtagaac

SEQ ID NO: 76212 - DNA, 969 bp, Oryza sativa
tacttcctcaaacaatactccatgatgaaaccaatcttacatacagaggagagaaaagaaaaattggtttggacaaaatgggaatgcatttattagatatcgtcgattgtcaattatttatgaaatgataaagctatcaagagttacaagtgtttgtaaacatatattggtggttttctaattttttgcagatatattaaaaatgtgctgcatatatacttttctcacacacaattcatgttttctgctacaatgaaccatctttagggattgtgtttactacctatttaaaggttcattggcaacaagttctctcattcttccttttgtgagttaatgtcaaaatcaatcagatatattccaattttctctttggaacaaaatgaaatgagtgccatgcagaagactgctgaatgtgctacttatattgaaacaactcatatgcaaagaggttatacagtttttatctagcactaagtaattgtcgagtcacctacatttgttgatatgaagagccaacacaaatgttgatattttccaaaaatcaactgaaacgtcgaatttgaaatcaagttgtagaaaagggtaagaaggatgtgctcatttcaaacaataggagaactgtaaactatagaaacttgaagtcttaaggacactacactaaccctgaagtcactcgccatcataagcaaagtgccaacattatctgtctggaatctggactcgtcatttaggggctctttggctaggcagcagctgtatgtttcagctttagagttgtccttagaatccatctcattgagaaagcgtacttcaattgaaatctataacttcctcgcattctgggaagttcgtttttttattgtctacaatttttgtagcaactacaagcattaggggaagcagtaggaaatcaatccagaggattatctgatgacctgatatgctatttggtgccttttaagaaca

SEQ ID NO: 76213 - DNA, 726 bp, Oryza sativa
gatgagcacaagaacccggggtaggtcaagaaaccagtcacaggaatcacgtcgagaagtttttggcccatatgccacctcgggaatgacggatgcggggacccctatctgtcgaagttgcctaccgacgtagtgctgatagatatggccgaggtcgcgtgagaacgcgttcccgtaggcgcgtaggcccacgaagtagatcgacgggggaagagccttcatcaggattgcttgcacccacggcgctaccgttgtgcctgcctctatctcgatgaagggtttgtcctggagaggattgaacgcgtacttcttctgaggagacgggagcgggtcttgccactttcgattctcttccttgaacgctttcggcgtggtcacgagatactcattaaacgtccgccgcacagcatctaggtcgatcacctcaccgagctcagcgaaatgcgcaccctctaaccagcggagatcgaatatgccactgttcatcctggccccgacgaagatcaaaaacaccgaagcgacgtagtgtcgatcgacatgccactggtgatttcctcaaaccagccgggaaccatggcctctggggcgaagtctgggggctgctcgcctgccgacccgaagaggaggatagatcgcgccacctcagcaggcgcatggcgttgccccggaaactgttcgaagaagatgcgagtgagcaccttcgaaagccgctcgggggtgcaggaa

SEQ ID NO: 76214 - DNA, 4443 bp, Oryza sativa
  unsure (1)..(4443): unsure at all n locations
catctcttttccattgttaaaaaatggtcatttcctactctattattctccaaatcagctctccaaggttgtaaagcttaaactgacgtagacatgcaacaaacaagcacaaatggaagttgtgctgtacctgaagattcgtccttttttgacctttgtttattatatttgatctcatacaacaaaagagtattcatttccaattatttcgcgagattttattcttatttcaattttcacctcacgatttgttttttcccctgagctgttcatttcaatattttttgtagaaaaaaaaactcttgcccatcttaaactagttatctttttcatacatttgcatgtcaggcatcaaccagtaccaaacacctgatgatggctcaaaaaattgccatcaagatgtccattgcaggccacacctggaaacagataactttaattattattgcaacaaagctggttcagatcaggaactactactaaagtgctaagtagcacctattattggcatgttattctacacctccttttggctgaaatggccaaactctctcttgatccagtgaccagttccagtcaaaaatggggcaaactgacacagacagttcagaagaaacacacaatgagtggattaattgctcaaacatgcaggttgccagatttatctgatgctactacagctctgaaggaaatttttgcatagatgtcatcagttcagatgcatgcttgaagcatagatgattaatgttcatttaatcatttattggttggtgttagttgttagtgctactagtagtgtggtacttactctgcatgacaatatgatactactagatcttatccacagatgacagattctatgccaaacctgcagcttgtattgtttataagcaatgcttcctccactagacaaaattgttgattgctagctttacacaggaaagaatttgatgagaacatcaacaaggcatattaaagtgaggccttgcaaagtttcagttagacagcatcacgaaaagatcaagagtcttttccttttctttttcatccagaggaaactaaaagaaacatctagtttagctaatgttttgctttcatgacacaaatctctgctcttcaggaagaacttatcaactgaactgaataataatgacaggtagaccttttctctacagtgaattaaaccgtgtcactttcagattatgtgctgatctgatcagcaaaaaccaacgaaaaataaaatcttccatgtagcacgaactcgtgcaaatgcaatgtccttgactttagttggaaagtgaaatgtcctttgcacggctgcatcatctggacctctattttattttatcttttttcttaggattggactatggatgttgcatcttacttgaagcttaaaggcaatcacgattgattgaggggtatacgtggttgctcactatgacctgagaggaaaaagaaaagctcccttttcttctggactctctgaacttaattagtatttgcagcgattggtgacgtctaaagatcagcaaactaccattatcattgaaccagctaggcatctcaagattgtttttgacgaacaagacatctgggttgcctctcatccactttcggcaccgtctctctgttctccttttcctattcggaccgtagcaggtgcactacagtccacaacattacaactacagtatatcaattacaattattttcttaatctttcacgaacacgcagaataattacaagtcaatatattagaaaaaatagaggttttgttatacaacgtaatcagtaagacagacctatgcctagagggaaaaagaaaacacaaaatagaaaagaaaggaaaactactgttgaaaacactgatatatgaccgataaattatagaaaaataaagtaggatataaaataattgataggtaaaatttttatatatacttatttttgtctgtttaaaattttagataacaacgtaaatgatgaaagacatacttcagtattaaaaccagtaaagatttgattgatgaattacaatctcaccagtgtgatgaaatctgagcattgtagaaagcaggaagggggaagcagaaacaaccggaagcccacagccacagttcactacaagttcagttaccagtcgcagttggcaatttcagataagcacagaaactctcgacatgtctcatgcgaaaagtctatacgtactaactttttcttattaaatttttactaacactgacatgtcatgctatgagtgcatctagattttttataacttctatctacttgaattaaacggttgagatgattgttaatataaatttagtaagaaaaatttagtatgtgtagcggtgctctttctcgtgagatggacctgaccgttcgcccgtctcggttcatgtcaaaatttaacaagatcagcatatgaccatggcggctgcagccagcgaacgagagctcagctcagagctcaagagaggggaaaaaaatgcttcgcgataaatacgatatttttttttgagatttttttctttttgagaattcgataaatacgatacgaccaataaaaggcaagcgagcgacagcgacgactcgcgccaccccgccttgaaaaaagctcgagtctttggcctttccccatgggcgaaaaatccagcctttttttgagtctttttttcaccatcggtgatcacacacacggcacccttcttcccggcttttctgctgctgcccatcgtcttctcccccctcccctcgaaaccaaccaaccttcaacctaaccccgcaagcaaacgccctgaccgactaaccctcgccaccgagcaaactcgagacccaaagccacgcaactttctttgtgttctttgatttgttcttggcaatcgcatcagagatctattgattgattttgaagcagaggaggagcagagaggtagacgaagagctgcaagattctttgcctgttcaatcgaccgtgctttgtgagagcatacgacggcggcggcggcgagggcgcggcgtctcacctgccccgacggcacggcgaccgaggaggggaggccggcgacnagatgggctccttgccgctgaggagtggtagcagcctgcctccaccgtccttctccaagtcgccggcctcgctgctgctgctgtccaagtcgctcaccctctactgctgagagagctcgagctcgagctcgagagctcatgggcggtgtcacctcgtcgtccgcggggggaggcggaggaggggagaccgcgctgggggacctgccggagagctgcgtggcggaggtgctgcgcaggctggacccgccggagatctgccggatggcgcggctcagccgcacgttccgcggcgccgcgtccggcgacggcgtctgggaggccaagctgccgcgcaactacgcgcgcctcctcgccgtcgccgccgacggggaagccgccgcgctggaggcgatccccaagaaggaggtctacgcgcgcctctgccgccggaaccgattggacggcggcaccaaggtgcgtgctttggccgcaaccctttttcgctgtgttctatttaaggctcaaaaatcatgtagtttgcgaacttttgcatgtttatgttcgtgtgaattgatactagtttgtaacacaacattgtgttgtgatcttgtggaaattattacgcctgtgattaaccaaaagtataaggacttgaaatgatcttattggttgagctatggcttataaaccgagaaaaaaatgaacgaagcaactaaaaatggttttaggttaggatgtttgtacttctactctttagcagtttaaaagttaaggctgaaaaataggaagtggtgaaaaaaataactagattaagtttcaaaattcaagttgtggttctggcttataagttcatgggataatgatttgtgcccttgtgtttggattgttttggtctgattagcttcagctatctgtcaatttgagaaggagctaagttacttgtttatttaaagtctctcaggtttggattgttgttttcgtcggctatacatatgaaatttgttttgttgaatgtgtaggagttttggctggacaagggtggtggaggtgtctgcatgacaatctcttcaagggcactttcaataactggcattgatgataggagatattggaatttcattccaaatgatgagtcaaggtgccttcaccaaaaccaactctcagatttgcagcttatactggctaccatttgtagaaaactttttcaatgatttcatatgatacatagggatatgaagaaagaaatatagtggcatttaatctgttgaattttgtactggaggaaatcattaattcatctcatgtgaatttgttagcatttaggatatgtagttattgattaccttatgttagattttaatgttctgttttcctgtgcttgtgttgaa

SEQ ID NO: 76215 - DNA, 645 bp, Oryza sativa
ttaatgggctggaacgtgcatccagggatgacaaatgggccgtaaagcccttttatctgtctttcttagtgggctggaacgtgcatccagtgagatgttgatgggccgtaaagcccttttatcatctaacttttttttttgccggcgtctccaccgtccgccgtcgccggcgttgccgatcaagcttgccattgctcgccgtcgctgcgcctgctttgcgaccggcacatagtgatgctttcaggaagcatacgttatcttccggttagctccataaggtggtgggctagacggcctgggttcgaagtccccttctaattatttaatattagatcattccctaatattcatgtttttttaaaaaaaattcaaagagaaatgctttgttgaatttgttgaaagaataactgaagatcccccccgaaaaaaagaataattgaaggaagaatttatgtacaacatccgtcccaaaataattgtaatccaaattgtttagtaaatattaaggggtctgttcgctgcagctaaattgtagttgttgtgtagctgcgctacagtgcatgatagagaaaatatatgcactggctgtacagcgcagccagttacagctgcatagcagcgttgccgaacagagccaagtttgag

SEQ ID NO: 76216 - DNA, 1562 bp, Oryza sativa
attctatggagattttggaggaaaataaatatgaagttctatctcatgtttccttattcatatgactctaattcttgtgttctttctttgtgtcaactaaataaacagtttttaggactttcttgtgttttcaattcctatagaaattcaatgagcatgacattctattctattttgatgttttttctattcatgcgtcttcacaaacatttcaaatggaccctctaatttctcaaaatgagccacatctaagtaattatcctttacaagtaaagtccaatatatataggtttgtacttttagaagttaatttatgccttgcttggttgtgcattggattgaaatacaaagaaattttgattttttttaagaatagaaattataaaaatagagttgtgcaacaaaagctataaagaggaatcctaaaatcaaattctaaaattcaaaatcatctacgcgactatgcattcgaatgatattatatgagtacgactttacctttcgttactgaaaatgctacaatttaacgcatgcattgatcaattttgtgaaataaatatgaattaattctactcgaagatttggatatgcaaaaacacgtgctatatatctacctaaacaacaatttgtggcacaaatcctcgccatttccaagaatcgatcagcttgtgagagtgactctgtgtgtgccactaggtgtttccccatcctgccatatccatgtaccagacgcatgaaaggctgtgttggtactactctgagctatcgcagtaatagctctcggtttgcttcaccagaaggaagaatcatgccttgcctactttccaaggttgcccgctttacgaatggccaatgggatgcaattgattgcaatgcacgtccgcatccatatgacgacgagtcgatgatcaattccaccatccttttagctgcatcgacatcaactttgctatgttctagttgctacgatttttatcagagaaattaaggggagaaagtgtgatatgatttgattggccaaacaattaacctccaaaagatataatctttaatttacaatgactagcttgagttagtcaagatgacgctagaccagcgtactccatatgtcctatagaatataataacttttttatgttagaaacaaatattcaacaaatatatatgtggaattaaatagggaagattaattgcaattggctgagaagagaaaatatgtgaagaaactaaacaggagacggttgtgaacttgtgattaattggttaagatgaatgaatagatagaaaaattgctatatttattttaggacaaattttaatgttaaaagttcctatattattttaggatattttttttaatgttaagagttactaaaaaccgagcgaatatttctcttaagctaaagtgaagtaattttgtataagtggctaagtaacttatgctagtttttttccttctataaattgttgaagtgaaattaagctacatcagtgcattttgaggggaaaagcacataactagagcaatcatgttgacacttgacagctcacgccctcaatga

SEQ ID NO: 76217 - DNA, 1594 bp, Oryza sativa
  unsure (1)..(1594): unsure at all n locations
gaaacgagtaaaaaagggggagcggacaagcggcgcggctaaaaaggagagcgacaaaaaagccgcgcgcgcagaaggcgggcaataaaacaccacccccaaacaccagcgaganattggattggatgggcactcgcacccnacaaaacanaaaagggcncaannngagaaaaagagggnccaaccgaaaagggcgcgaagacgcacgaanagaaaaaacaccaaaacagaacagaacgccaggcgcaggggaannccaaaggaagggaaaacacaagaaagccccaaaaaccgggnaaanagggggcacaaagaaagaacacaagaacnagaggcacaagaaaaaggaaacaagagaaagaaccccanaacgaanngcccccaaaaaccccaaaaaaccgggcaatgcaaaaaaaacgaganaacccgagcctttgttttagaaacccatttaggaaactttcttataggactaaaatcctctaggcttagtttttttttctcatattatttatcacattgttgaacatattatttgctccacgcttcggaaaatgcattttttgaaaaaaaatctattgtattatttagacccacttgttttgagttatttttcaattttatttattaaagtatttaatttatccctataattaagtagataatccccgaaaataaatttattcaataatacgtttcaaactgaggctaagttttctatgttattcccacatatcaaaaggtgccttagcatactccctctttttggtaatctcttatattttcttcgaaagcatacatttcaaaatattgttattatagagagttcacgacacaattattgcattttttttcgatacctgcttctaattaaatgtttcgaaagagataattaagctggtcacgttatgagtttatgcatccaggttcttttctatttaattttattaataccttaatttgtattttgttgatctaacatatgggcggtgagctaaagacagataatgtgaagagataatatctatttttactttcctcaggctttatgtttcctgcaataagcatgcattcaggcgtttgcaggccgcagcagcaatctatctgctgacaagagaatgattcacagaagatctatccgcttagtgaacgcagcctttcggcgccaaaaaggctacatgatatgagttgcaacggcaaacggtccatactacaatctttttttttatttgtgttgcccattgtgatggaagtggacagtgtgtagtgaatttctgcttgaaaaatgaactagaaaaatgttcttttaaaaggaaacttgtgttttgaagactaaaagggaatattgaatcggagatatgggagatactgatggctccaaatctagagggaaattatgtgttattaaaaataatttctttaataacaattgttttttttaaaatctcatagtcaaataacccctacaggaaaccgtaggcagcatgccattacatacacactcaactagctagctagagtccgtttgaaagaaatggtgcccgtcagtctcaacaaaaagttttaaaagcataagtttacaaactggcgctga

SEQ ID NO: 76218 - DNA, 1582 bp, Oryza sativa
  unsure (1)..(1582): unsure at all n locations
ccggactcctgatttctactctattcctattccaccagctagatactactaaactaaacttgatgagaatgagagagctactaaactaaacttgaggggaatgagagagctattacttgaagtgtgtgagtgaagtgagaaggtgaagtccttatatagaggtagttatgacggttgtggaaggggaattgtccgaagtgccctccaaccgtcattgggatgcaatcctggacgtccacgccaaaccttgcatccaacggtgctaggatgggttcggccgaaccatgggctgggtcttcccggcccatcttcggctggcggcctcctctattgcttcactatgtagacttgtaaattttggcccaattcatcgtgtcaattctgagtttgtggcccattcatacataagtctggttatcgacaacgtctgattgatttatcgtctgagttgatgtcgattctcctccactttattgccattgtctgcaaaaggttagtatacctaatactagtggaatattattattctaacagatatatgcgttgcaagcattactagttctatattttggcaatattgacggtcaaaactgatcgataacaaccgtcaacaaaaccccccaagcttgaacctttgctcgtcccaagtgaaggacgaaaggaaacaaagacttggttgttgatcaggagttgctactatgctgcatatctcaaagatataggtgcaaggtatatgtactctctctcagattaaataatctttggtacggtggcttacccttacccctgattcccacgagacactgcttctccttgccttgggcagttgaaagacagaacaacaattagagcaccaatcacccaatcattattcaactcttattccggaagttttcaaatgattttgcataagaaagcctagttcctcaaatgattcactcagtctctctaagtgtatcaaaatgaattcctcaccactttgcctttttgattcctactctaaggcttgatatgtggagctcggtagggatcaaacatggcatacttgcattcgcctttattactaaataaaaacttagactaaagcaaatgactaaacatactcaagatcaagatcatgcaatatgtgtgtgtggtatatgatggaaatggtatataaaggaaaataaagaaaaagcttctcctttgtgcttactttcttctcccaaaaaatcattcttttattgattaggagagggcatggctacatttttttttcagtgtcatgctcatgcttaatggagcataactntatttttattatttatttttttcataaccatgcctttccctctctcttttttttttctttttcaaaaggatttttttaggagaagaaaacatatgaaagtatggagaatttattttggtggtaatatggaaatggaatggaatattgcttagctcccagtgtaggagtttagcatgtgcatatatgtgggtgtatgatcttgatcatagagcatgagaattatctacacaactcacaagagtttgacaaagttcaatggaatgacaagcaccaaaatgtatatggtttaat

SEQ ID NO: 76219 - DNA, 785 bp, Oryza sativa
tacactattactgcatactaattgggaacagcgtaacagtttaacacatttatggaaacaaaccttcaattcaatatcaacatagtctacgcctaactccattgctaaacggagtgcttcaaatcttgtagcatcatcaccatcgtactggcctccttcccaattgggtctgcaaaaaaaacaatcagatacgtcatttatgcaaagcatagtgttgtaaactagtatacataagttagacaagtatgaccaactactacaaagtgggttgcaacattgtgaatataaaaaagtactcacgttggaaaaagctacaaaataaatcaactaaagctcacaaaatgaaaagataaatataaggatgggagaagcatataccttttatgtatattttttttacagatcctataatataaatattcatttctacaagtatagaaagctaattaatggccacagatacgctcaatcagtttaagtgtttaaccaaacgccggcttttacgaaaataagaaatgattgtgccacgtctcaatcagaagtgaacgaacagataaaaaaccttttaggttcttgggtttagttcttttcagattatttaccagattgttgaaatggattatttgctcaacacttcaaaaaatacattttctccaaaaaaatatactcctgatgtattgcttagaccacttgttttaagttatttgttaagtaaatttatcaaaatattttatttctccctatcatcaagtagattatccgcagcaacaatctgctcaataatc

SEQ ID NO: 76220 - DNA, 1090 bp, Oryza sativa
caccattattaataatccaggaagtcatatttaaaaatgaattcttaaccttcatcagacctgataaaaaatgggaatctcttgtttcctctcaacctgagttattgatttaccagtaagatattttcttttcagtaaatcttgccacacaccttgctcatttattaatttaaacaaccatttacttaaaagacattggttttttatttctaaattgtgaactctaagtccgccctgatcttttagctgacaaataatatcccatattgtcaatctatactttttttatgttcatccccttgacaaaagaaacaggatctataataaccaattttttgaagaacccctttaggaatatcaaaaatgatatcataaacataactagacttgacaaaacagaattaatcaaaaccaatctcccactaacatatatatgtttacccttccaactactaagtttttttttcaattctttcttcaattgttatccaatctttattactaagctttctataatgcataggaatgccgagatatctaataggaaaatcacctagctatcacatatgaaacaacaagtattaacagattgaaatatatgttttcctttcatcaaaatataatcatgcgatatcttgttctaaagatttaattacaacgaataccatagtgtgatcggattgttgattggataagtaatttagagaaaaataatcattttgaagcttgctaaaatacatgcacgtatgtatggatgaggtggagaaagtggagagagagagtagtagcaagtagtttaaggaattttgtggaacacaatgaagacacacattgaaacatatcactaccacgtataaaaaatttagttttaacggtttaaaacacatgtttttattttgacataatataatcatatgatatattgttgtgaagatttaattgcaatgaatacaacggtgtgatcggatcgtagattgaataagtaatttaggagaaagaatatttaaagagagtaggaaagaaagagaagaaacagctagacatgcatgtgacagtaacagggttcgtccgattcattgggctgctgatt

SEQ ID NO: 76221 - DNA, 1152 bp, Oryza sativa
cgttgggtttctgcctgcctgtggggaccggccccacctgtcaccgggcctaaggagtggcatcatgcccgatcgcctccctcgaggggggcggtcgccctggcgtgacgccgggggctactgtcggtgacatggggccgggggtatcgtgactagaggcttgggtagccgcgatcactcacgtggcccgaccccctcgggggggtcgggcccgacggtgacgtggccacctctccctctgtctccccgaggggtcgggccgctcctgtttcggccccgagggctggggcaccccgaccccctgtggtgattggcgccacgtgtgtgggttaggtgagcacagcggcgctcacttaaccgcatttatagcgggttagacgagcgcgtcacgccgcattcaatgcggcgcagcgcatgcttatccgatctgtgaccagtcgcggtatgtgaccggtcacagaccggtcagatcgcgggttaggtggcaacaggcggcctgtcgcacgcctcgccccgtcccgtcggaatgatgagagcttcctggttctcgtctctagccggagctggcgtgctgactcctggagttggtatgtcagtcctggtcagatccattccaggcttcagtgcaagcatggcaagaaaatcgctggccattgaatgaaggatgaaacgggcgtccaccgggagagctgacgagcggagcaggaggcgtgtgtactgcttgtcagaggtcatttccggctgtagattagccctcattgtaaaaaacatgtttcttttcttaggcagagagaggcccatgtggtgacccctaaccagataaaaaaaggaggcccaggcctaaggagacaaaaaaggggggggggaggtgagaggctggccacttgatcggagagcctgaactctctctcgctctcgagctctctggctctggagctctctgttttccttcacacacagatccaccagaacacaggagtagggtattacgcttctcagtggcccgaacctgtctacgtggcccgtgtcttgtgcgcttcttctcgctgacattcctcagatcgagggcgaagaacctcacttagcgcccccggccgaaccggcaaaggggggcctgcgcggtctcccggtgaggagccccacgctccgtca

SEQ ID NO: 76222 - DNA, 2643 bp, Oryza sativa
tttcaagtttatcaccttgcctttgctggtttagctgtaccaaaagataaaaggaacaatttccaatgaattacatatacattttgtttaacaccaagtgagctttatataatatttatcaatagacttgaagacttatatatatatttgttataccctatgccttattcgaaacgaatccagtatgcttttttgagtaatggcctggactgcaagttgatttactgtttatgactattactattcacagttaaaactgcaaatttatagaggtgttaggaaatggaagaaagaaaataaaaacaaacagctgtttccatgtctcctaggaactctcagttgctacctaaaaagccaggtgtttcacttgcttggtaaaatgccaccgcacaatttggtaccactgcttaggacctggcacagtttggcaccgttgcttggaacataaacagaaggtctctttttagtgttctgctcaagagctttaagacctctcaagctcacaaccattatcatatgcaggttgctaaaatggataagctcagtggttctgcacgtcttattatcgtttcagatcttgaccacacgatggtttgtgtttttcaactcatatcttagacttgttcagagataattgcagcctgttatatgtcgttttaatccttcttcaattcaaacttgcaggttgatcatcacgatgaggagaacttatccttgcttagatttggcgccctgtgggagtccgtttactgtcaggattctctactagtattttcaactggaagatcccctactctttataaggaattgaggaaagagaagcctatgctaactccagacatcactatcatgtctgtggggactgagataacatatggtgaggcaatggttcctgatgatggttgggaggaatatctgaccaataagtgggacagaaatgtagttgtggaggagacagctaagttttctgagctgaagcttcaggcacgttcaatatttcacatctgattctgttaatctacaattatttcgaaaatctgatggctaaaataactagtaacattgttctattgccgtacatttgcatggatacagccagagacagaacagcgtccacataaggtcagcttttttgttgataaaaagagtgctcaggaagtgataaagtctctctccggtaatatggagaaatgcggggtgaggcaacattcgacttgatgttagcttgtttcaattttggataacttaagaactatttatggtttcttttcgtattatgttaactgctatatttcttgtaaacagcttgatgttaaaataatctacagtggtggccaagaccttgacatattacctcagggcgctgggaagggtcaagcacttgcatatttgcttaagaagttaagctcctgtggaaaaccaccaaacaatactcttgtttgtggggactctggtaatgatgcagaattatttagcatccctggtgtacatggtgtcatggtcagtatacaataaatttcatgaagtgtctaacaaagttcatgccagattgaatataagtttactgtaactgcaatctttttttaaatttttcaggttagcaatgcccaagaggaattgcttcagtggtatgcagaaaatgcgaagggtaaccctaaaattattcatgcaactgagaggtgcgccgctggtattatcgaagctattggacacttcaaactaggacctagtgtttctccaagagatgtggggtttccttatgttaaggaggaccatatcaaacctacagatgctgttgtaaagttttacgttctctatgagaagtggcgcagggctgaggttccaaaatcagattcagttgtacagtacttcaaaaatatcactgtaagtacatcactgcccagtgtgatgtttcttcaaaataatttgtaacctttgtcaaaatcagttttatcttttacctcaaaagaaattatcagaaccttctaattttggaaaagaagttatatttccaattaataaagtgaactgggtctgacgtattatattgttgagttaactgattttttatttgtttttggtttgtcttagcatgcaaatggtgttatcattcaaccttctgggcttgaatgttctctccatgcctctgttgatgcattgagttcatgttatggtgagaaacaagggaaaaaataccgaacatgggtggacagactatttgtctcacagtctggttcagacagttggctggtcagatttgacttgtgggaggcagaaggttagtccttagaattgtgtagaatgagtgaattagctcttatatgatattttttacacttcattcaaatttctttaatgttttacttacacaatttagcttgttcaatcatattttttcacttgtaggtttctctagacatgtcacttcaatctattaattttgttgtgtgttgtagtatatcctcgtacacaccagaaattatatgaaggttttaggcaatagtttatgaaaagattgacaacatattcaactctgcatctgtacgtacaaatgtcataatacattacacatatgcagtctagtgcaattcatttgtaaataaaagtaagaaaacatactcctcaataaaaaataatttattt

SEQ ID NO: 76223 - DNA, 2771 bp, Oryza sativa
actttctctaatttagtacacgtagcgatttagaaatagggagagctgctagacctagttgttggtctatttgtgtttttttacatgtaaaagtatttttgtttatattttctcattaaatagaaaataacacatgaatgaaaatatggaaagacagaagggaagtgcgtacagtacatacgcacgtacgttcgacattacgtacgttggttccgtatatgatggttccggatgtttttttttctttactagaaaaaatgtccgtgcgttgcaacgggagaaaacatgagaaattaaagaaaaggttaagaaaaatttacattatgtaattaattaaaatataaaatcatacctatacatgtatacgatgttgaagaaaagaaaggctcgtaaaaatcaaggtaaatgtggaaaaataaaattttccaaataaactatggctggatttattttttattaaattctccatgattaattacactatgtgaaattttttcggtattttcagagcaccattgctaattttaataatacaaacattattttagcatttatttaaatgcaaatctaaataaaaccctcctttctccctgggtcattttaagcccattctttctttagcccgtagccaagccggcccattaacctcacttctcctccctttcacctcggcctgcaagcgcgcatccggcccatcaagcaaccacaaagtctaatcggcatcccttctcctcctctcactatcgcgtgggtcccagtgctacaggtccgtccgctacctccgtccgactccgtagcttcctaacactgccggaaaccgccccctccatgaaatccgtccacatccgcggagataatccaaaattgattgaggggttttgatccttatctctttctctttccattttaccaaaattagagcaaaattgcatcatatcgacctcggaatcaagccatatagcaaacaacctagagttgtccgtttcgcgtacggggagagaatcggactgcgcgcctccagggacgacgtacgaaaaaagttggcaaaaacatcttaaacttttataataggtaaagataaagattaaatagatctacgtaaatctaaccatttttgaatgggtccaccaatataagtaaaaatagatggtcagatttttcttatttattatggtgccacttggcgatttgagagtgtttatatggtgccacttggtggtttgggagtgtttatagaaagtttaatggacttttagtatataatagattggaaataaactttttgatatcttattcttcatccattgctcttttgctcactttttcaaaaactgatgagagatgtacaaagttaggaaacggtagttacttgactttgcaaaaagcattctgctctgagctatatatatagaagcaagttcattacaagctcacaaggatagcatcccagattcccggtaaatgatataattagctctggtaaatggtagtagcccttaatatatataccctgtccctttgagaatatttgcttcataccgggagtcagtggtggacgcacccattaggcaggggagggtcagccggcccagctatggacacggtccgtgtcgcctcacgcggctacgcccctaaacctcatttgtagacctatttttaacatattattcatccgtctactattgaataatcagataaatcaaatattttaaatagagacaaaaatatttatgaaaattcatgacttataagtattatttctgtataagtagtaccattttgactgttcctgattttgaccatatataaaatttatttttttatttctatacaattcacaggaaatagttaaattggtaaatatataaaaaaaatatatttttactcacttgaactattttggcgaagcacttaaacccctaaataatttttcatcttgttttataaccccaattgaaagtggttccccatattattgtctaacaacatttctctttttctctctctacatataaatcatatatatttgttcgactaccaattttccttgttaactttctcgatatccgtgccgtgcactgctgcgccagtgtcatgagccggcgactatggtttgtgtgcattgtaccatcacctaattagagttagctctgccgccatcagccagtgactatgggttatatgtattgtgccatcatctaattagggctagctccgtcgtcccatctatattttaatcctgcgtctgccactgctgggagtgattgtaaagtggtcttttttctgttctcatttgtacgaatcgataaaatcagaaatcagggatttcataatttcattagacaaagctgaatacccagcttttgctcaaatcttaccacaaatttaattagacctaaacattagactcctatggattggttggacaacttaaaattaatcaaagttctcgtggagcagtgtagatcttggatgtcgattgttttgtatgcgagaactaatttcctgagttttcttccaatatttatgttgttgtaaaactttggtcgattctactgaatattattattctggtgatacaccatgatagagacgccggcctgaaggccttgggccagtctccaagggttaaattaattttcatcgtggtaataattttggcaaaaattaggctgggccggcacgcaagcggggtcagaaaatgtgggtgatacttaattggaataagttcacttcatgaccctcgaaattgatcgaaatctaatccgtga

SEQ ID NO: 76224 - DNA, 28338 bp, Oryza sativa
gccaccatggattccatttctattctcccctttcttgcttcttctccttcccagcaccggcggtccgggtggtgaggacaagggtggctggcggttggggtcatggagagaggaggtggacgacgtcgcgtgcagtgttaggggagaaccacgccgagccaaaaaacaaggatgggaaccaaaaaacaagtccatagtaaaacaaccgccgcaaatcaacagaaatggttagttgattatagtagaaatccagatagtaataagaaaagctatcatctaacctaagaagaagtcatggagaatgtctagatttttcgtcctaaaaaaagaggcagctcaattataatttcacatatcttgccatgagacatgtgtcttaaaatacccaatcaaactaacaaaggcattaagaacagtttctgacaaaaacatggacgttagtattgagagatttttatggcaagcaaacagcggatttaagaaatttaagaacgatttccagtggttaggctataacctaaataagcgataaactgattaatatgtaccaaaattataaaaatctagaaaaagtgggaaaaccaagaaaaaccctaaaaggaacataatatttcgatacctgtaattttaggcaaaaaaaaaaaaaagaggacttgaatggggtggccgtggatcggagtcacggataagtacatgaaattttaaagtttaagtaattttatgaaaatagaaaaaaagctaatttaaattggaaaaggaatattctttcgagttttttttgctgacagatggccgttggttccaaagggcagtcaggcaaaattagggagaggtatatggggggaggtctactacacgaacgttcgtggatgacgaatctcacaaaccattagcctttcttcgtactaaatcatgtaaatcacacgcctaatcacggtttgcacctattttgtcgtttctgtccgtaaatgctttattttttccaagtttgttttgattggactattttctttttagaaaaatactccctccgtattttaatgtatgacgccgttgactttttaacaaacgtttgacctttcgtctcattcaaaaaatttatgtaattatcatttattttattatgacttgatttatcatcaaatgttctttaagcatgacataagtattttttgtatttgcataaaaaatttaaataagacgaatgatcaaacattggttaaaaagttaatggcgtcatacattaaaatatggagggagtatcctctaaaatttctaattacatataatatatatatactaattggagtatataaagtttttatatagaaaatatatatatagtttataaatacataaagtttatatacataaagtctatatataaaaactttttatataaaaagtctatatataagggtataaataaaaaagtctacatgtagaaagtttccaaaaaaaatagttgaaataaaaaaggtaatctggaaaaaaaaacggtgtgaaaaaaacagaaaaacactatgggttacgtaaaagaggaaactaaaaaacgaaaacttatcaccttaaaagtggaaacggcagtgaaacggaaaaaaaacggaaagagatgaacaatacgcgtacctgtgaagaaagaaatatctgttcccttacctattcgtgagatctgctagtggcgcacgttcgcccacacttgattcacggaggagggaagggtaatgggccggttgatggtctttgtcagcgaggatgcatattagactttgcgttttatgtgtagtgagagactggtggccacgacacgcgagaagtccgacacggcgtcggtcgctcgccgttcctactccgagtccgagtcagtccctcctcccaggcagcctatataattattcttctatcaattatctcctcccaaatcgtgtgatttccttccgccaatcgatccctctcgcaagcaattgttgcggccagatccgatcgcatcgatcgctctctcgggcgagatggccggcgtcgaggtctccgtttccgtctcccctaccaagaagagaaaaggggggagtcttccgccctggacggaggagaggacgatgccctggctcatccatcaaagaagaagaagatgtggctgctgcccaaggaggaggtggactggatcctcgctcagtgcaacgagcccatctgcgccaggttccgggagctgaagcgcgccaacccgtcgctggtgccgtcgccggaggagaaggacgagtacaccatgcttctctacgagtgcacccgcgaatcctacgaggacgaggctaagtacgccaagttccaggactgggttcggggcgagtacgctcgcaaaggatttgtggaggtggactatgactatttcgccaagagggagaaggccatttggctgaacgaggaagcacgggaggaggttttggggcactggtcagatcgtcatcatccttcccacaccgaccttgacgatgaagattggaagcttgtaagatcaattctagaacgatttgatcaacggtccgcaatttcccgattcaacagaaggaactaagcttttgtagtgaacaaatcaattcacctctgtatgattcactttgtgcttccattctctctctggcagagaaattattttgaagtgtcatatgttttcatcatctgtctttctcttctcacctctatatgattccactttgtgcttccattctctgtctggcagagaaattatattgaagtgtcctatgttttcatcaactgtcattctcttctcttggtggtcaaatttttttggtcaaattgaaacatgaatgatttagctatagaaaatcattcgacagccatttagccatttagccttccccttccccttttggtgcaggaagcttccttcctatagttcagagctcatataaaagaaaagtccaatcttttcactaatcggttgctaatgtgatcggacgggttaatcatatagtatatgagttatagtattttcatcagaaactcatagttggaatcgcaactaagcttttcaaatgttcaaagcaaattttctcagatgtcggatggaactaattaatatcttgccaatttagatatatacattttttcactgtgctttaatctgagcagccaaaggtccgtaactcgattcttggatccacaaaaggttttggtcatggggtggtctaaagatgagatttttggggctcaaactttgggtggttcagattgcagttcggggctgatgtaaattggtgtagtgcaaatatgcatctggtcaatttgtaaagactgcatgtttttctgatgtcttctgagtattgatttcgggagagatttttgttgtttgtctaccgttgccgaaaatttatctcttctctccaagaatttatttactgcactgccaaaatgtatatggagattcagaattcttcagaaccgcttctgcaaggccaaaacagctgagaaccgtttatcattagtatgcaatgtttgctttacggacatgaatatagtagtatggacttgcaacatcagtctatgcccttactttatgtcatcttcatgaaatacgatacgtttgcagtcaccaatagcatgcggtttatggttattcagaacttcagagttcttttctttccaacgcagtcagtttttccctctcgtacgtgtttcagagaaattgggttggaggcaaggagtaagtttgataaaaaccgtgaattacacaaaaccacaattatagtcttggcaggtggtacataaccccaaatattatggtcttagtattgaaaaaaaaatcagatcaaatattagagcacaaataacaaaataaccaagctcaacatggatagcatcccagttgatgaacataattatctggtaaacggtagtgttgactgcagaatataccgctgaaattgactacctgcgagtgcgagtagcgcctgtctgattcttttacgctcgtagtccccttgagagtatttgcttcttattgggaatgactggagtgtgattttttttcctgctctcagttggacgaatcaacaaaatcagacatcaggagtttcattagacgacattgaaactaaacttaaacattagattcctaggattgcacaatttaaaaaaacaaagtccacgtggagaaatgaagatcttggatatagataattttgtcggcgagaactaactgcaagagttcctgccaagatatttcttgtgctaatattttggttgattctacaggggtctagctatacattggttgataaattttctcctaaaaatttatttgggaggtccaaatataagtcaatcatagagtaattaaattataacgtatgtataaccacaaaataatttgtatgtaattaaaagtctcacacagtaacatattattttcatgaagcagaggtcgctatgaccaaatctccttacccatgtacacgctatgatattttgtattcctaacttaacggttttaacgtacaagttacattgcagttttatgtaagttgcaatataagtaattttagtgtatttatatatgatgaaattttagaaagagaaaatttatcgacaactatatagaaaaatcattctactgaatattattccagtcatacaccatgatacttcagggactacaaacgcatgggtaaattttatagtgcaaaccataaatacattgaaaatctgaaaactatatcgttggatcgaaaaatagacatttgaggataaatttactcctaataaatttttacttaggaataaatctgcgagttgagtaaaatttttacttgtgatgacgtggataaatctcagacatctatattttatccaacggtagttttatgtttccactccatatgtagaagatgtggcgtctgcccaaggaggaggtggactggatcctctctcagttcaacgagcctgtctgcgcctggttccgggagctgaagcgcgccaacccgtccactagtacagatccttccatctgtgacggcccctaacaagactggaattcgcgggccgtcacaaggaagtaatctcaatcgggccgaagtttcgcccgattgaaatatggtcgcacagccatggtagatcggcataaaactaagggtcataattgaggcccgattgagatgagggttccatatctcaatcgggccctaaaagaagcccgtcacaaatgactgtcatctgtgacgggcaccaaccagaggcccgattgagataagtttaatgcccgtcacagatgacactcttctttgacgggcttttattaaggcccgatagagattacttgtatgcctgtcacggttgattgttttagggccgttacaaatatttgttgcacagtataaataccccccacctaatgtaactatatcccactgttcattattttagtgggaggctgcagggggcgattttttgtcttttttccaaggaaaacagaaaattcccaaaagtgatcaaaatggagcaatcaagtgagtaatattaatcattaattgagcaatttcatcacgtcttacttttgcaatactgatcttataagatgtgcctctgatttgttttttttattttgtagcaattgatcgaagttggatgtatgcgaaaaatttgaaacgtcattctacggagtacagaaaaggcgtaataaattttatgaacgccgcggaggaggatcggaaaagaagaaacaatgattacatgtgttgtccatgtgcagattgcaagaatgagaatatgtttgatagcggagaggatgtacacggtcatctgatacaacgaggattcatggagggctatacatgttgggtgaagcatggagagcaagaatcaggaagtggagcagcaacagacagaagtggtgcgcataatcaggaagatgaagatgagcatgacatgtttataccttctccattgggcggtgaaatggttgatgtggatcacgatctgctgcaagacatgttacgtgacgttgaggacccagcccagaatgagagagattccatgaagttcagcaggttggtcagtgattccgagacgtctctgtacgctggatgcaaagcaaaacacactaagttgtcagttaccttggacctaatgaagctgaaggcaagtagtggatggacagacaagagtttcacagatcttttaggaattttgaaggctatgcttcctgctgagaacacattgcccgagacgacatacgaagcaaagcaggttctgtgtccactggggttagaggtccgtagaattcacgcttgtccaaacgactgcatattgtaccacaagcaatatgcggacttggatgcttgtcctgtctgcaaggcttctcaatacaagcgaaagaaaagtgctgacgaaggaaagaagtcaaagaggggtggttcggcaaaggttgtgtggtatctacctatcattgatcgtttcaagagaatctttgccaacccgaacgaagcgaagttagtacattggcacgccacggagagaaggaatgacggtatgcttagacacccagcggattcgattgaatggaggaatatcgatagaaaatacaaagactttgctgccgaccctagaaacatgaggatatgtctgtgtacggatggcataaatcctttcggtgacatgagtagtactcacagcacttggccagttcttattgcgaactataacctcccgccatggttatgctttaaacggaaatttattatgttgtgcttgttaatccaaggtccgaggcaacccggcaatgatatcgatgtattcctggaacctgttatcgacgatctagagattctttagaaagaaggtgtggaaacttgggatgcatatggtcaggagaacttcaagctaagagttctattgttctgcaccattaatgactaccctgtactcggtaatctttccggacaaactataaaaggaaagaatgcatgctccgattgcaaggaacatacacgaagccggtggctgaagaaatcacgaaagatggtatacatgggtcatcggaggtggctctcgctacgtcacgcatttagaagaaagaagaaaatttttaacggtaagagagaacttcagcctgctcccaaagatttgtccggagatgagatccacaatatggtcaaggacataagcaatgagtttgggaagaaaagaaaacgtagcaagacaaagaagaagggtatgtggaagaaaaaatccatattttggcggctaccttactggaaagatcttgatgtccgtcattgcattgatctcatgcatgtagaaaagaatgtgtgtgagagtttggttggcctgatgttgaatattcccggaaagacaaaggacgggttgaacgcgcgccttgatctacaggacatgaatattcgcagtgaactccagcacatacgagatgcagagacaggttgagtgtacctccctccagcctgccacacattgtcgaaggatgagaagatcgcaatgttatcatgcttgaaggatattaaagttccatcgggctattcagtgaggataagtaagtatgttaaattggacgactaaaacttgttggaatgaagtctcacgattgccacgtgctaatcacacaaatcttgccagttgctatcagaggcattctaccatcgaaagtgcgtcacacgatccaacgtctgtgcaccttcttcaatgcaattggacagaaggttatagatccagaagatctagatgggttgcagaccgatattgtgaataccctctgtcacctgaagatgtttttcccactgtctttctttgatataatggttcatctccctgttcatctggtgaagcaaacaaaactatgtggcccggcttttctaagggaaatgtggccgtttgaaaggtgcatgggagttttgaattcatacgttcgtaacaaagctaaacccgaggggagcatcattgaaggttacacgaccgaggaggctattgagttctgcgtcaattacgtccgatgccgatcctatcggagtttctgcgtctcgtcacgagggaaggttgttaggtgttggcacaatcggaaggaatagaattaggcccgatcaagcgtcgtacgtgcaggctcattacactgtgctccaacatatggcagaagttggcccatactttgaggagcacttagcgaaaatccgagatgagaacttggggcgatctgatgcatggattaacagagaacataactctcggttcaacgaatggttcaagaatcatgcgacaatgtccacggatgtcccaaatgagacagtacagttgttggggatggaaccgtcttggaccctgggagctaaactacgtcaagttcaaggttcctttgttctgctgccgttgggtgaatctacgcactggtgtcaaagccgacaagaaaggatttactttagtagatctatcaagggtgggatacgccgatgaaccatttgtacttgcgaaacaggtcgagcagatattctacataaaagacccttcaaacaagaagatgcacatcgtgagggatggcaagcgccgaattgtaggagttgacaacgtcatcgatgaagaagaatacaaccagaatcttcatgtaagaccttacattgaccttgacgatgatccccaagagtctgtggcatatgctcgtttagatcatacggaaggcataaccttgtgaccgatgcatttgtacttatctattgtaatgaatgaagtattttattttattacaaagacttgatatgtgtactaatttatatggctaattttgttttattacaaatgttgtttaaatatgtcaaatattcaaattgaatttcatgctgttgggaatatagttatacataaaagtgaccaaaataaaagttgtagatcttgacaggatctacgactttgttgttgttgcctttttcatttgaaatcatttactatttacaaaaagtggttttaatttgtcatattttcaaaatcaatttcaagctgttgggaacaaagttatatagacaaatgaccaaaataaaagttgtagatcttgataagctctacaattttgttgttgaccatatttcgatttcaaatcatttactatccgaaaatgtattatgactaataaattgaattattatatagcagctatatattttgcactcacaaatataaagacttgacgggaaaaatagaaaatagtcatcggtgacgggccttattttaagcccgatagagattaatctatctctatcgggcattatcgtagggcccgtcaaagatgagtcatccgtgacgggcctgaatgtcatctcaatcaggcattagtatggagcctgtcaccgatgtgtcatctgtgacgggccctacagcaatgcccgattgagatgactcatcactatactataactagggtttctcagatcagatcgaaaatttttctaagtcccgctacagtttcccgcctccttagaaccctagcgccaccgtcgtcctccatcgccgagcccgccgctgtcgccaccgagcccgcggccgccgccaccgagcctcctctgccctccattcggaccgccgccgcctcctcaccgatgacccccaccaccgccgccaccgccgccaccgagcccgccgccgccgccaccgagcctctgcaccgaccggcgtcggccttccttgtcgtcgccgcccgcgtcctcaccaacgcacgtcgccaacccccaccgagcctgtcgctgcccgcccggcgccgacctgcccgaccggcgtctccaccgacgggcgctgccctccaccgagcctggcgccgctgccgtgaactcctccttcgccgagcccgccgctgccgccaccgagaccgccgcctccaccgaccggcgacaccctccaccgagcccggcgccgccgccaccaagccccaccggccgtcctcaggtgagtcctccatctcgccgccctctgctaactgtgaatgacatgtcattgaaatgtggatgtggatgatatgtgattgaactgtgagtgagacatgttgatgttgggatgaaatgtggtgcatttattaattctgtgatagatgattgtagtgattgatgaaatgtggttcatttaactttctttatatgcgaagtggttcatgttgggatgaaatgtggtttatttatgttgggatgaaatgtggtttatttatgttgggatgaaatgtggtatatgtatgttgggatgaaatgtggtttatttatattaaatagatgaatttagtaaatagatgaaatgtggttcattttataaggatgagatgtccaatttagtttatttaaatgtttcatttatttataagtgacattcaattcattgtaatagattttagcactgaattctgtattttcgttattttgaaaaaaagtagacgatgtctcagcaaggcgaactaatgtcgatgacaactagtgggtcctcaagggcacgtactcctaggacagggaacaaaatccttaaggaacggttccgcataacgacagtgaaccaagtagggttgccgataggtccaaggaaaatattgagccgatttaggtttatctgcggggtcatagggaggcagaaattcagtattccgcaagatgacatcaagcaagtgccggccgcagagaaggatagtgcttggctagcgttcaaggagagcttcgattatcctgtagagcacgagaaccttatcaggcaggctgcttttaaggtcatgggcaacgcttggaagaacttcaagagtaagctagtcggcgagttcgtcttcaacccgacgaatcctaatccaacagagaaatttccttggatcacggaataggtctgggaggaattccatgcgaagaagtcgacccccgagtccatagctagaagcgaggcatatctcttgcttcagaccaagaaccagcatccgcaccggcttggcaccgccggatatgccggtaaggaagaggaatggccgcatgaggatgaagaagcggaggaatcaaacacaccgctcatgtttggcgatatcccacacccttgggctaggaactaggccagggctaggtaccagaagaatgctgatggcacaatcttcatgccaaatgcaaaagatcaacgagtgtacgaagctatagtaagtgtctagtcaaactagatgttcgcattgtttcccatcttgcagtttatttaaccccactaaattgtaatgcagaaggaattggttgccgagcaacaaacctcgcaagaggccagctctcaaagacgcgaggacgacctcctcacgaaagtgttgggcaacaaggtacactgtggacggacacggggcgttgggtcctccgttccctggaagtatggatttccagactacgcgtggcagtacaagaagcggacttccaacaaggcggagaaagatgcacgccttgaagccaagatccgggcgtcgatcagagcggagctgacatctgaattcgacgaaaagctcgagtcgatgagggccaagattaggcaaaagatccaagaagagcaacagaacccgcaggccgccgctgccgttgcgcatgaagagttaggaagtcccacccaaaaacgcagcagttgcgcatcaactgagttggcagaaaatccaacatcggttaacagcgccatcgaccacataatggtaaaagtttcgtacacaatgcatgaaaggcttaacgaatcaatatgatatataatattctaaagaaattgatgaatctatcgcaggaaccaacgagctgcaccctcacagttagggtgatgccgaccttcacagttccagcagccgagggacttgcgtacaagccgaccccagagacaagagtgcatggattgcaacttaggggcgactgtgcaaaagttcaagtcgactcggttaagcccgaatacgagctgttcccactgaggtacccaccgaacgacgaggtcctctcactaggaaatgcccgtggtaccttcatccaatggcccaaggaccacattgagataagggttacagcgaggccaaccactgcaccaggcggtcatccgccaaagagacccgcctctgctccttctgcccctcctgctcaagatcgtcctgcacaatcttacgatgtgcagttgcagtacgacacagattttagggaggaccgaacggaggccgacagcaaggcgattcatgaacccccacctatgaagaagagcaggaaggcacactcttcccctcatagaattactcttgataaacccgaagcaaaggggagaggaaggggaggaaaggtgcaggcctcgcttctagctctaaggaagctagatctgggcaagggccaggaagacactaagggcaaagaggtcaagaagaaatacgtcgctccataggagttccaactaggcatgccattggttggagatgacgtgcttgccgcaatgggcaccgcttgcaaggaccttcacgtatactacatggagaaatctaacactaggaggccaaataaaactaccgatatccttggagagcacgatggaaagccattccttggtccaacaaattatatcatggtcgacttcaaggatctattcgacctctacaggctccgagcggtggacacaagcctccttaagtgctactccttgtaagtattatcgcccaacttaatctggtaacaacaattggtttaactcgcttacaagatcgtttatcatgtgtgtaggttaagttggcaatggtgtcagaagaatgcaccggaagttgccttccttgatccacaagtggtcactgtcacaaatatccagaatgaccgtcaaggaatggtcagctacatctacgacaccttgtggtcccgccgagacaaggagtacattatgtgcgcctataatcaatagtaagtgtgttatctaaatatacacaacagcattacacattccttcagtacttaattaactttcactatattaatgccgcagtgcccattggatccttctagtcataacacctaagtggagtacatgtcactaactgaactccagaattgataagaacacatatgattagaccccaattcaactagcgatagatgaagcgtgggcccaatacgtgcaaagaggatgcctcaggaagacaggacatgacaccctcatccacaaaaaagacttcccggtgaagcaacaaataggtgaccagtgcggattccatgtgtgccacaacatgcgccttctgtacagagaaaaggtgaagactttggctgagtttgaggtcggtggtctcaattgtgatagactaactacattttagtacttatatatgatcgatcaagtaatctggaattatgacaatgtagggcacaataaccaagtctctgcctaccagctttgaggagattcgtgaggagatagccagcttcatcctccgtgaaataattaaccccaaaggaatgtttaggcttaaactaaaatgatgagcaatgttgaacttttatgtctagagaatgatgaacacttattatgcaactgtgatgatgtaactgtgatgcttatatttatgtatatatttcatatgtttatgttaagacttgctaaataaatatttgatccaattaactcggttttgcaggtgaaatacgataaatatttaaatggatgtgaaatatgtgaatggatatgaaatatgagatggctgtcaatgtgtggttgtgtgaaatatattgatgtctgtgtatgtgaatgcatatgtatgaatgggtgatgctggggagctggggatattagatatctgtatttgtttctgtcatttttgcagcgggcatggctagcaaaggcctgaggctagccaaaaaaacaaaatttatttttttttgtggattatactcatctttgacgggccataactaaatgcccgattgagatgatgttcatctatgatgggctctagtttaggcccgattgaggtcagcagtcatctgtgacgggctctagtttaggcccaattgagatgagtgtcacatgtgacgtgctctagtttaggcccgattgaggttagtagtcatctgtgacgggctctatttgtggcccgattgagataggtcatctgtgacgggctatagtacgcttggtagactgggtcaaagctatcggtgacgggcttcaattagggcccgattgagataggttcatctgtgacggccatttgcccgattgagattacttttcacatcagtaacttctagcctatgacggacgccgtgcccgattgagatggggcttactgcctgattgagatgagggtatccgttctagtggtccctggtgccgttgccggaggagaagggtgagtacaccatgctcctctacaagtggacccacgactcctatgaggacgaggccaagttcgccaagttgcaggcctgggtttgtggcgagtacgctcgcaaaggattcgtggaggtggactatgactatttcgccaacagggaggacgcgattaggctgaataaggaagcacaggtggaggttttgggacactggtcggatcatcattatccttcccacaccgatcttgacgatgaagattggaagcttgtaagaacaattaattatagaacgattcaatcaacggcccaaatttcccgattcaacagaaggaactaagcttagcttttgtagtcttctcaactactccgttgttggtagtcaatttttttccccttttgttggtgtggtcaattttttccccctttttttgttgaaagcggattgcgagatacagaagaggatcaattttggagtcatcaagatcaaaaagaagataattttgaagcatgagttctcatactccaaaattggggggcatgttttaacagtggaatttggtaagccccgaagtcatcatcggcctagagtgagtttcagcttcagagtcctggaatcggccgatgaaattatcacgtcggtaatagtcggattcttgctatattcggttaaggaaattaatcaatcaaatgaagtttatccaggagagaccgagttaaagaaggatgcgacaagcagattatctattaattcggaagagtatgtaagtttccttttatcctcaggaaagtttctttcttttccaacaaggactagcatctacccttggtataaatatgtacacccgaggtcattgtaatctatctcaacgatcaatacaactactctcggcgcatcactactctttttgcttttctactttttcgacgagtttatacttctcatggctgtttgcaccggtggggctagggcttcgacactctaatcttgtcaatgtaagcacctatctatcatatatcttagttaatctattttggtagttcaatttacttgtatcggctaagatttgttttaggggtttatgctggtatcggctaaattgctttatcatattagattagctaagatatccactgccctgaagattagtcaaagacttaattgtttagactttatgcttctttgcatactttgcgatatatcatccctagtcgtgcttgaatcggaaaagctaacctgcctttgattataataagggtttcatcggggtttcagctgatgagttatctggacgttgcatcggcttataaggattacatacaagttagatttagccgatcgcaacaaaggtttcgttgtttatctaatcttgtggatttaatgacatcagacctccagccgatgtatgctttaaccttcggatcaatacttattctatcatattgttagccgattggtttctattggattatattgttgtattgttacattattatcagccgattgtctatgtatcattatttactcaagtatcagatcccacattggacgtatagccaatagctcaaaaccttatcgctatcggctagtatcggcatcgaccggaactactccagcggcttgtcagctgatcggctatttgatctactatttatatatcttgtcagttgtaggatcaaactgactagcatgcccgcatgccatcatgttttggacctgcactagagctaagcagatctctcaggccattgtgttcatcaacttagttcgtgccaacacagttccggcaccatcggctgagcgcggatttctcgtcagcagccccccaattccgttgtatattatataatgcggcggattttgctcttctcgaacccgcatcaatctaggggtttctgttttgactgtagaggccactactttgaaatcccctttttccggctaagtctttcatacgtgctccatcgcaaaaactctttcgtctccgacgactccactggtgatccagtccctcggcggcgagctcctttccaacgctctcgcgctctaaaaacacgctaccgacgctagtgtcgcgctaccaaagtgcgataccgatgagcccactcccgtccatgcctctctctttctccctaatcgcaaaacccatcgccacgtggcactctcgctcgataaaatagcgataccgccattggtgtcgctaatccaaaaagcgatgtcgccagctcaaatgcttcacttttctttctcgcaagattgtcgggctaacgtcattgtcttgctgattggtactgcgatggcatggcggtatcgcataatccggttgcgaactgggtatcgcgcttcctaaccgcgattttggaaaaaaaattatatattttcaattttttctcgcaccaatccccaaatccgctggcgctcgcatcgcacgttcgctccggtccgcacgcgagtaaggctgtgtttgggaggaaggttcctcccaacatggaaagcaaagcatgcgattatagtgagatcaattaagtatttgcctaaaaaacttgaaaaatggattaatatgattttttaaagcaactttgatatagaaaacttttgcaaaaaatataccgttcagcagtttggtcaggtctatataaaaacgtagtattattttaacacaaaacaaacatattttcgacgtttgatgtcacgaccacggtatttgcatagtatggggatcgttggtactaggatatttgcgagatagaggtaaaagagatggagacgaggattttcatacagattcgggcccctgaattgccaggtaataaccctactcctgttggccgaagccggtcgttgctcttattcaccataatcacaccaatacaatatttggggtagcctatctaactgttgtcgacttggcggtctgaagtgctgactcgtagtcgacaacagggtagccttccttctcgaatccgcatccagcaagatcaaagacagcgctatgtctctcctatcagtatccctagacaccgtaagggactagccatgcttatctctgaagtcgatatccggcgtcttgtcttggcgtatgttggcttgtatgttgatcttgtgtcttgatctattgttccatcccccctctcctcctagagggtcttgtatttatacccataggtgtttccttttccaagtagaactagggaaaccaatatggatacaatctgagtaatccttgtcgtttccatatagaactctatttatctttccttatctggaactccttctatacccgaaggttgttttcgtatgaaacatggtatgtggtgggtcgtgccgagatttagtcaactactattaggtatgtggtatccataaccctgacagtagcccccgactttaatgcaaatgaacgagtacatattctcaatccgaagacctcgtaataactgttgtcgaggtcacgtgaccgttctcggtgagttcagagataacgctagacttcccttataagccttgtgcaggcaccgtatagggtttgtctgagtcaatctccgacgtcaactaagaaggtacagagcatacgactaagtttcctgtcttgctgtaatcgagaatttggattgaagtcaagaaattttatctcggcgggtacaccatcttttcattccgtattccttgttgagatccaccagccgttctcaaatggtcgagaaggcgcaaagtctgcgacgaaaccttgtcaacatttgtcatactcgccttagtcgatcttggtgtagaacaatagagacatggagtcttcgacaatgtcgaatagaattttcatgaaatcaacactcagaaaagaatattagatagaaatggcccccgagcaaatgctcaaagggtgacatgttataatatgtatggaaaactaaaaatgaattaaatttacaaaccaatgttttgtgtacgagcgtcttctcttttaccgacttcgatcagtcagtttgttgagtcatacactctccctagcccccagccttgtcatcggagataagttctcagaggagaaggctcttggacccttgacctgccttggttgaaaaaacgcttaccctagcccccagccgtgaagttggaaaacccaattttcgattacacggcttggttaatatgcacggtgagaactcttacatgaccggatcttacatggtcattcgtctctgcattacctgacaaggccttatctgctctgggcgtccctagccgaagttcccttaggttcctcagaggccttgccagggcggcgtaaagggacagtaggattagttttaactctaggtgtcgtcgtggtaagggatctctgggtaaaacacttggcgatattgtgtacctgatatcaactttgttggagtagagataatgagaggatcgctacaccgctggtcgaaaaccagttgtagccccaactcaaccacttgaagtaaaggtagtgggagaatcgctacaccactggtcgaggaccatgtagtagtcgaaactcaaccactagaagtggatgtagtgggaggaattgctacaccgctgatagagaaccaggtgtagccttaagaaatagaggtagtgggagtatcgctacacctctggtcgagaaccaggtgtagccttaactcgaccacaagaagtaaagctagtgggagtatcgctacaccgcttggtcgaaaaccaggtgtagccttacctcaaccatgagaagtaaagctagtgggagtatcgctacaccgctagtcgaaaaccaggtgtagccttaactcgaccactagaagtagaggtgcgagagatcgctacagcctactagtccgagaaccaggagtagcctcatgtctcggccgattgatgtcgaggtatgagagatcgctatggcctattggtccgagaaccaggagtagccttatctctcgaccgattgaagtcgtggagcgaggaccactacgctgctggtcgaagaccagctgtagtcgtacctcgaccatctgaagtcgtggtgcgaggaccactacgctgttggtcaaagaccagtcgtagtcgtacctcgaccatctgaagttaaggtggggcgctagagttggtttattacatgtgcatctcatctggccagcatgactcacatacccaacttgtagcatatccggatgtccgtccacaatcatgtcgggtgatcaagccgacatcgtttgcgagtaattatccgttaacaacccttttctcaaatagcccagtcatagccggtgctatgagataggtcgtcggtcttcgttggtaggttggctgcgacaaatctgcatttgtctagaacgttctcgataatggggagtgctcgaccacaacctaatcgagtgctcaattgttcctgaaaagtatttttctagaaggcaaggcatatagcagagaatatcgagtatgtactcaaaaaacttcatggatcttctagtattatcagaatataacgagcagatgtaaatatcaggcattatgtaaaccgtaaacaagcatgattcatacagaagagaacagagcgagtccccagcgttagaccgtagttggcctaacatcggaaacactcgcacaatagatattgtataaataacatgctctaggtaaacataataaattatagatctgacaatgctgtatgatctgaataggtacgataaattgcatataaaatattgcatacatttgtagatacatgtcagatgtatctacgaaattagtagattaatttaaaaaaccaatccaccaattaccttactgcgtactcgtttgatatcatatgatctgacgtcttttggtacgacgcgtatcttgaggcttggatgatctcgataaaccaaattgttgacaatgatggttccgatcttgtcgaggcacgtactctggttagattaaacttcccagatccaaagtagttgaagtagccctcgtcaaaaaatctatagtgacgatgacttggtgaagcttgacgaagatcccgatccgtcggagaacatacttcgttcgggtcatatcacccaacatacgaagtcgctgagtagtttattgttgaagaatccatctcttgaacccatctcgtcgaaatcctgaagcaccaaaatcccctacctggcacgccactgtcgacgtttgatgtcacgtctacggtatttgtataatatggggatcgttggtactaggatatatgtgagattgaggtaaaagagatggggacgatgatttttatacaggttcggttccctgaattgtcaggtaattaataaccctactcctgttggccgaagccggtcgttgctcttattcaccataatcacaccagtataatatttggagtagcctatctaactgttgtcgacttggcggtctgaagtgttgactcgtagtcaacaacagggtagccttcctcctcgattccgcatccggcaaaatcaaagatagcgctatgtctctcctatcagtatccgtagacaccataggggactagccatgcttatctctgaagtcgatatccgacgtcctgtcttggcgtatgttggcttgtatgttgatcttgtgtcttcatctattgttccgtcccccctctcctcctagggggtcttgtatttatacccatagtgttcccttttccaagtagattagggaaaccaatatagatacaatccgagtaatccttgtcgtttccatatataactctatttatctttccttatcggaactccttctgtaccacaaggttgtttccgtataaaacatggtatgtggtgggtcctgccgagatttagtcaactattattaggtatgtggtatccataaccctgacacatatcattaaaaatatattcaatgttagatttaatgaaaacaatttaatattttagatgttgctaaatttttttataaatttaatcaaactcaataaagtttgaaaacaaatcaaacgactagtaatacgtccagtaaaaaaaaaagactagtaatacgaaacaaagaaagagtagtaaaatttctccgttactactcgatgtgttgatcccattcaggagttaccaactaggctattaatacgacgagtgataaggcagaacaaattaagcaggcagacctgcaaagtagcaagccagcgctcgcacctccgattccgacactgcctcggtcgcgcaccacccccgactccgactccgactcctatccggcgatgagtaattaagctatatattcaatatggcggaggaggagtcttccacgtcgacggaggactagacgagcagcatcctccggcgaagaagatgtggctgttgccgcaggaggaggtggaccggatcctcgccgagtccaacgagaccgtctgcaccgtgtaccgggagctgaagcgcgccaacccgtcgctggtgccctcgccggaggaggagaaggacgagtccaccatgctcctctacacctgcgcccgcaacgcctacgaggatgatgccaagttcgccaagttccaggcttgggtctgcgacgagtacgctcgaaaaggattcgtggaggtggactacgactacttcggtgagagggcagaggtgttcaggctctacgatgaagcacgggaggaggtgatgggacactgggatcatccttcagatagcgacgatgacgacgaagactggaagcttttcattagggcaattaggaggaccttcgtctgaatcgaatctcaaacccatcatcacagtttctctaatcttattatttgtattgtaagaacaattcaatgtacggatgcaacagtttacctctgtatgatatctattcacagaaatttaagtgtgttgtgctgatcgacatcattttttgattgttagttattggtttacacgcttgtgcgctctgttgttggtgttcagcctttttttccttttgttgctagaagcctcgtacaattcagagctatgtaaaagcaaaagtccaatctttgactaatcgttgttaaggctgtgaatgggattaggactgatgggattaagcattttttccaaattgtgctgttcttcaacctgaattttgtaagcagagcgagctgaatatgtcaccgagcagatatattcagtagtgtcttcagctgttagcgattgcatcatgaatggttttcttgcggtaacagatgaacaaaatttatttttgccttctgtacatgctacccagccaatctttgaattaaatctcaaattacttgcctcttgcttccgtatagcaagaatcctctgtatttatgtgcttatgatgtgatagatataactgcattgacaggagaattaggagtcatttggttttgtatatatgatttctgacaaaaataaaaactctctgtttgtatcctaaatttggacccgtttatctgcacagtattttttgcatttttcttctcactgcgaggatgacgaagattggaagcttatcaagaggagagcaggacctgggtgtatagatgagattttggggctcaaaatttttgtgcttcggattctttctatcaatggcaattccgggctgatgtatattcgtttagtgcagcagatatgcgtcggccaattttaaagactgcatgtgtttctgaagttttccgaatattgatttttggagacatttttgtttgtgtgtgtggttgctgaaaatctatctgttgttgtcgccaagaagatactgcattaacaaaatgtatatggaggatcagaattatatacagaatcaccttttgcattgccataatagctgagaaccgtttttcattaatatgcaatgtttgcattaggtacatgaacatcgtactagaaacttgcacaacaacatcgagtctatattgatattgtgtatgtcatcttcaggaaatgagcggtctgacaatgacgacttagcattctctatccattgctttgtttatctcatcttgtcgagttaagacttacctctatatatgtgtcttggcttgatcattgacaaaagtgagaaattcttagtacaaagatctagtgctaatttttcttgttgctaaagctctaaagcatgaggattatatatggagataacataaactgaaagtgaacctcccgtacttcataaatacatggattagatttgcaccgcccaaaccttggcaacagacgtatgcaaattaattctgcgaattatatctatatttctgcctgacactgctgcaaatctgaaaatctctgaatctcacgtccgaatcccactaacgatgaggagctccatttttgtctcagggcagaagatggtttgtctactttaacagccctgtggtcattaagctttgctgatggtaactttggttggaagagttacttttcttggaaaatttgatactatttggcttccattccatgtttcttaacaaaagaaaaaattagttatgattggagataacctttttgatatcttattcttcatccagagatgtacaaagttaggaaatgatagttacttgactttgcaaaaggcattctgctccgagctatataggagcaagttcattgcattttaagttacttgaactcttaagactgcatcatgttcttgtgaacactcagtacaccattgctctgttttttctttttccagccggttctctgtttccattcatgttgttttacctttaggctgtgtttgttagaacaaattcccatccggaacagtaatcacggaaaatggagtggtccattagcgcatggttaattaagtatttgctatcttttttcaaaaatagattaatttgatttttttagcaaatttcgtatagtaactttttgcaaaacacacaccgtatagcagtttaaaagcgtgcgcgctaaaaatgagggagaggggttgagaaaaggggcatccgaacacagcctcctaattaacattttgactcatccatttttacaaattcatcagcgacagaaggcagatttgcctcaccaaactctggcctcctaataaacaaactcacaaggataccatcccagatctccagtagataaatataattaactctgataaatggtagccctaaatatacatacccctttgagaatatttgcttcttactgggagtgactgtaaagtgttctttttcctgttctcatttgtacgaatcaataaaatcagacattagaggttttataatttcattagaggaagctgaatacctagctttaatttgctcgaatcctaccccaaatttaattaaacctaaacattagactcctatagattggttggacaacttaaaaagaaagttctcgtggagcaatgtagatcttgggtgtcgatagttttgtctgcgagaactaatttcctgagttacttccaacattgttatgttgttgcaaaactttggtcgattgtactgaatattatgaatattattattgtggtgatacatcatgatagttcacggattagagacgatctcctgtaggccttgggccagtctccaagggttgaattaattttcatcatggtgataattttggcaaaaattaggctgggcctgcccgtaagagggatcagaaaagttgggtgatagtacttcctccatcccaaaatgtttgacgccattgatttttttaaaaatgtttgaccgttcgtcttatttaaaaaattaagtaattattaattcttttcctatcatttgatttattgttaaatatacttttatgtatacatatagttttatatatttcacaaaagtttttgaataagacgaacagtcaaacatgtttaaaaaatcaacggcgttaaacatttagggaaggagggagtatttaatctaccgatccaacatagataaagtagatggcactacttatgattcattcatttgatgaatctactgtagtaattaactgatcaatgagggcactgtacacaggaaagatctactgtgaagaaattgaggattttcgtcaaaaaaaaaaaacaaatccatcagttccctgctagattctcgatacttggaatgccaacttcggttttttcgttcatccacatctaggcgaactcccgcgcaccacaagaatccgtaattttaagacttggtgggttttccttggcaatcggttgacagaataattaatcttaacgattagcccaaggaaatcgtaatattcctaactttctaaatttggtagtatttacttgacggatgctatacttggtagtttttgaccgccaaaaaaattgcagattcttatagtggcgccagcacaaggtatcatgtacattgggtgttgatcgaataaccgggaggagcggacgagagaatgattctgttggtagttttttaaagcggcccacctttttatttagaaatatcaatatatatgggcttttttttcgagagattgatattttcatgccttaaatactcattagagatttccataacagggtttaggggatcaaattttggatgtttgttggccatgctctaagtgaagtagtagtaaaatacaatatatggaggaatatataatcctattggaagagatcacccagtttttagtggtttaatttgattctgaaaccaaatagcccgtatattcctcctggttattaaacacaaaaaatatttgtccagcggtcaaaacatgttttcgcagaggcaaaaccttccgcctgtatccaaatgacgctaaaaatccccaaattttgcaagcggaccaacgattttcgtaggcggcagttcgaatcttcgcaggcgctgtaggtgctacagtagccccgcctgcaaaaatattgtcggtccctagggtttcaaatcacaaatcacaaatcctcacaaatctcatccaagaaacaaaatccaatcacagatagtgtaaagttgcaacacaaaagtattggattcaaatccacagcaagttaacaacaatgaacaatatgtaaacttaaaagaagacatcgtcgccggtgaactcctccgttgcatggggtggccgccgccgccacagcctcctcccccctccgtccggatctgggaggggtgggttggggtagcaagcccacacagccgccgccgacacgtacccctcccctccgccagatctgaaaggggaggggtcgaggggaggggcacccacgtgcccagtgggttgtcatcgtcttcgcgtggtagtcgtcgtaggccccgtcgcgacccccctctgcccgcgcccctccgaccctctccgcccgtgccatcaccaccgccctccgcccgcgccgccgttgcccccccccgcccgcgccgtcaccaccgccctcagcccgcccccccgccttcccacttggcccgccccaccgcgggcccccttcgccggccccctccggccaagcctctgccaaaggccttccgccggcgcccccccgaacgccctcccccgaaagaaggggagggaaggaaagaaagggaagggaagggaagggagcccagatgaagagagagagagggggaggggaatgagtggtggggagaggataagatggaagagaagatatgataggggacttagtttattttatgtaggtatgatttttgcaggcggaccacataagctaccttctgcaaaaattcaaaaatcatatttttttcagacggaccacttaagaggtccgcatataaaaataaaggtattttcgtaggcggacctcttaagtggtccgcctggaaaaattaatttccgcaggcggatgatgaaaattcacctcggtttatattttcgtaggcggatatttggctctgggtgtcatatccacctgcgaaaataaagatccaacgttggcgaaaatgctttttctagtagtgaaatatgtgacgctgcagctagttaataatgccaagtgatacttaatgatcgatacaaatacgagactgtgatactttatatactgtggaaactgatttaccgctcggggcaagcaacatacagtcatcaaaagttggcgcatacatggatcacatgcacgagacaattaacaacgattaatattgatacgtttacatatcttgtcgcaagcttttggcgtttatcgatagatagacatatataaatttctttctctggccaaaaatcttgggcttcaattgattggttgataatgctgaagacttggcaatcagatcgattggagtccaatttgcagatcaacttggcataatatattaatttgatttcgtgcaatgatcgattagcgttggggtgcacgttgaacctggatatatataatactggcaatatgtgcctaaaaataagggtgagtgtgcctcacgtggaccctgtaaaataatgtgctgattgtctaacacaatatatataggtactgaatttggttcattgaatgatgataagataactatttctacaacatttactaaactatttagggccctttgaatcaaagaatttgtagaagaatttcataggattgaaatcctataggaatttttcttatttggcccttttgattcaaaggattggagttttccaaataataaacaattcatatgaaatggctcattgtatataggttttggaggaaatttagcaagatgtccaacttcttcgaaagttcttttgagtttagctttctcatctgattcttgcatttttactgtggcccaatcaaacgatcatttctgtgttttttctgtgttttgcaattctctattttacacatcattttattagaatcctatattatattttttctagtcctctatttttgtattcctactatccaaagatgaacaggcgcgtccaccggcttcggtagtactggttcaaccagaatcagcatcactatcagtttaagctacgaactgacagtcatacacagtaacatcaattctagttcaattcctctaatctctaccgattgcaataggactgtttgattcagactttcgctagcactactaaaaaaccaataataggggacaacctcatatgtaccggttcatccaat

SEQ ID NO: 76225 - DNA, 2525 bp, Oryza sativa
tatttggtgtaatattttatgatttttgtatgaataaagatatcttataattattgtatgactgtcattattgtaagaataattatttgtgtacggtttttttgactcatgtagatggatcggcaatggatgtaccgctgacccggggcggggttccctccaaagagtttattgacggcgtgcactatttttgagagaggccgaagctaacaggcaaaggggttttatttgttgtccatgcaataagtgtaagaatcagaaggagtattctgcatccaggactattcatttccacttgtttgagtcggggttcatgccaagctataattgttggacatcccaccgagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccgggggaaaacaaattgtccgagacaacgtacgaggctaagaagatagtctgcccattaggactggaagttcataagaatcacgcatgtccgaacgattgtatcctatatcgcggtgaggagtatgagaacctagaagcatgccctgtttgcaaagcactacgatacaagattagacgggacaatccagaagaagttgacgggcagctaacaaagaagagaattcctgctaaggtgatgtggtatttccctataataccacggctaaagcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctattcggacagtccaacaaggggtacaaggcttgcactcactgtatggatgaaacagaaagtacgtatcttaagcactgtaggaaggttgtatacatgggtcatcgtcgaatccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattaggaattcttggacgtacgccacgcaatcgacgtgatgcacctcactaagaacctttacgtaaaccttcttggcttcctaggtgtatacggaaagtcgaaagatacactggaagcacgtaatgatctgaagcatatggaaccaaaggagaaaggaagccattacttgagtccagccagctacactcttagcaaggcagagaaggaaagtatgtttgaatgcttggagagcataaaggtaccgtctggatattccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgggcattcatgaacgcaatttcgcagaaggtcatcgatccggatagattagaagcccttcagaatgaagtggtgcaatgtctcgtcagttttgagttgatatttccaccttcattttttaatataatgacgcatctgctttgtcaccttgtgaaagagatccgtattctcgggcctatgtacctacacaacatgttttctttcgagaggtacatgggcgttctgaacaagtatgttcgtaaccgtgctcgtccagaggcaagcatcgccaagggttatggaacaaaggaggtcatcgaattttgcgtagaatttatcgaagaccttcgcccaatcgggagac

SEQ ID NO: 76226 - DNA, 1596 bp, Oryza sativa
agttcgcgccaggaacatcggtaagtccgatgcatggattacacggcatcacattgatactttccccgcgtggctacgacaacatctcatgggtaacgagtcgatcaaccaacaacttgccttcctggcgaggggaccatctgggtcgatcgcgacattccagggatatgagatcaatgggtacacattctacacgagagcccaagacatgaagagcacgaaccaaaacagcgctattcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgatttatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttatcacagacaaaaataatttttcgaggtaattgtcattaatctttgtactttaaataatgttaatgcattaacttctattttataaacacatatgtaagtgaaaatcatatgcagtgctataatctttagtcccggt

SEQ ID NO: 76227 - DNA, 1013 bp, Oryza sativa
ttaagtagatgcaaataaaataagaaagttattagtacatgattaattaaattaaattatcataaatttgataaatggatatatttgatattttaaagcaactcctgtataaaaaattttcgcacggaaaacaccatttagtagtttgaaaaacgtgctaattgaaattggggtaaaatccgaatcttaataagaaaagaatattgtttaaatatagataaaataattgaaaccatcaatgatgaccagtattgcatactgacgtaatcacatgcatttatattttacatgaaccgtcgaggtaccggttgtattcacgtcgtgttcatcgtcagaactcgccgttgtagtttctctctctatcgggaccacgtcattatcggtcacgttcttgctgttatgattttcttcgttgccaatatccatcatctatggacgagtcacatcgtgggacacatcctaccatcttacttactattattggttcaccgaagcaccagcatccatcttcccttctttttgtttctcgcttttggctaggaaagacgatgaacaatgcctgttgggtgctattgcttctttgtccaacctaaccatgctcctgaatcactcacataatattgaaaccatagtaatatgaatataataggaaaattctaatttatgttaatgaaacgggcacccgttcggaattaatggatcaaattttcatctatgagttaaagtgagctttttcaattgctagctaatttcatttgttttttcatttacaattttagttttagcactatttgatccactaaaaattatttttaacttataatttttctctgtattgaattatttatagctaaatgaaaaaaggggatttagttatataattgttttaatattaaattatcattccgaccaaacttatttgtggtttcatgtcgttatttttttattatatttctttcatcatttatgccgaattatgatatatgattttaatttatgtcaatgaaagttat

SEQ ID NO: 76228 - DNA, 630 bp, Oryza sativa
gtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggt

SEQ ID NO: 76229 - DNA, 1002 bp, Oryza sativa
agctcgggctcgtgcagagagagcggaagaaggcgcgatgggctcgggaaagagggggaaacgtaagaggagagcacggggagggtttatataggctcgggagggtgaaatcgtggccaagaggggcgggatcggacggcaaccggccggtgacgtgggactcaacgtgggcggagtggggactcgatttggcgccaaaaattggggaaaagtgggggaaaatgtggaggagttggaggggaactggtttcactcggtttgggtgtgagggtgcgagcgggagggcgctggatttggcgggacgtgggcagcaaccgccggccatgtcggcttcggcattggaagccgaaggtaggagaagggcctgacaggtggggtcgccgagcctacctgtcggggagggagagagggaggagaacccaggggggttatttagattttgcgcgaggggaaggaagatgggtcgacggcccaaggaggaaggaaggaagaagggaggggacgggccgcggggagggaaggagggctttgggccggaagtggcccaaagtgaaggagggtagatttaattgtttttctttttattaaattggttaaataaactttgtgctattcaaattattactcgagctccgaaaattaatggaaaatttcacagagtattttagggcacagagaatattacaaaatatttccggccaatgatttttaaagtaaaattttatttctcccagtatttcacttgattaaattgctttaacttttatttagtttctagaaaatgcattatttaatgatttttaatttcccgaacaaaaatcggggcgttacaccgccccagtgcgttgccgtccgccgcccgccgaccgttcacgcgcgctgtcgtcacccgccgcccggtccgctgacaccagtcgaccgggcgccttcaacttcaccggcacaatcggtccgtcaagcgcgtgcccaagttgggcattcttgacgtacccaccttcacat

SEQ ID NO: 76230 - DNA, 10578 bp, Oryza sativa
  unsure (1)..(10578): unsure at all n locations
attggaggatgaagttgcaaaccttttaggcacctccgatttgtatgtaatcaccaaaataaattcaatagaaattttggcatgacctcccctcttttttgaagaaattttgaagcttgctcgggcagctggaggaggaaaaagacatatatataggggtgggactttagtcccggttggtagcaccaaccagggctaaagatcaccgagatctttagtcccggttggtgttaccaaccgggactaaagatcccgggggggcctgataggccctgacagcattcgaaccgggactaaagatcggttggtaacacaaaccgggactaaagatcaaatatgtccgttacccttttgaaccgggactaaagatcatctttagccccggtttttattgcatccgggactattgtggaaatcggccgaccgacgaaagatggtttctccaccagtcctatgatatcatataagtataggtgtattacaaaaccaacactaataatataattacaagattttctaataatcgatacttttatacaagaaaagtgctggtttttctaataaatcagcacatttgctgagccgtaccagcatgcagttgagcgtggagtgggagattgaggacaaaaatccttcaagtatcgtaattctcattgctctcggccttataatctcacatctcatcatctctcatctcccaacccgatcccggccggccgtctctcccagcaaggcaagggtgcgttcgcctcctcttcccccagccggcgagcggcaggactgcctcctttattcaccctgttcactccgtttctcctcatccactacatctcccttatgcaactctccctcttccctcctcttcgcaccactcaagctgacactaggccacgggcaatggccactttctccctagtgtgacggtcactggatccgtccacatagcgcatagtgaccacgagatccagccaactagagcctggcctggagctcaacctccctctcctctcgatatagttgtagtcacgatgatgcatcgagtcagatttttctgattcgtgacctaaaaggtgccagtttatgaaccgtgtcatcgatgattcttcccatcaggctggaatggggtggcttggtaatccggcacctatacgaggtttcgaattgacactcattgggtgttctgtactagtatattttgttaattagcgctatatttctgattacgatttggtctaaacaattaactattgctaatgtgaggtatatatctgactgtgtaggggatttaaatacaagaaacanacacatcagaatggggtggtaggaagtcattaggaacacaaaaaccaaattatttttttgaaataaatataacacaaatagaactaacctgataaaattgagtctaacgaacgttgtaattaagtccggtttaaccggacgtataccatgtctgctggtgtgcctctgttctgaccgctgatagatctttggtctaattggaaaaaatggacaaacataactctttacaagatgatcaacaatattgcatcaaggtgagttcataatacctctaaaccgcctctccaccttgatgtattataaacagatattgagacaaattcttttattaaatggcacatcacggaccttgcacgtaattatactcaatatatatttgtccataaatataaagtattttaggttatttaataaaattttaaggtgaagggtgaaattattctgttgtctcaaaaataagttgattggaaattaaagaacagtctagcgatgtactgctccctccgtcctataatataagggattttatgtccaaatttattatattaggatgtgtcacatccatccaaaatcccttatattataggacggagggaatactaactactactctctccgtcccaaaataaacgcagtcatgaatttccgtgcacaactttaatattccatcttatttaaatttttttaaaaaataaaaacataactattcatgttttataatctaataataataatatgctaattatagaaaaattttaaataagacgggctacgtttattttagacgcatggagtacagggaacgcaacaaataatgtcgttgaatgcatggatgagatcagatcgatcacgtgcaggtacatgcatacagtatgtatttcacgtgggtatacgcatgtgtcagaaaactattgcatcgaaccaaacgcttagttatatacgccctcggaatttgatgcagcgaattatccaccctgtacatttgttcacgaatgctggtgcgaattgaatgcatgtgtatcacaattaattcacagacctgcgggtctctcttgtactacatccgtactaaaatatagtaatttttagctatatatctaaatttatagttaaaaatatttacgtttgagacggaggaagtagtcttaaaaaaaattagtgatcggccgttgcacacttgtacagctgactacagtggctgtccgccatgcttgtacccaatatttttatgtttataacaaatttttgtattgttcttttcaggccggtactacaactaccaaaaaggtcaaccgtatggtgctggtgcaaacaatgtggagatttttacccgtgtgccattaaaaaacatgatgcctgcctctgtgccactaaaaagttcgagcctctctctatgccatcggcaaactttatcgcgccctccacaccattcagtcctttttagtcctaacggtgtcaaacagcgcaaccaaatgactttgttgcccttagacttgagagcccatttggtgaagtttgttttcttctgtgccattcggagggcagccattcgggctcaggggcgcggccggtgcagcggcgaggctaggtgcggccgtcgcggtgaaggagcagatcgcgcggccgtcatggtgaaggagcgcattgcacgggccttgcggctgtacaagaagncgcggcgcggtgncgncaacggtggcgggtgaatggtccaggtgtgggcgccggtgagggacggcgcccggcgcgtgctcgccacgcgggggcagccgttcgtcctggcgtcgcagtgccaccgcctgttccagtacaggaccgtctccctcacgcgcgtcttccccgtcggtggcgccgccgccgccgacaagcaggggcttcccgccagggcgttcgacacggggacgccggagtggacgcccaacgtgcagtgctacggcagcggcgagtacgcccgcattagctacgcgctcatctacgacatccagggcagcctcttcctccctatccttgaccccgacgacgcgagctcccccctcgccgtgcatgagctcgtcagcaccgtgctgcggctccgcggctccggagaggtcgccaacctctgcaacactcttgaggcaatctctctctcgctctctcgatctatctgcaactaagatcaagaaataattagctacagcaattagcaggagtgattagattagtgaactgattaacatttcttgtgttcactgagaggtgcagggattactcgccgtgaaccagatagtgaatccagatgagacccgggcggccatggccgaggtatcgtagctcctaaccatggtgtgtgtctgtgtgaagctcacaagctgccattggcacgcaaacatgggtgagatgcaggagcggcggaaacgacacggagaaggccgcgctgacgaccgccggcgcaccgttccacctcgccgccgccgccgccgggcaaaggaggtggtcgggcgccagttggaggggtggccggtggcgctgtccgctcggctcggcggagacggcggtgacgaggaaaggggagggcggcgtggcggcgcgggcgtccagcaactcggccacgctcggctgggtgttggctgggagtgacgcggacacggatgccgcggagataggggaatcgagagagaagagagagtgaaagggcaagagcgacatttttcctgctcgagcccacatgccagagctactaaacagttaaaaccaaacagaatagtgacggaatggtgtgaagggcgcgataaagttcgacgatggcataaagggaggttcgaactttttagtggcacagaggcaggcaccatcttttttaatggcacacagggaaaaacctcaacaatgtgtgtatgcgatgtttggatgcgccatactttaccacaattaaaataaaggcagttgtgatcggtacaaaagtgcggtgttgttaatgtaaattatatcgtgacacatgaagacacgagagatctacttagtttcagtgtagatcctatcaattgggattagagcgtgctagacagttagtttgatactacaactgacaagatagataaattgatgataaaaaaaccgaccgaccaataagccgatgtagtgatactagtcgatgttgatagggttttgaacaaacggctatatatccaatatagattctgacactttgataaagacaatggaagcacttgaacaaacaattcaatcggccgatgataatatgatgaagtagatgtcttatgaaccaatcgaccgatattgatatataatattaaatgtaagctctatggttaaagcataaatcagttggaagtccgatgtaaaaataagttatcggttaatactccgataaaacgcagcacaaataatatataaacttagcaagacttagattgttagtagtgacctaaccgcgagacagttctaaattgcgtctgatcaaacaatcttggtaagttgatagatcatctatgctaacgtgatagatataacaaatctatttaaaacaaatcgactaaggctgaagatcggacctaatcgagacaatcctaactaaaccggtatgtctctaaacaacacagtgcaattaaatatgtaattgaaacatcacgtagacaaatataccaatcaaaccagattaatctaagaaattgaagtgatgtagccttgaacaacactaaaatagcttatacaattgctagggccaaccgaacttagggcttacgccttcatgggagatcgaagcaatgcagccccgcgtcaggtgccagtttcgtcggtgataaaacctcaaaaaagagggcggcaatgttctataaatcttattgatcgagagataatttataataaccacgagtgtatgtaattatagccataggtagacactagtactctctccgtccctaaatatttgacgccgttgattttttaaacatgtttgaccgttcgtcttttttaaaaaaattaaagtaattattaattcttttcttatcatttgattcattaaatatacttttatgtatacatatagttttacatatttcacaaaagtttttaataagacgaacggtcaaacttgtttagaaaaatcaatagcgtcaaatatttagggacggagggagtccttcttagacacaacacaaacattcctaaagataaagtaaaagacacgagccttgatcggactctaaacaatctctcctaaaaataaaaagaaaactaacagacgttgccaaattaatagataaattaccatgcctcgtccttcttaaactcgacctcttctggataaacttcctttaattaattaattttcttaactgaatacactaataattcgattgctggcagatgatatttttcataggtcaattttagaactctgtggtcgatactgtctaggtcgataacgacttcgggtttaccaaattttaacgttaacatgtgcacaatagaaaagttagaaaacaattgcctctatgggcatgtacagtagagtcgctgcagcatggtcatgttttctcttgtaaactggtactgtgctgtagcagcaatatctgccgaataaaccttacaataacatgctttctagatttattaacattaatataaatatgaaaaatactaaaatgacttatatgtgaaacagagggagtaataaattacggccgtgtaccaaatttaatttgttggagcattaatttgtttacgtaggattaggaagtactagctatagataaaaaaaaccctgaattattggagcatctccgattttccatgcatgaatgcatgacgacattcttgcttgtcctctagctaaaaataattttagttcccaccctaaaatttttcatcctatcacatcgaacatttgaacatctacatgaagtattaaatatagactaaaaaaactaattgtataaattgcgactaatttgcgagacgaatcttttaagcctaattgctccatgatttgacaatgtcgtgctacagcaaatattaattaggcttaataaattcgtctcgcggtttaccaacggattctgtaattagttttcttataaatgcccgaacactccatgcgacaccctatgtaataaccgatgtgacacgtcaaaactttacacccctgaatctaaacagcccctaattctatcatcaccagtgtattcccttcatcaaactatttataataaattattaaattaaacaatcgtgatccacgtgctgacaagtaggtcgcaccaaccacccagttatcctcttcttcaccgctataaaaccccatggcctcctcacacttccccccgcagcttgtttagcttaattagcagtagcacaaagcagcaatataatggcgacggcggcgaggctgctcctcctcctcttcctcacggcggcagccagcgcgtgggagatgaacatccggttgccgacggagatgctgaacggcggcgaggccgtggtggcgccgatcatccacgcgctgcggccgctgctgggctccggcgggcagctggcggcgcgcgccggcgtggcgtgcgacagctggaggctaggcgtggaggcacacaacgtgatcgggtggaagacggtgccggccaggtgcgagggctacgtcggccactacatgctcgggtggccactaccgccgtgactccgccgtcgtcatcgacgaggccatcgcctacgccgagagcctccagctctccggcaacggcaaggagatctgggtgttcgacatcgacgagacctccctctccaacctcccctactacgccaagcacggattcgggtacgtatactatacgtacacgtacacgtacacaccactttccttgcagtattacctatacatatatatcttgtattatacgtgtattgctgcaggtatatacgcctcatttcagttgggacttacaccgcgcgctgacttggttatacatttatctactggcaacttgctggcaagataatactactatatatgaaaaaaatatctaaaaatctagctgatgtgacataattaattaagtgtcaaaattatgatgaactatttaatgtgcatacaaatatacagtatgtgaacgtattattaaattgagaccggcctgcctagttcacaaattaatataggaaatactggggtattacaaaatgtgaagtcaaagatgaaaagtatatatcatccaattaatgaatataacacagtaaaacattctcaaaatagtaaaaaatagcaaggagatgcgcatctatatatgcttagcaagattccaccggacattccaagacctcgcaaagaactagataactttaagcattatattgattaagaggataaaaagaacactatgcacttgtccatgtggctatttttaggcaaaccactgaaacctttattagattcttcaatcaataatttattactagcctgtaggaagtcagaaccctaaaaaaacagattggaccagcagatcaggtaatgagtgatgcaaacatgcacaggctggcagacagtacattttgtcgggcttatattgtccagcagtcatataagtcagatccaaaattcgttctttcaaaaaaaagatccaaaatttaatcgttatacaaattatgggtggatttatggaccactgcatgatgagggcgttagttagatctttcactaattgttaattttttcaaatatgcacaaaagttggaactttattttgaattcctgtaagttctaaattaatgaagagtttcattaatgattttttactaacacccggcagagctacactgtacaatgatacgagcttccgcgaatacgtggcggaagggagcgcgccggcgctgccggagacgaggcggttgtaccggcggctgctccagctcggcgtcaagccggtgttcctgacgggccgcaccgaggaccaaaggaacatcaccgtcacaaacctccgccggcagggatactccgggtggatggagttgttgctcaagccagcagtgcacgccgccggcgagctccaggggtccgccgttgcatacaagtccggcgagcggcaaaagctggaggatgccggtttcaccatcctcggtaacattggtgaccaatggagtgacatcctcggtacaccggagggcgcccgcaccttcaagctgccggaccccatgtactacatcggctaggttgctgagtaacaagtccaatgaggcccagactccgtgtcacgtgcgtttcatctttgttttgtcttgaaatgcttctaagttacaataattttcgacgcgcgtctatctgtacttttccttgtgagattgatgagatttgtaatagcatgtacgtgtaagagcggtaaatctatctagctatgtactattgagcaagcttgtcgcgtgcgtatctttgtctaataattaagaaaaattgcaagatatctcaccaaatatcatccttagtttaagattttcctatatatataaaacgatttattccgaatacctgtcctttttcctacttatttaccttagattgaccccggcccattagatgtagttcacgccctatttttttttctttcttttgcaagtgttatatgacttagcacatctcttgatagacatgaccccaaacattcttttcaaaacaacagtcgcattgaactcatctttctcattttgaatttgtcgaaaaaccagctgccacggaagagtactcgtgactaccgtcgcccaatggcatactggccaccctaagtggggatgctacgatcgtgtaataagcctagcaaatatgggtgacgatcatggttcatcgtctatgagtatttatacgggcacatgataatatatatgaaagggaacgggcagatcgaggagtatacattatctaaaaatacagctgatgtgataattaattaattattgccaaagctagctaggatgaacgtgcatacaatatacaatatatgtgaacgtataattaaaatgaaaccggcaggcccagtgcatatatagaaataatacaagaagtactctgatattgcaaaatgtggagtctaacttgaaaaggtcgtccaattaatgaatattattaagaacgagataattccaggacctcacgaagaacgagataattaactttaaatatattgataaaacatactccattcttaaaaaaaaataacctagatggtaatatgatccatcctattacaataaatgtgaactaatctctcatatcttcacttaatttaggttaagtttttttttttgagggggatcacaaatgcatggtgtatgaggaaggaaaagatcataggttcattcatattatcgatcgagagcacgtgcagtacatttttagaaagatcactgctccctccgtcccattttaagtgcagtcataatgttccgtgtctaatttggatcgttcgtcttattaaaaaaaatttaaaaacataagtcaagcacgaagtactatttatgttttatcatcccataacaataaaaatgctaattataaaaaaaaattaaataagatggacgattaaagttagacacagaaacttatgattgcacttaaaatgggacggagggagtaataatcaagatttaattataagtggcctgtcagatgtcagacctaccttttaaaataccttttaaagaaaaaacgcattgcaccacatcaggcaataagtgatgcaaacatttcacatgctcgcagatggtacattttgtaggctagatgttgtccagctgtcatatgtagcaagtcatatccaaaatttaataatcgtggtcttgagaaaaaaaaacagaagaaacagagtcttttacaaagaaacagagcatatactaacaaccgatagaaaacaaatggaaaaagtatactttgactccctgaactatcgctcaagtatgattcatatcctccaaccataaaaccgggtatatcgactcctttaactattaaaactggtgcaaacaatatccctaggtggttttgactgatgtggcgcctacgtggcggttttgactgagtctttgtcctatacgtggacttgcatggcattagaataaaaaaaatatgtagaacccatatgtcattcacacaaaaaaaaaagtattgtgggacccactaacatatgggacccacatgtcatcctccctctcctttccttcttcctccccttctttctcccttatcccactctctccccctggcctttctcttcaccagagtggcggcggctgcggtgg

SEQ ID NO: 76231 - DNA, 4089 bp, Oryza sativa
tattttattggaaattagacttaatatgacattattgactacggaattggtgcgactcctagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggctgtgcgggataacgtgcctgtcagtacggtgtactggcgaagaacaagggcacgcggagatcataagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccagcaacagccaattggccggaacgatcgaagttctggtactatgctcacggtggaacgctcaacccagctgatggctcactagtcttcggcgatcagatacgagaggctgcgcgacgactaacagatgcagtggaagcctcctctcagggcacgttccgaccagacagagatagggacgagctgacactcgccctgcaaactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccctagccgaccattcctcctgcaatggtgagcccgtcaggaaaccgtagcagctgcgcctcaacggggcaggtaggatcacagagcatggacgccatgcaaacacaggacgaatcgacctgtcccattgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcttgcaccgtctcctcctcatgctccggcagcaccgtctccacctcaagctccagcatcgactcctcctcaggatcctgcaccaactcctcctcgtgctcctacacctactcccccacaagctcctcttccggcaccttcaaagtcaggggccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcttatagaccccagtgtcaggaacttctttaggggtatgcctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcagtaaaccgcttgtcaagcctgagctgctgcagtccctacccacacaaatgtacaagttccatcagctgtacatggagatgagcaccaccggtagagagatgatcggagcgacgatcagggacacggacttcttgcaaggagatgacattctctggatcaatttcaggggaatctacgaactataccagctggacgccctgacgtctctattatgagttgctggattttgtaagtatatcgttcagttagatttcttactatacgtctcctttaattaattaggtccttctatataagtagactatagaaaataatatactcccttttatcgttgtagaatggagattcaaagggcccgacggcgaagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactctcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcgacaaatggagagaaagacttaggcggaagttcaaatttcctgtgagtacacatcctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagtgagtactactacgtcgaaatcgta

SEQ ID NO: 76232 - DNA, 9005 bp, Oryza sativa
tcctggttatgtttaattttatcactagatcacctcacattgttcatgccatgattattgtcttaatattttagattaaaatatgccgatatatgactatatttccaacaatccaaaaacttgataggtcattttcggtagttagctttgctactgcactgaaaccacatgcttttgatggttctaattataagagatggaaagcaagtgcactactgtggttgacagcgatgtaatgtttctatgtttcacggggtaaacgaagtgaaccacctgtctctcctgaggagaaggttaagttcgaggctttggattgcctgttccgtggagcattgatcagtgtactcgctgacaatatagtggacgtgtatatgcacataccttcaaggaaggacatgtggaatgcacttgaggccaagttcggagtttccgacgccggcagcgagctgtatgtcatggagcagttctatgactacaagatggtcgatgaccgttctgtagtggaacaagctcatgagattcagatgctggctaaggagcttgagaacaacaagtgtgagttgccggacaagtttggggcgggtggcattattgccaaattgccaccttcttggtcagactttgccacttctctaaggcacaagagacaagagttccgtgtttctgatctcattggctctttgggtgttgaggagaaggcgagggcaaaggacaaccggggcaaaaaggttgagggaggttctagtgccaatatggtacagaagaagaacactcatgcatcccacaatagcaagaaagtcaagtctgatgtcaaacctaaggctagaaccaattttaagaagaaaggcaagggaaaggcaaagggagactgctttgtgtgtggcaagtctgggcattgggccgaggactgtcctgagcgcaaagacaggaagtctgccaacatggtcattagtgagggcggaggaacatcggggtacggtaaaattttacctacagttctctctgtttttcattcacctgattggtggattgatactggtgctaatattcatgtatgtgctgatatttccctgttttcttcttatcaggtcgggagaggttcctccttgttgatgggaaacgggtcacttgctaatattcatgtatgggttgttcatggtgttggtacggtcgatctgaagtttacttcgggaaagaccgtgcagctgaagaacgtgcagcatgtcccttcaataaagaagaatctagttagcggctctctactgtgtagagaaggttttagacttgtgtttgaatccaataaatgtgtcgtatctaaatatggaacttttattggaaaaggttatgacagcggaggcttgttccacttttctttggatgacatgcgtaataataataatgttgtgaaccatattagcgagaatgatgagtccaatgtgtggcattcgcgaccctgtcatgtgaattttggttgtatgacacgcttggctaacatgagtttaattccaaaattcactttggtcaaaggttccaagtgccatacttgtgttcaatcgaaacaacctcgcaagcctcacaaggcatctgaggcgagagatttggcacctctagaacttcttcattccaatctgtgcgaaatgaatggcgtgttgactaaagggggaaagaaatatttcatgacactgatagatgattgcactagattttgttatgtgtatctattgaaaacaaaggatgaagcattgcattattttaagacatataaagctaaggtagaaaaccaacttgaaaggaaaatcaaacggttgaggtctgatagaggtggagagtatttttccaatgagtttacatctttttgcgaagagtttggaattattcatgagaggacacctccctattcaccccaatcaaatggggtaaccgaaagaaagaaccgtactctaactgaaatggtgaatgccatgttagacactgcgagactttcccaggaatggtggggtgaggcagttttgactgcttgtcatgtcctaaataaaatcccaatgaagcataaggaagtaacaccattcgaggaatgggaaagaaagagattaaatctctcatacctacgaacatggggctgtttggccaaggtaaatgtacctatagccaaaaagcgtaaacttggaccgaatactgttgattgtgtgttccttggttatgctattcacagcgtgggttatagattcttagtagtaaactctgaagtacccgacatgcgagttggtacaattattgagtccagagatgctacattctttgagaatgaatttcccatgaaaaatacacctagcacttctaatcatgaaactgtcataccccataagcactttgcaccgatagaacacaatgatcaaacgcctgagggaaatcctgaggaggataatattgtagatactcgtaagagtaagagacaaagggttgcaaaatcctttggagatgactacattgtatacctcgtggatgacactccaagaaccatagaaaaggcatattcatctcctgacgctgactactggaaggaagcagtacgcagtgagatggactcaattatgtctattggtacttgggaagtcgttgagcgtccatatgggtgcaagcctgtaggatgcaaatgagttttctagaaaaagcttagacctgatggtacaattgaaaagtacaagacaaggcttgtggccagggttatacccaaaaagaaggcgaggatttttttcgacacctacttaccagttgcccgtttgatcacgattcgagtactacttgttcgagcagcctctcatggtcttctcgtccatcagatggacgttaagacagctttcctaaacggtgagctggaggaggagatctatatggatcaacaagacaggtatgtactagaaggtcaggtgggaatggtgtgtaaactgttgaaatccttgtatggccttaagcaagcacctaagcaatggcatgagaagtttgacaccacacttacatctactggctttgttgtgaacgaagctgacaaatgtgtgtactatcgctatggtgggggagaaggagtgatcttgtgtttatatgtcgatgacatattgatctttgggatcagcctcaatgtgattgaggaggtcaaggactttctgtccaagagctttgaaatgaaggatttgggagatgctgatgttattcttaacattaagctactgagaggagatgagggtgggattgcacaatcccactatgtggacaaagttttaagtcgctttggctatagtgactacaagccagctcctactccttatgatcccagcatgctattaaggaaaaaccgaagaatagcaagggatcaactgagatactcctaaatcattggttcattgatgtacttggctagtgcaacgaggcctgacatctcatttgctgtaagcaagctgagctggtttgtctcaaatccgggagatgatcattggtaggctctggaaagagtaatgcgctatctaaagggcactatgagctttggaattcactatactgggtacccaaaagtactggaagggtatagtgactcaaactggatatctgatgctaatgagataaaggccacaagtggatatgtgttcacacttggaggtggtgctgtttcctagaagtcttgcaagcagaccatcttaacgaggtcaacaatggaagcagaacttacagcactagatactgcgacagttgaggccgagtggcttcgtgaactcctgatggatttgccgatggttgaaaaaaccagtgccagccatcctaatgaactgtgataatcaaacagtgattattaaagtgaacagttcaaaggacaacatgaagtcatctaggtatataaaaaaagactgaaatctatcagaaagcagaaaaactccggagtgatagcattggactatgtccaaacggctaaaaatctggcagatcagtttaccaaggggctaccacgtaatgtgatagacagtgcatcgaggaaaatgggcttgatacccacctaaggttgcacaaaagtggaaacctgtccattttgatcggagatcccgtgaatttggatggcgaaacaatagtctattgtgtggctgagagaagagacccttgaaaagggctcattttcatgatgtacttctcttctattctgcatggtaggatggcttatgccttaatgtggtccaagtggcttttctaagcagagatgttgacttgcagagcatctcagaaggaacacacttatatgagttcgactgctagtcatagtctatgagatttgagcgatctctagatactcatgaaagggcctggagtttgacttatatgctccaaatagaggggatgcaaacggcagcccagtaccagtcaagggtttgactgaaacctgatcacacaagactgacaatttaaggcatagtccattattcaattatggtctgatgtagctcttttcctaggtggaagttcaacttaacagtctccaccaaaacactggtctgtcaaacaggttcaattttgagaacatttcttatgagccatgaaatttggtggggattgttagaataaatgggctaggcccgtttttctattaaaatctcaagggcccataataaatgttaaggataacaataccatcctgagaattaaaagtggagtatctgaacttaaatagggagttattggaggctccctattgaccggttgaggtggggatcggaaagccacacgcgcgcgcgcgctgagccgagcccgtggccgtgggcgaggcgtgcgttgcgactgcgactctctctctctctcattttgcaacggaccggaatccaaccccgcgtgattgcctctgtaatgggcaggcgattcaatacgcattgattgcgccattactgcggcaacgggcggattcctctcctgtgctattaggaaactgagaaccacgatcagatcttcacgctactttcctaacgccggttcttcgtccttgcgcctgtgctgcttctgctttccccgattctgatcgcttgcgcgcacgagagatcggaacgagcagggcctccggaaccacaccttcgcctgagatctacaccgggtaggcgggtgatcaggttttggggagtgtttccgcacgactgctcctcttcctcggttcgtcgtcccttcatctgcatcaccatgactggagctgtcgcacccgcacctggaggtggcgcacccagagctggcgcaccgatcgacaacaccaatggaggcagttctacctcacaatccagcggagggactttcacagggtataactttctaccgtgatctttgtgtttgttgcttctgttggtcgcaatactattgcgttctctccatgatgatgatgcttattctatcttaaacatgctcctagttatgtttaattttatcactagatcgcctcacattgttcatgccatgattattgtcttaatattttagataaaaatatgccgatatatgactatatttccaacaacaacctgttgatcgacagcaatctactcttcataatcagggttgctgacgacgacctctgtttctccttctttcttcctgatcagggcggctagggcttttgcagctccggtgaggtgaccttctagctttgcacctcttatagccgctagaacctgcgccttccatatggcgtggttggattttcctaatttctctgagctgaattggccgaccaggggattcccggcatggttcttcgaggagctcgccatggtacgacagggagagagctagattggatcttgctctgataccatgtgaataaaatagatgggaagcgttgaacccctctcggggccgcacctttgttaatataggcgagaatagccctcgccgtggcacttacaatctcaccgatcggttccagatcagttccaacaaacccggataatcaggaacacaatcggcatacattggataggaacgatatcacaagtgccaactaatctattcatatctctagaaaccatatcatctaacagagacaaacaaagcaattgatagagaatgctaagtcatttattcctgaagatgacatacacgatatcaatgtagactcgatgttgttgtgcaagtttgtagtacgatgttcatgtacctaatgcaaacattgcatattaatgaaaaacggttctcagctattatggcaatgcaaaaggtgattctgaataattctgatcctccatatacattttgttaatgcagtatcttcttgacgacaacagataaattttcagcaaccacacacacaaaacaaaaatgtctccaaaaatcaattttcaaaaaacttcagaaacacatgcagtccttaaaattggccgacgcatatctggtgcactaaacgaatatacatgagccattcagcccggaactgccattgatacaaagaatctgaagcacacaaaaattgagccccaaaatctcatctttacacccaggtcgatcctgctctcctcttgatatgcttccaaacttcgttatcctcgctgtcagcagaaaaatccaagaaatacagtggagatgaacgggtccaaatttggggtacaaacagaaattgtttttttttttcacaaatttagggtaccaatgactagagtggatccttattctcttgtcaatgcagttatatctatcacatcagaagcacataaatacagaggattgttgataaacagaagcaagaggcaagtaatttgagatttagttcgaagattggttgggtagcatgtacagaaggtaaaaatgaagtatgtccatcttttgtcgcaagaacaccattcatttgaatgatgcaatcgctaagagctgaagacactgctgaatatctgctcggtgacatagtcagctcgctctgcttgcaaaattcaggttgaagaaaacagcacagtttggaaaaaatgcttaatgccatcagtcctaatcccattcacagactaatcacgattagtcaaagatttttctttgcttttacataagctctgaactgtacgaggcttcctgcaacaaaagaaaaaaaaaagctaaccactaacaacagagcacgtaaaccaagcagtttagaagaattaataatcaacaatgatggttggtcaaacaaacacacttaaattttgttcaacagatgtcatgcacagctgaactgtttgttgatccataaattagcttcttcctagtgttgaatcggtaaactgcatccattcattttattgaattgtgcttatgtactccctccgtattttagtgtatgacgccgttgacttttcgaccaatgtttgacaattcattttattcaaaatttttatgcaaatataaaaatatttatgtcatgtttaaagaacatttgatgatgaatcaagtcactcccctttcatccctagaacacaggtcactcccctttcctgaccgggcagagcaaggcgacgaggcgtccgtgtgcggcaagctaaggacgtcaatcccctcccctcttcacaccgtgggtcgctccccttcccctccgctttccccacaggcggcgcagctccccctcccctcccccaccagcgcccatcgcatgccgcctccctccgactccgcatcatgcgatgcgcctcctccgctctgcgtagtgcgccataagagagtacgtatcaactaagtatggatcggaaaacgagcgacacaagaaatcgcggacgcacgcggacgtgactgcatggctgcctagtgagagactgctggccacgatacgcgagtaagtccgacacggcgtctacaattattcagaattattcagaattattcaaaatgtatatggaggatcagaattattcagaatcaccttttgcattgccttaatagctgggaaccgtttttcattaatatgcaatgtttgcatgaacatcgtactagaaacttgcacaataacatcgagtgtatattgctattgtatttcatcttcaggaaataagtggtctgacaataacaacctagcattctctatccattgctttgtttgtctcatcttgacttaccactgtatacgtatcttggcttgatcactgacaaaaatgagaaagaagcatagtatatttcttagtgcaaagatctaaagcatgacgattatatatggggataacagaaactgaaagtgaacctcccttacttcataaatacatggattacatttgcaaagcccaaaccttggcaacagatggatgcaaattaatcctgcaaactatatctatatttcttgatggcactctgctgcgaatcagaaaatctccgattctcatgtgtcataatcccactaaagatgggggctccatttttgtctcagggcagaagatggtttgtctatttcaacagccctgtggtcattaagagatttgttccggtccaataaaaagtatctcgatgtatcgataccttaaggtaccaaatcgttttatcattggatctagctgaataggttacgataccaaatcgttttggatctaacattgcacattgttagatccaatgatcgtaaacgatttcgtaccgtaaggtaccggtgcctccatatacttttggttggaccggaacaaatctcggtcattaagctttgcttcaagctccatgctgaaggtaactttggttggaagagttagttttctcggaaaacttgatactatttggcttccattccacgtttcttaacaaaagaaacttgcgattggaaatttagttacaactagaaaggtagcccgcgcacatgcgcgggcaccttctcgtataatgtaagtgaaattttattatgaatatttatgtgtgggtggctttttattaaaatatcttgtattatgttctaaactaaaattaaacttattttgtgtgctttgaaacctggttatatttttataattacccttccaccatataaattctaaaataaattacttgagctcatg

SEQ ID NO: 76233 - DNA, 3017 bp, Oryza sativa
aatttagccaaaagcgcttcttgctacataacaattgatacgatttggccaaaaggcgcttcttgctacataacaattgagctacattgtttgttgagcgtgtgctttgagatatcagagctacataccagtgaactttgataaaggatcctcacgatttcttacggaatcgttggcgctttgtgcctcctgaattgttattcccatcccaagcacttccccagaaaaacagtgccatccagaacagaactgcaaagaatatgcgtatcctatcctgtaatcttgataacctctcttgccaacctgtcaaaaggaagaaaagactagtacatatggttaaatgcatgcatccattaagcatgaactacaatcctgagatacactagaaatatgttgcgcatgaaagtaataggtagaaccgtagaactagagaagaaaatacaaaaatgattgcactgctctactggctaaaagttaaaatgcatacaattattaagaactaggagtataaagataatgtccacaaagttcaccagagattgactgttcctagacacaattccttgatagcattgtgaaacaatctcgttttggttgttgcaagcaagtgatacacatgatgtacataattcataataaatttcacacaaatgttgatgaacatcactaaccaactaatgaagtctctatatttatgatttaactaaaagttgcactgacaaagtaaatcaaacaagtagatacaactctaactatgatgtctgaaattaaaatagcatcaagaaattaagcattcctaagtatacaagataacgattatagtttgttgacgatgctgcctcaagttcaacacaaaccccacaaaaaagaacagcacacagagtcagcccttcaaaagtttctagtgggatggcaaacctaggcagctagtgcttgccggtgttggctgggtgtgtgggtgtgtttttttggtgggagggctttggttctcctactttgttttttttttctttttcttcttcccttaatgaatgaaacacatttctcttgcatttcgaggaaaaaaatcactacggagtttttcccattgttgatgagttccctttgttgcgaagaatgctgaagaccaccaagaaaactaaaaaccaaagttttgtgagatttatgtgcaagatcaatgtacgtgaggaccaattatgataatattgcaatgattgaaaatttgtgtttgagaggtgaagtgccatgtgcttagtggtctgaccagtatggtaccgtagtctgactatggccctagtggtcaaactggggacgactcattttagtttgacttttggtcgcctcgggtttgcatggttggacaggtcacataacaacagtctgactaaggccagctaagattgggttgattaggacttatgtccaagttggttttgagttggatggctattgcaatattcttagtgatttacacacattacatatgatgtgtaaacgctaatttgaatcaagttcagaagaacttgtggtaaaaaaattgtttcttggtttggttatgacgttatgtacagttattacttgagggtgagcgtggtcgatgaccttagataggaacaagacagatgggggtgttgaggttcagtcattcagatagtcaatgagttcatgtgggacacacgggtagataacagtgcatgcgaaggtgagatttccatatggaattcatgggagatgtgcatcttatggaaaagtataataatttaaaaatagtccaagtttggcgaggacaaactcggttatgcgagtctttcctctacagctacgagccctagataaagaaagatttgtggcttgtgacagccatgttgcgggtatataaacactcggggagagcaaaattgttgaggatttttagagaagaattagggatttagacattttccattttcatctagggttttcccatgtggttaagggtgccaaggatacaccttgtaaacattttaaagcaacaaagataaaattcataaatccaaaggtgtaaaatccttttgcttttcctcactgttcttcatttttgtctatttttgtacaagttgatccatccaaaacttgctagggcagaaagaaatagttctgaaaattttcattgttcctttctgatgtttgaaaatgaccacattttcatgttttttatgatttcagggtcaatatgttcagatctataagtcgaagtgcgaaagttcttcttggaacagtttctaaatagataaagtttatattagtcgaaaagttccaggccaatagaagttagggggttagaagacaccaattttacatttggtttgacagattgcaaacagggctcgtggtctgaccatgactaagccactaaggacaatccgacctaactaacagggcctaagtgtgattgcagtggtttagtgatttcagtcctacaattgcagcattaagtagctgctgtttgcaaatcaggccatccacctgatattctaatttatgatttgtactgttttacttctactagggagggcaacatactagtaactatatattacatatgttgcagcagtttcaacttttaagatataacaaatatatttcatattttagtttcctaggcaccaaaagaaaacatggtatatggacagctaacattctcatgatattgaagcctggatgtctggcctgcatgaacaccataaaaaaatggccaacgatacattgttcccctacatctatgtgctctgctgcaaactaacacactacggatgaagaggacactttcttcagcaattcattttgtcccacaacccttttataaaatggaacatgtataaaaaagcatacatttgccgttagacaaaccgacaatcagcatttggtatctcaaatccccggcaaatgagtctggatcggacacaattagtacatagtaattctctagtacaacacatcccaacctcaatcgattaatcaattacttgggagcacgg

SEQ ID NO: 76234 - DNA, 5081 bp, Oryza sativa
gatctagcatgtatcagctaaactctgataccactctatcttaagatatcaaagcaaatagaatatttcaaccaaagcctaatattcctaaatgcagcaagatcttacattaaagggcaagatttaacatattaacgaagcatatagagtaaaaatagttaaatcaggtaagatcggctgaaaccccgatgctaccctaatcgtcaaccagaaggcaggctagagattgatattctaagcacgacttaatagatcaaactcaactgatgcagcattaaatatgaaaagaagaacaatatctagacaatcaagccactagatgcttcatagagtggtaaatatcctatataatctaagccaacgtcgctatttaacctaatcggctaccttctactaacagatgttagccgattgtaggttagataacgatattaccgaagattatataagatatatgataactcgacgaattacataaataagattagagtatcataaagatggaagcactaatcccgagaacgcaagctgctataacaagtttacctcttgttgaagatcgaaatcgatgcagctcaacccgaaagcaagaacttgtcgaaacaaaacgaaagcaacaattcttaaaccggctccaccagtaagatatttttaatcctttcactagttgatctcagccgattttgtctaacacttgtctcttttacagcctcctcctcctccttcttctcctgtacgaccatcatcgagtgaccatactccgtcggctgtagggagccatcatgttgaagaagaagaacaactagctgctcctaccattccagtaagtttccttttgacacaagaatttagatcggctatgtctacttagctctaacttcctttaaataattattgcaggtcctagccgatcttttctgctttgacattagagactatcttgatgagacagaagaggataccacaagcaaagctttagcccccttatccgatgatgtgaagaaaattcttgaagatatctcatcggctagaggcatcatcgttagacagcttagtggttgattgtggctcaattaggactcggctacatgaggttcaagctctgatcccagatgagctagccgatatccttactccggccgtatatctcgagcaacatcaattcaagctagagaaagccaagctgagactagctgaacgtcgggagcgcaaagatatcgaggctacaattcaagccaatcgacagcttgttcatgaagagaaggccaaacttgatcagctatctgagggcccgatcaaatctaatattgatcggctcgaaactcgtaagactgagctcttggcacaacttgaagaatgcaacgccgagctggacatggaacataaaaagctagccgatctcccaaattctgttgaagagcagaaggcaagactaaaatcggctatcaaaaatgttgctgatctgaccaagtttttaaaagtcatccctgtaaccgatgctcaaggtgcccatgccattgaagaagtagaaaaaatcaggcaaagagctatttcagctttccagcaatatttgtcttagtgatatcttatgtaataggtcttagaaatttttttgcaatcggctaagaaactctgactctttatgtaactcatctcaacaatctttaagccgatttaatatgaccccatatttggctcaaaaatatgcaatttttcatatatatatgtgccccccctaattttacaatgtcacaagcattgataaaattataaaagcggctaagggcgatacaacaatatcggccattatacatcggcaaaccataaccgattacaatatgaaaaacaactaagggcgatataacaaaggaggaactgattaaacggcttgctgattatcagtgatcaagggccgataattcgggaaagtacctccttgaagataaaccggtcccgtagtctgatagtcagctattgaaccatcaaccatcgacttcaccatgtttgacaaagtattgactaatatcccagattgattgatcaaagcatgatgtacggcatagtctacctgatcttggaagttattaaactgtagctgtgctgcgttactaacttggttaagattagcacctttaaatccctgagaaccatcaccttgaactccttgagagccaataccttgaactccttgagagccatcaccttggtctcattgaaaaccatctgcagcacctttatcagtcggttgagccgagccatctagagcttgtttcacttctccatccttagaagaaccggtcccaggaacatcagcaactacctttactttgtacttctgaactaatgttcccttgcgagtctccgtgaatgagctcaagaactgattccgtgcttactgcatcattgtatcaagatctttttgctgctcaagtgtcaatttatcaaaagtgatgggcacaatgttggcttcatcaatctcagatagacccagcttcaggatcttttctttaacagagccaggaccagccgaggacggcgatgctactagtttctcggccatgaggaaagctgctgttgtgattctgacttctgataggtcccaccaggcgtgccaaaagcgtgttgacgtaaaacacgaggcctgggagatctgcttaactctagtgcaggtccaaaactcgccttcgggtatgctagcgtaccagttgatttgatcctgcaatcaacaagaaacaaggacaaagaaaccgtggttaaatccataaacgatagccgatcggctaggtgccgatgacatattatttatctttgagccgatgtcatatatgcatcgatcggcaagtatcaataaataaaacagaactaaatctactcgatcggctatagatattaatgatatatgatccttatatcgatatatacttaaaaccaagtgattgggatagatcggtcgccatgccgagacagtataaatcacttagatcgaaatatatattaataatgagattatatatattcatagtatagccgatcagatagatctagcatgtatcagctaatactctgataccactctatactaagatatcaaagcaaatagaatatatcaaacaaaagcctaatattcctaaatgcagcaagatcttaacataaagggcagatttaacatattaacgaagcatatagagtaaaaatagttaaatcaggtaagatcggctgaaaccccgatgctaccctaatcgtcaaccagaaggcaggctagagattgatattctaagcacgacttaatagatcaaactcaactgatgcagcattaaatatgaaaaaaagaacaatatctagacaatcaagccactagatgcttcatagagtggtaaatatcctatataatctaagccaacgtcactatttaacctaatcggctgccttctaccaacagatgttagccgattgtaggttagataacaatattactgaagattatataagatatatgataactcgacaaattacataaataagattagagtatcataaagatggaagcactaatcccgagaacgcaagctgccataacaagtttacctcttgttgaagatcgaaatcgatgcagctcaacccgaaagtaagaacttgtcgaaacaaaacgaaagtaaaaagagtggcgatgcgccgagattgtattgaacgtgtgttaaattgattacatggggctcggggtctatttatacccgagaattacaaaacatgtccgtatcggacacgactcttatctctacaaactctaagataccataagtctttgcggcagacttttgcccgaatatatctctaaggaaattacataaaatatcctaattaatatatacaattgccttctcaagactctatccatgtgtggcaatcatcacgaagcacattaactcaacccgatgatgtataccgagtcgtattgtcggaatcggctgtatcagcttacccaatctgactcggactcagccgatcctgattgtagctgatttggattccacccgattcttactctgttcccgaatcgatcttcgtctttgattccgcttcgatctaatcttcatcttcgatactgacactggtggagaaaccctttgtagtcccggttcgtaacccccctttagtcccggtttccaaaccgggagtaccaatccgggactaaagatcgctatctttagtcccgggtgaaataaccgggagtaaaaatcgatctttagtcccggttggtaacaccaaccgggactaaagatcgagctaaccttttttttttgcatggccctgttgctgcatggtttatatatatatatatatatatatatatatatatatatatatatatatatatatatataaaccatgcatatatatgtttcaatacatatatatgcatacatatatatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaatcgccgcgataaattccttgtgtgtggtcaggttatccctcatgcgaataaactatatgaatgtatgaaattgattagtaattaaacaagaaatcgctacgtaatgaaattttgaatttatttgtacatacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgt

SEQ ID NO: 76235 - DNA, 5244 bp, Oryza sativa
aacgtttgaacacttggatgaagtattaaatataggcttaaaaaataactaattacacagattgcgattaatttgcgagacgaatcttttaagcctaattgctccatgatttgacaatgtggtgctacagtaaacatttgctaatgacggattagttaggcttaataaattcatcttgcagtttattgacggattctgtaattagtttttttattagtgcttgaacgctacatacgacaccctatataatattcgttgtgacacaccaaaattttacacgcatggatctaaacaacccccttagctacactggtggagaaaccctttgtagtcccggttcgtaacccccctttagtcccggtttccaaaccgggagtaccaatccgggacgaaagatcgttatctttagtcccgggtgaaataaccgggagtaaagatcgatctttagtcccggttggtaacaccaaccgggactaaagatagagctgacctttttttttttgcatgcccctgttgctgcatggtttatatatatatatatatatatatagaccatgcatatatatgtttcaatacatatatatgcatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacggtttcgacgtagtagtactcgctgctagctcagaagctaaggaccggtgaattgtgtttccgtcgtagtagaattcacccttgggatcaaggatttcttcgttgatgaatcccatgagttgtttttgaaccgccgcgataaattccttgtgtgtggtcaggttatccctcatgcgaataaactatatgaatgtatgaaattgattagtaattaaacaagaaatcactacgtaatgaaattttgaatttatttgtacgtacatcgagctctcttgtggtgatgatttggtctgcaaggcagtagcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtaacgaaaaccctccgccgtcgggccctttgaatctgcattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctaggggggcccttgactatgaaggtgccggaagaggagcttgcgggggagtaggtgtaggagcacgaggaggagtcggtgcaggatcctgaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgatgccaccttcatgttgtgagagattatttattagtaatcaacatatataagcagcaactagcggaatggctaaatcttacctttattgataagttcttcaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccatttccctcgagttcgtcctggatgctctggagtctgcagggcgagtgtcagctcgtccctatctctgtctggtcggaacgtgccctgagaggaggcttccactgcatctgttagtcgtcgcgcagcctctcgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcatttcagtactggctgcttccctccgcgattgtatcgtacaatatctgttcctcatcgcggtcagccatctgttgatacaagaaacatctgctaagtcatgagacatttatgttttaacaatctaagtcatgtatgctaagtgtaaatgtcgtacattagaaccctacacaaccttacatgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttatagggctagctcttccactcaggcttgacggacgactccgacaacacgtcttttctgcaagatacaaaaaaatgtattaggataaatgcgaagtaacatatatatatatatat

SEQ ID NO: 76236 - DNA, 23518 bp, Oryza sativa
atgcatgaagggagatgcggcggctctcaccccagagatgcggcggcagcggaggaggcggaggcagcggcgaggacgacgagctcaagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccccggatctttactcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcatgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaagctcatcaggccctctgcccttctttcctttgctagacatgtccttcacgaaaaagacttgcgttacatcattgccaaggacaaaaggttcgtccgagtatccaaccttgttaaggtcaacagttgtcatcccactgtcatcaatcattacgcctccactagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatcaatgcatcggacttaccaatgttcctagcgcgaactagagccaagtgctccttgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcaaaaggtgacaaagcagatgcgtcattatattgaaaaatgaaggtggaaatatcaactcaaaactgacgagacattgcaccacttcattctgaagggcttctaatctatccggatcgaagaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagatggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatggagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactccttgtttgtcctcgtcccacatggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttctagtcctaacgggcagactatcttcttagcctcgtacgttgtctcgggcaatttgtttccccccggaagaatgttcttgacgagtttcaataaatcgccaaatgccttgtcactaaccccattttttgccttccattgcaccaactccagagtggtatccaactttttgtgcccccgctcgcaacctgggtacaacgaagttctgtggtcctccaacatcctgaccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaactggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtcccggttggtgctaccaaccggaactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgctacatggctatgcaaggtttttgaggctttgtgtggtgcacctgcatgtgtgatggatgctgaggtgggtgtcggatttttaagctaaatatcgtaccgatccaagcacttgtctaaatattactgagtgcatgttcaaatattcagctgatagcgtgagctcatatcacctataccataaagacaatgccaatacatatgcatcttcttatttattaatttcagattcaaaaattattatatttaaagcaaacaactatcaagggctacataaaccataaataaatatataattaatgttacttaatcttctcgatacaatacatcaactggacaatatatagtagtgtagttactacttctcgacactttgaactatatgcatatataggagatggatttttcattccacaaggaaactatacacacaactttagggtgaatctatcataagggcatccggatcttgagcctttactactttctccgtttcacaatgtaagtcattctagcacttttcatatttatattgatgttaatgaatctagatagtatctaaattcattaacattaatataaatgtgggtaatactaaaatgacttacgaaacggagggggtacgtactaatacgaggacaataggagccctatgaaacccatcaaatttttatttcttcttaaatccaccgctgcacaactcgtcgcacagacgatgcagcggccagacatgcatatatgcagtggtcgcgtgcgttttctgtccatggctagctccgtgctacttctagctagtgcttcaggtagaggtcgatctcgacgatgccaccggtggcgaggctgtagtcgtagttcttggtgaccatgtacccgcgcgcgagccggaaccgccccgtgccgccgatcaccaccgactcgcgctcgccggcgtccatgtcgatgcggcccttcgccgtcaccgagctgccgcggtgctcgccggcctccagcaccatgtgcaggctcaggtccgacaacacgccgccctccgacacccgcaccgcgaacccctgcgccgtgcccacgcgcgcgctgccggcggatggcccctccgtcagcgcgttgttcagcgccacgatgtcgccgaactgccgcggcggcgagccgtcgtcgccgttgccgttgccgttgccgttgtcgccgtcgagcagggagcggccggagacgacgcgcatggcggtgggagccgggccggtgtaggcgtcgtgcatgtaaaagtggaggtgggtggtggtggtggtggtgaaggcgccgttccggtgaagaaagacggcggctgcgaggagaaagcagccgacgaggacggaggagaggaacgccattgtcgagcttgatgtggggctatggcatgcagctgcttgcagtgtgttgttgcagctggcaatggcatgtacttatggacgtgacaagatagcgagtgctagcgcaagcgaaacgtttcttttttaaaaaaaaacgaactgggctcctcctcgtgtgaaagttttaaaaaaacatatctacacactatgcatactttaaggtgctgtcacatcggatgtttaaaccctaatttagagtattaaacatagactaataataaaactaattgtatgaatgagagctaattggcgagtcgaatccataattagcaaaacttttgctacagtcaacttttgctaattatggattaattaggcttaaaaaattcatctcgcgaattagctctcatttatacaattagttttattattagttaatgtttaatagaccaaattagcgtcaaacattcgatggagaggaactaaaaagttttagtcccatgtaaactgggccttatcaaaagttttagtcccatataaacttggccttatcaaaaatagtaaagtatcttatctggtcatactcatattttcaaaaagaatgtagcatgctattcacatgctatgagaaacagtaccattgatgtactctctccgtcgtaaaatataatcattttttagacttcgacacagtcttcaagatgatatataaaaataggatgttgtaaataaaaaaaatacatattatgatagtttgcttaatgataaatctagtaacatcaattttacatgatggatattttttattttttctattaatagtcaatgttaaaagtttgacttgacactatgctaaaaatgcttatattttaggacggagggagtagtatttttttaatcacttatatcttttcaacggtatatatatttgtcatggttataaataccacatacctaatagtagttaattaagcacggcgggacccaacacatatcaagtcttatacgtacctaatagtagttaattaagcacggcgggacccaccacatatcaagtcttatatggaattaggcctcacttatgaaaggtattttgaataaggaaggacaagtagagttctatatggaaactatagggactactcggattgtatccatattggtccctatagttctatttggtcaaggggacacctatgggtataaatagaccccctaggaggagagggggacaatcaagatagacacagaccaatacaagcaaacacacgccaagacaagctgccagatatcaacatcaaaaataagcctagacaaacccaatatagtgcctgtagaggctaacaagggatctagcgctatctctaatctcgccgagtgcggattcaaggaggaagactatcccgttgtcgactacatcatggtattctaggccgccaagtcgacaacggttgatagattatcccaaattttgtactggtgtgattatgatgaataaatagcaacaccggcttcggccaacaggagtagggatattacttgccaaataaggggcccgaacctgtataaaaatccttgtataaaaatccttgtctctatctcttttacctcaatcttgcataaaccttggtaccgacaatccccttaccatgtagttgtgacctaaaacatcgacaatattattttaaacatctacatatttgaacgatcgtacttcactcaaaatatataacaaaacaagtccaatattaaaaatttccaattattttaattttttattttttttcatagctcctgtaatagtatagttatttcaaataccacgaagagtttctttcccagagaatgtagttacttctacttctgaaaagagttacttctactaccttaaaagcgatggagcccacatgttagttctgtttttcttaccttttaatttctaacgatatatactccctctgttctataatataagggattttagagggatgtgacactttatagtactacgaatttagacaaaaaaaaaagcttgtccatagtcctagaaagtatcctattcctctaaaatcccttatattttgggacggatggagtatattttaatttcttcctctcgtacataaaaatcggtgcacaactgcacatgtcagaatatatattaagccaggcatcagccataccattggtataatgaagacattgcctgatgtgattgagatgagggtaactgattaattcatgttctaggaaagacaacatccgtcctataaaaaaccaacctaggatgagatatgacatttctttatacaattaatcttgataagggtatgtccgggttcattatactaaaaaaatgtcacacatcctgtctaggttggtttttgatggcacagacagagtactgttgtatattttacgcgctctctctctcactactactctccttttctcatccatagtgtatgtctacacatgcatatcatgtcatgtcattcgcgcatgtccacataagtttttgcttgctcatttgcacgttttctcccattttcaaatgtttttctttcaaaataattatccattctatcatttgattacactgttgtattacaattaaatctttataacaatatatcacacaattatattttgataaaaaatcaaatattgtttcaccctttaaagaaaattgttcactgcataaagagtttcagagaaatgcaaaaattaaaaataccgattgcaacaatagtaaccacctatatgaaacattaagtcccaaagaacgaaaaaaagtcatatttatatcacatattaatattaaattgtaaatattgaaacattataaaatacttcttgaaacattccagaaaaaccaggtgcaacatttgcaagttaactagtgcaacatcatatgtattctagttgaaacatttaaataaaatttgtgcatcatttaaaagaaatgtaaaaatgctaaatattttttcattaaaatataaccatatgtggtcttattataaagatttaattgcagcgaatttaatagtgccatggatcgtagattgaagaagtaaattaagagaaaaggtagtttatagattgctaaagaaaaactaataccacccaactaaccatggttttttattagatgcatgcatgaatatagacttagctacatggctacgcaagattttacaagctttgtgtggtgcgcctgcatgtgatggacgctgaggtgggcgtccgatttttaagctaaatacctgacgcccaaaccatagtggtgtcgtacagatccaaacacttgtctaaatattattaagcacatgttcaaatattcagctgatagcatcagctcatatcaccacatcacctgtacgataaagacaatgccaatacatatacatcttcttaattattaatttcagattcaaaaattattatacttagagcaaagaaactatcaagggctagctcgtgctaattattttttatcaaaacaaacaactatcaagggctacataaaccataaataaatatatgattaatgttactcaatcttctcgatacaatacatcaactggacaatatatagtagtgtagttacaacttctcgatactttgaggagtttctacgtatataggagatggattttcattccacacggataatatacacacaactttatggcagatctatcatgcaggcatcgggatcttgaacatgaggacaataggagcccgcacgaaaccccatcaaatttttttaacatatacagatagaaagaagtactaattttttcagtttgttcagatattacttcctgaatccaccgctgcacaactcctcgcacagatgatgcagccatgcatatatgcagcagtcgcgtgcgttttctgtccatggctagctagtgctgcaggcagacgtcgatctggacgacgccgccggtggcgaggctgtagtcgtagttcttggtgaccatgtacccgcgcgcgagccgaaaccgccccgtgccgccgatcaccaccgactcgcgctccccggcgtccatgtcgatgcggcccttcgccgtcaccgagctgccgcggtgctcgccggcctccagcaccatgtgcaggctcaggtccgacaccacgctgtcgaaaaaagatttcggcaataataaaatgggtggctatcaagctagaaaagtggatgggtttggagacgaagaattttataaaggttcgggccttcttattcaagaagtaataccctactcctgtccggggatgattccgccgagtgtgttattgattgtataaattgggaaaaagaatcgcgtcccaagaggcacacggaccctccttatataggggaaggagtccgctttacaaaatacaatccatatcctaacggaatatgggattatagataaaatacaaacgtaaccgactaagatcccgggtatttccttgacatacaagtttagaacctaacccgagtcttcatagagatattccatctatatttggtaccgtatatccgactaaattacaactgtcatgtagatatggggtatctataatctccacagtagcccccgagacgttcgcagttgacaaaatagccttctcgaaacaaaaaacagtagtccgagtgcttcaattcaacttgctccagcttgccgagtgctaaagatcaaaaactgtgaagggcgaaaataaaacatggtgcatcgagtagatgtacctaattaggtgtagcccccgactatgtgattagttgaaaaactaaacatatagtcaagaaccgagtggttttatagcgaagcacgcatggtacttagtaagatacccagccgactgcttctcaacttgaacataccaaggacaaaaaatacaagaagggccgagtgataaacactcaaaggtccaaaaatagacatgtttgataggaatccgagtaaaaatctcataaaatgacccaccaaacatgatagaaaatcatggtaattaataagtctaatagcctaggctgtgacccttaccataaccaaaataagcatataacatgctaaaagaatgattattaataaaccagtcatctcaaatcaacccaaacagcttttgcagcctaataaagcttacaaaaaatggtataacacctttctgtcgggcacctttttatatgcatcataataattccaaagaattattgaatcgcgttaaaaaggattttaacagcattgggccacaccattgtgaacacaaattgccaaagcaaaaattgactaagtccctagggatcacaacaggccacgctgattatagtattgggctgaagtactgtacaggcccaggcccattagtactcccgataccccaataataccgaagtgaaaaacgtctcttcgtcttccccgccgagactctcgccactttccccatttcctgctacagtgcaaaactgcgccgggcaaactagggttcatcaatccgctccaatccaccctcaaaaacttcacgaaatttctcctcgcatccaccgctccgattccccatccctttccagccgtatctcgaactaaatcagaccatccagttcacattcatggcggaagaaagagaaagcttcgagagtcagtgggcgccctccgatgtgacggaagacaatctgaaggagatggtggcgcacggcgttcttccagcaaaagagatcatcgggtggcgaccggcatttggtgaggcattcccgacccccgatacacacgaaatcgtggtatttgctcatttcttctatggcggattttctcttccaacctcaagatttttccggggaattctgaacttctacgggattagcttgcatcatctgaatccaaactctatagtgcatattgccaattttattcatgcctgcgaagcttttctgggcattaggcctcatttcgccttgttccgccgcatcttcttcctcaagccccagctaaataagagcaaaccatgcgtcgttgggggtgctggtttccaactcaggggaacactaagccaaaaatacttctccatgcccttcaagacctcaaataaaggctggcacgcaaattggttttatgttcaaaaccccgagcctgttcttcccgagtactcctgccttcctccagtttatcgggatacttggaactcactgccaatgggagatgaagctgcacaagcagtagaactgatggagagaatgataaagctgaaagaacagggccttcaaggagaacagatcacccggcactttatcaagtgtcagttagctccaatcaaagaaagatctcgcacagccttcgaatttgacggcaagcatgacccaaaccgtgaagatccagattctcttgacttcaaggtcatgaaggaaaggatgtataagatcttctcaaacgccatcgttgtcagctactcacacttgctgccagtcgtaccgttcaatgcattcaatcctcctccaccggtacgtattcatacacttcaacctttctcaaaatatgatcttattttcttgttgaattagttaacaatgaaggatattacacccaggaatttgctttgatgaagtcggatcccccaatcgctcaacgccgatctccccgccaccaaactgggcaagggagcggaggaccacgaattcggtctgaactcaaccaagtgcttctgatccaatcagccagccagattctcgaaagaggaagctggttttaagtgacgacgaagccgatgataccgccaggaggcctggagaccgagagacaaccaagaaactatcaaaacaggctacaccaaggaagaaaacatccagtcgccctgtgccaaagatcaggaagtcttctaggtgcaacttacataacgatctctcttgcattgatgcgcacccattgtggcaataatactgataatcaaatttgcaggaaaccatctgatatagatccgtctggaaaagactctgacccgactaacatggacacaagttcttccaaagaaaccgggccaactgctgaggatcatccgagtgacaatcagccggcaaccgataatgtagaatccggtgatcaacccccgactggaaaccagtcggccgaagccgaagccggagttaatcaggagcccccgactggaaaccagtcggacgcagggccaagccaagaggttccagaagtcgaaacccaagcagacaaccctcacggacaagacgccagcaatgaccagagatctggatcccctttaaaggcatccgaatccactcgtcctcgtccagaaatcattacgggtaaacactttgtctgaaaccatgttgacccaaataactctgatcgattgtctaacctttgtcaatggatacattaggaccaatgatcggtgatgaagaagaaattccccgtatacaagcagccgaagattcgtgccctcccattctggtcaagtggtgggatgacaacttgcaacctcaaggaattgtaataaaccggcaaaaagaagatgaagaggtatgcctactgaaaaaggcactcaaccaagcgactcgcattgtaaatgtaagtcccttgacgcctgacctcagccatcttgtttgccgtctggctcgagcgctgattaaactgctccgcagaggattcatcttaggaacgaggcgaaaaccgcaaccctagagagactagttcctcattttggaaccctcgaagccactaggagtcaattgcacgaggccagagaacttgccaagaagaatgaacatgatctgtgggatcggattgctgagctccaggagtccaatttcgaactgagtggctcatcaaaaggttcgcgcaaactctgcccaactgatttgtgctgttatctctgtaatcttgattaaccgaagttaatgtagtgcaagctgccaagatatctcaactagagaaacagatccaaactctggaaaatgacaaggcagagctggcaagatagagggattcggctttaaaggaggttgaaggtaccaataatcaatacctcaaaagccattatcttctatatgctgattcattaatgtgaatctgttgacgcaaaccgcaagatcaagtctcaagcacaatttgatgtcttagttgacaagatcaacaagtttgaaggagccagggataaagtcgctaatgccgctactccacttatctaggccatgttcttcaataacgccggttcgagtacacttgatgctgccgaaatcttcgacaagctgagagtcgcaccagatacttacttcaagaacatcaaagaagctggaagtatgggagcaagtctggcattggcgatgaccaaatccctttatccaagagttgacattgatgccattgatggctttgcagacgggacgagcgaagaagctgctcttgacctcatcaatgatgagcagaaagccgctgacaagattgctgctgatgtagttgagagattccaagatttcgaccttcggccaactgggtctgataagtctgatgatgaaaaaactgatactgattgatataacaatgattttgatgatcaatgacggtggaggctcaatttgtacaatactgatgaatttatgctatgcttggtgttccatacttagcttctgatttcttaaaagcctttgtcaaaccttattgagcctaaaacccacaaaagctattaaaaaccttcagtcctcattggctaagacgaaagaccaaacagggcaatgataaatcaagtaagcaaattgaattgataaaaatcacactccattattatcatagtagccccctgactgaaaacttcaaggaaaaccttgaagttagcagtcaaagaggaaagatacaaacgaaatgcctaagcataaaatcgacgaaggtgttcaatattccaagaattgttgatgagagtaccgtcttcgtgcttgagtcgataagaacctggccgagtgacttcagcaattatgaacggtccttcccataagggagatattttatgccgatcctgtgttgtttgaattttcctcagaaccaggtcgtcgactaaaaaggctcgcgatcgaatattccgattatgataacggcgcaacccttgcaaatatcgagtcgactgaatcaaagctgtttctcgggcttcttctagtcgattgatgtcgtctacttggccctcttcatagccctcctcgttgaatttccgaaatcgtagtgattcaaattccacttcactcggcaacattgcttctgcgccataaaccaaaaagaacggcgactggccggtagcccgattaggagtagtgcgtaaagaccaaagtatggacggcagctgatctacccacttgccagcatagggacatagtcggtcaaaaactcgtgctttgatcccttgaagtatcatgtcgttagcacgctcgacttgtccagtactcataggttgtgccacggaggcgtaacaaattttaatgccgaagtcttcacaaaagtctttaaatgctccgccagtgaattgagtgccattatcagtgatgatccgattaggtaccccaaaccgatgcacaatgttgatgaaaaaatctctagccttatctgctgtgatcatgatgacctgtttagcctcaatccacttggagaatttgtcgatagccataaagagatgcgtgtaaccgccgactgcccttttaaacgggctgaccatgtcaagcccccagaccacaaatggccaggataacgggatggtttgcaactcttgggctggcaaatgaatttgtctggcaagaaaattgacaaccttcacatgtccgcacaatcttgtcagcatcagacacagctgtaggccagaaaaaaccttgccggtaagctttgccgacaatggtccgtgcagcggcatgattaccacaaataccagaatgtatatccttcaacaactgtctcccttcttccaaagacacatagtgctgcagtattcctgatggacttttcttgtacagctcggtctcatgaataatgtaaagtctgctgcgcctggaaatccgctcggcttcatttttgtcttgagggagttcttgtttgctcaaaaattttataaaatgttctctccagtcggctttgatcatgcttacgccttgagtatccatggcttcgactgtctcttttctgggcacggtcggttcgtaaagatgttcgacgaacacatctgaaggagctgcttcccgttttgaaccaaaattggccagtttgtcggatgcctcattgttatgtcggaggacatgggtgagctcgagtccatcgaatttattttccaacttgcgtacctcttgtcgataagtggtcatattatcatctagacatgaccactctttcatgacttgattaacaaccaactgagagtctccacggacgattagtcggcgaatacctagagatattgcaatccttagtccatggagtagcgcctcgtattccgccacattatgggacgcagaaaaatgtatccacaatacgtagctcaatctttctctagtcggggagattaaaacaaccccagctctagtgcctgtaagcctcttcgacccatcagaatgcatagtccaatattccatcttttcctctggcatgtctttttggcactcggtccactcggtaaggaaatcagctaaagcttgtgacttgattgaagttcgtggcttgaacgatatgtccaaagacatcaattctaaggcccacttcgcaatccgtccgtttacttcgcggttatgaagtatatccccgagtggaaacgatgtgactaccgtgaccgagtgactttgaaagtagtgagataattttctgacggtaattaagacaccatatagtaacttttgaacctgagaatatcttgtcttggagtcagctaaaacctcgctaacgaaataaattggacgttggactttttgaatatggccttcctcttcacgctcgacaaccaggaccgtactcacaacctgggaggtcgccgacacatataacagtagcggctcttgcggatgtggcgaggccaaaactggtagagtggtgagaagtttcttgaaatcttcaaaggctttctgtgcttcgggtccccactggaaattgtcaatcttcttcagcagcttgaagaagggcatcccccgctcgccgagtcgtgagacgaactggctgagcgccgccatgcaaccagtcagcttttggacgtctttttgggagcttggcggtttcatgttgaggatggcgttgattttctccgggttggcctgtatgcctctttgagataccataaatccgagcaacttccctgacggtactccgaagatgcacttttccgggtttagtttcatcttgaaagcacgaatgcttgtaaaagtttcttctaaatccgcaatcaggtcatccttctgcttggtcttgacgactacatcatcaacataagcttcaatattgcgaccgatctgagttgaaaaacatctttgaatcatgcgttgattggttgctcctgcattcttcaatctaaagggcatggtgatgtagcagtaggccccaaagggcgtaataaacgaggtcttcaagcagtcggattcttttagccggatctgatgatatcccgagtaacagtccaagaagctgagtaactcacagccggccgttgagtcaaccacctggtcaatgcgaggtaacctgaaagggtctttgggacaagatttgttgaggttggtataatcgacacacatgcgccattgccccgtctttttccgaaccaggactgggttagccagccaatcgagatgaaggacttccttaatgaagcctgctgctaacagcttggttaattcctccttgatccatccttcctgtcctgtgcaaaacggcggagtcgttgcttgatgggtttggcgtcttccttaacatgtaaagagtgctcaatcacctctctggggataccaggcatattggatggtttccacgcaaaaatatctttattattctgaagaaaggtgatgagcgcactttcctatttacaatctaactcagcgcctattacagcagtcttatcaggatcggagggatctaagggaatctttttcgtcttggcatcactttcttcggtcttcgtcagcttggttgcaggcgcttctccctcgcttgccgtggtcgcagccagtcggatctcttcgcgggcgagagtagtctcgtgggtttgggccatctcacaactttctttgtcacatgtgacggcctgcttgatgacgctccgtagtgatatgactcctcgaggaccaggcatcttcatcatcatgtaggtgtagtgtgggacggccataaatttagctaaagccggtcgtccaagtatagcataatatgctgtctcgaaatcagcaatttcgaaacaaacattttctgtgcgaaaattctcccgagtgcctaaggtaactggaacagtgatctggccgagtggtgtagctgacaatcctgggataacaccgtggaagggtgcattactcggttttaattccgtgcaaggaatctgcatatcgtccagggtcttagcgaaaaggatgttgagtgcgctgccaccatcgatgagagtccgtcggagcttgacattgcgaaccactgggtctagtaccagggggtaccgccccgagtggaccactcggtcgggatgatccgagcggttgaacttaattgctatctctgaccaccgaagatattggggcgtgttaggctgaaccgcattgatctcccgttctgttagcttctgttttctcttagattcataagccaggggtccgccgaagatgtgattaagttctttgcgatgatcttgaaaaccagtcatggcatcgtcttcatcatctttcttctttgatgtgccttgatctccgtctgagggtttacatgcgttcttgacgtattgctccgcgaactgtttgtagacgaagcaatctttggccacgtggttggagttgggatgatgcggacattggaagttcattatcttgtcgaaggtgttaatgcgggaacgttgtcgggaagacggagaggtggtcgccacaagttcttcgggcttacgcttgcgatccttgtggttgttacttccactccctcccgcggtcggcatatccttctttggcttccaagtggtgcccgattgcttggacgccgtgatagcatcttcggctttggcatactcattggctttttcaaacatctgtttgaccgtcttgggaggtttgcgtccgaacttgccgactaggtcctcgtggcgaatgcctttagtaaaggcagcgatgatgacgtcgtcggtgatgtcggagatcttgttgcgttgctcgaagaagcgtcgaatgtaatctcgaagagattctccagacttctgaacaatgttgtaaagatcgaagtgtgttccgggccgttcaaaagtgccttggaagttggcgatgaagtggtcgagtagctctgcccatgatgcgatcgtgccgcagggtagcccgtgaagccatgaccgggcagaatccgctagggccacaggtagatagttcgccatggctttgctgtctcctcctgctgcgcggattgcgagaccatagacggtgagccaagactcagggttggtggtgccgtcatatttctcaattccagtcggcttaaagccggctggccaatccactcgacgcagatcgcttgtgaaggcagcaactccatccacgtcgtcgtcgtagcgatccggtgaatgatggcctcttgctgcgcgcgctggttgatggtgtcgcgaagatcgatggggcgccttcgatgtggggagtgtggtcgttcaactcggcgctccctatatcgctcgggaggcgaacgaacagaccgttcatcatgtcccctgctcctacgactagattcggcgccggcaatgctgaggctcggctggtgagggactcggctaccagtcggggtgcgggtgcttgcagagttggctggaaccgaggcagcgatcatggtcttcgtctggttcaagatgttgactacatgatcggcttggttgagtgcgtcttccttgaggagggtgtcgaggagagtgattgctgcaaccgcgttctgctgggggggtgcgaaagaccgctgtcccatcgacgtcttgttgcccaatgagctctctcgctcgccgcccagattccaaggcacgttgtcatcgatcttcagcctcctttgcaatccgttcgcgatcttgttgctcacgctgtagtcgttctcgctcttgtcgctgtcgctcttcctccagtcggcgacgttcagcttcttgccgtgcgcgatcttggtccgcttctcgggcttagcgttgttcctccgtttcgttgtcagccatgaatacgccgaagaagaggggcgtgtagttatcctcatagctgtcgtcgaagttgtcgaggtcgccgtggtcgtagtggtagccgaaatcgtcgtagtcgaggatctcggttggtcgagaactgacgctaggggagctgaggtagccatccaactcttccgtcgagactatcccgagaggttggactataacgccaacctccctggatctagatcggatcggggccgaagccggagctcgcctagatcttcgagtaggagatgtcttgactgtgaagacagcggcaaatcatcaggaagtttcatcaggattgaaggataggacccgtcgtcttgatctggtcgcggaagagtagattggatctcgtccgagtggtttgaagccgactcgggagagatgatcttggagtaggcctcggccgagttcggaataccaaacgggacggggacctggtctctccccgactggtttgaatccgagtcaagaagagagatcttgccgaagtcgttcgtgatgaagttgaggctgccgaaccggaacgcctgcccgggagggaaggcgaagtcgtcgatgccagaaacgaaacctatcgcacttagtcggtgagaacttgacgctacccctacctagcgcgccaactgtcgaaacaagatttcggcaataataaaagggggtggctatcaagctaggaaagtggatgggtttggagacgaagaattttatacaagttcgggccttcttattcaagaagtaataccctactcctgtccggggatgattccgccgagtgtgttattgattgtataaattgggaaaaagaatcgcgcccaagaggcacacggaccctctttatataggggaaggagtccgctttacaaaatacaatccatatcctaacggaatatgggattatagataaaatacaaacgtaaccgactaagatcccgggtatttccttgacatacaagtttagaacctaacccgagtcttcatagagatattccatctatatttggtaccgtatatccgactaaattacaactgtcatgtagatatgggtatccataatctccacacatgccgccctccgacacccgcaccgcgaacccctgcgccgtgcccacgcgcgtgctgccggcggatggcccctccgtcagcgcgttgttcagcgccacgatgtcgccgaactgacgcggcaccgcgtcaccgccatcgtcgagcaaggagcggccggagacgacgcgcatggcggtgggagccgggccggtgtaggcgtcgtgcatgtagaaatggaggtgggtggtagtggtggaggcgccgttgcggtggaggaagatggcggctgcgaggaggaagcagccgaggaggagggaggagagggacgccatggtcgagcttgctgtgggctatgcttggctgcctgctttgtgtgtggttccaggcagcctttaatgcttacagctgctgtacttatatagaatcctagtcgatacaccacactttgccgtggaatatatagatgaatgcatattatacatgatagatatatatgtttaaataatatataaatgatgtggagataatggttcgacattgattacatatatattaagttctaaaaatacaacaatattataaatgatatgtcatatttatatgatatttaaaataatctatataataattactagtagatgatgatgtagcacacttgcatatctatctatctattatatactccctccatactcataaaggaagtcgtttaagacaacgacacggtctccaaaacacaactttgacttcttgtttctataaaaatatttattgaaaagtgatatatgtatacttttatgaaagtatttttcaagacaaatatattcatataatttttacattttcaaactcaacaatttgaaagttattcatgatttatattcttagggtttgacttaaacattgtcctaaacgacttcctttatgagtacggagggagtactaaaagtccactaaacttcctacaaacgctcctggatcgtcacgtggcactctacaaacgctcctaacctaccacgtggcaaagaaacatctaactattgatttttatttaaattagtggacccattatttttgaccattagattagatgtaaaaaaaaatagtccacccatcctaatccacttgggctcactattcccgcggatgtacatacacgtacgtactccgtatgctcctactccaattattatcttttaattctattatctttttatctctcatattttccttcttttaataaaaagcaaaatttatgtaaaaacatttagagattggtgttataggt

SEQ ID NO: 76237 - DNA, 7409 bp, Oryza sativa
ggcacccataacaccaggcacctttaatagactatgagtgtcggttaattaaaaaactgatacctttaatctattatatactaaatgtctattaaactttctacaaatgttcgtaatctgctatgtggcactcctacaaaagatgtagagccgctatgtgatgctctaataaattgtagaaattatgagaaaaaacaaaatatctagcagtcgattttcatttaaaatagtggacccaataatttaaaacatcatatcaaaataaaatccctcttacgtatgtaagtacgcctatcctcccctcatttactctttcttttttcttctttttctaattaaggtagttattacgagatatgcaccataacttaatattggaaatgataacttaatattggaaatggttatatctttccatgcatggagcatcgagctggctgtgcaacatgcaagcactaactttttttatggacgatctatacattaattttatgatacgcttgaatgattatatgtttaattaaattaattaatgagcgaagtcctatattcactctttttactatgttttcgatataaaaatagacatccgattggttatctgttttcgatatagaaatagacatccgattggtcatctaataggtaaaaaaagataagccgttagagatatagttacaggatgtgagttcctctgttacggtggccgattgtcacatagtctaaatgattatatataaacaatagatagctaaatgattagtatattttttaaatatattcagtttttagtttgatccatgtaggcttttcttgatatatgataaatatattttcagacataaatccatatcctttccgtgacaactaaacatcaattaaacattatataaaaattgataatatatcacatatcatcatctattagatgtccattacaacacctctatgtcttcacatttcacatctaataaattatttttaaaaatcatatttttgagaaaaaaatacatatgaccatcgattttatttaaattgatagacccttccctctcagaaaaactcagggctctcctcttctctcccccttcctattatttagctaaagtctattaaatttcctacaaacacttatagcttgtcacatgatgctctaataaattagaaatcaaagaaactatgcgagaaaacaaaacaactagcccacaattttcacttaatacggttgacataatattatactccatcattagatctatctttagaaaaaatccaaaacccatctccactgccccttcctcccgggcctcctctcctcacgatacaaacatcccccctctttccttccttccttcttttaattttctagctaacagatttttataaaaatcataaaaattctaataaatgtttagccattatttttctaaaattgatggacccattaattttaaccgttagatcttcatctaaaaagaaaatctgatacctgcatcctcaccaccacctccatatatgcgcacttacgtacttacgttctccctctaccctcctaactctccccttctctcctatttcttaagctaattgctattttttagctgatactcaatctatcaaaaattaataatcggatttctaaatgatcataaaactcaagttacatattttctcaattttttttgaattattgtgttatttataattaaatacataagtcaaaatccatatacatagctcaaacttctaatataaatgtttaagatcaaatttttaagcatcatattaaatactaaatattaaatttagatcatgtaacgccgctaaatcgccatgtggcaataataccaatccccctaaaccgacatgtgaccatctaataaattataaaaattcatataaattatattaaaaaaactaaccattgatttttttcaatatcctcaatcattagatctattcttaatcttaacctacttaaaaacttcaagatgattctgtcctctattgcttgatgatgacatccatgagtcagccgcacatactccgcgtatatgttgatccgttcacgagagagtccgcacgagagagagagcacgattctgagtcaaattgaaaaaaaaaacaccacatcatttgactcggctcactgaaagaaaaagtcaaatgaaaaaacatcttactttttatttgaaattaatttgtcagaccgatttttaacaaacaaatacatatgcccgcgcatcgcgcggactacctttctagttgagatttaaaagttagtgagcagcaattttatagtaagatgggatatactccctccatcagatgcatccgaaaagaatgttaattgtagagttgaaaaggcaatttagtagagaaggaaaataacttaggtatccctagggtttacactttcgatttcagtacgactgaaatttatgaaattttaggattttcggcaattttcggatcgaaattttctaaaatattgaatgaatttgaataaactttgaccaacttcaacaaaaatttgagaaaacccaaaaatttcggtcgatatattgatttgccggtggggaccaaaattgcaatcactggtatccctcattgaatgtgaagtttttgagaatgacataaaaactctagctaattgaattagaggtagtgtaatacagtaccacaatctccggggagtaaacaatcgtttgcttccagcgccgcaccagcattgacgacgttctcctgcatcttcaccggggaagctaggccaaaactgaggtgtggccatggagaaagaaaaaacggtctcaatagttaacagaggcacaaagatattgcgtgaatattcgcgtcgaacgagatcccgtgaatcgcttatctggacttgcttcagcggccacgttgattttctttttgttacgttgcattcgctatgcgcgaacatctcgttgatgccccgcgtgtttagtgggatttcaaaattcttactgataaacattgctgattaatctttgtatgtttctttttttttactcatcagttgttgtttttttcgataacataatgtggagtacgtgtttctcaagtaggctgctaagaaataacaaaatattttcttccgttggttgctaggccaacagccaactgcatacatgagatattttgctttgaagtaattatggcttgctttgaagtaattatggcttagtgcaggggtggagctagagtattgagggggtgtctgagagcccggtcaagaaaaatttgttgctatatttgatctattttcaccatgtgttcacctccatcaatcataggctgttgttaaatctgatcacctagctttttggaagaaagcctgaaacttaagaccaaagtcttatacgaaagaaagaactaccaaaagtaaactatatcggtcagaccaaattgggtatgacccgatgtgttctgcagtgagcccaaagcaccttgtaagacctctgataccaaccgcaagtaccacacatatttgaatgagtaggatccatatgtacaatcatatatatatatagccactcactctgaatgtgtccatgtccacgattggcatctttcaatataataaccacaacaccaagtaataagcaaaggagaaacctttgatagaatagttagccagttattaacttcaacctaagcatgttaaaccactcgaaggcaatgaccaagcaggatacttgtcttggggactcgagctataacactaaatttcacagtcatctcaattgctcaaaacttatactcttgcttcactaatcctgtgaaagcaactagcagcttgcactttataagcaaaacataaaaatattagagcatttgtgtcatatgaaaaataattctatagagcccattgaagaaaggactaatttttaaccaatcccctttaaaattctaacgaaatagactattgtagatgaatttcggagggagaataagcatgaggccccacctcccgtctatttttctgttgttgatgtgtatttttctgctatgccaatctactgatggtttggaaactttcctgtatttgaaaattctccataggaagtgaaatgatcatgatatagccgccttgcgctccgtgggtattggtaattaaataagtgaatagttgtgatgaaatgattgcagtttgtcaaagaagcattaattagatcagtgtacatacaagaccttttttcgcggtccgggtatatagcgaggtaagcagaagacaattgacaatttgagagacaacgaaataatcaaatattccggccgttgctgtacatgcgctatagagataaaaaatgctatgtgaacgatttcttcttatagacttatacgacggtcctagtgcgattgggaacgtatggtgaacgccaccatgcatggttagctgggaaacggacggtaaatgtcatgttctttcttcgcttttgcgtcgtgattctaggagagagccgttacgtcacacgaacatcgtatataacaagttactaactttttcttcaaactttcaacttttccatcacatcaaaactttgtacacacataagcttttaacttttttcttcaaactttcaattttagtcaaacttccaattttagcgtggaactaaacacaccctaaaataaataaatataatatatatatatatatatatatatatatatatatatatatatatatatatatatatatcagctctcatataaaatgaattcaagtgactgtcaggacaaatatggtacgtatgattgtaccgtgttcgacgaattttcaatactcttgggagccgcatataaagaagggataagagtatgcccaacaacctcctataattaggagatgaggggaccatatgaattttcaacgttctaacgggcctatagaaacaagcgaataagtatgagacgagagagacagcctatagaaacaagcgaataagtatgagacgagagagacagagataataaggtactggatgatatagatactaggaaattccccgcgctttgcttcggaaattactaagggggtaatttttaatatgttttttcaataatcgagctaagtgtaaaaaaaaatattagatattaacaacagataaaacaggtttgctaaactatgtaaggagagaaataaactttatagactctgtagcagattctggatgaaatatgatatcccacgcttctattacatggatgaatatatatgttaagtattataaaaatgttggatatgtatgttgaaaatattatgaaaataatgtgaatggtgatggttggatatacttgcacttttatttgcataatttaatgaattgtagatgatgctgcaatgtttgttggagcttagtacgcaattattagtaatggacgatgagatgacatgtttacacgttaagctttagctttagtgggctgtaactatatagcaggtatagatgtgacgatggccatttgagtgaaatcttgagttaattaaactatccataattacactagttaaaagtttgcgatagagaatgtttgagatatgagatctattaaatctaattgatggataaaatatacattttgacttagaacagactgtatatgctccctcagtaaaaaaaagtcctagttatgaatctaaacataaaattgggttagtcaatcgattcataaccatctttcgagcactatattaaaacctctttacttgcccgatcatatcttagatctgtaaattatgttatggtctacgttccactcatagcgatgtgcttgagtccaagggacagggggtcgtcttggggccagagagaatgaatagatagggccccacgagttgttaattggccgctggggaattcacatgaaagggaaggacttattctgaaccaaaaaagtgctcactaaaccgaacatgaaagttgttttccatcgttttccatcataaagctgttcacataacttcacttttgacttggattatatatcccatatatccaggtaccatattaagatgtgattggcatccctcggcaagcactggtatgtacttaccgtataataattgctccacaagtactagtatgtactacttaccgtataataatggattgatatgcatgttttttcttccttgtacatagacacccgagcacatgtcttgtgatatcttagcccaataagaattagacatgtgtagcccatgagagttgtatgcgcatgtttagtaccaccgaagggaggaccattacaaatggtatcagagccgaccctcgcggttgcgcgtatgggtcagtgtgagggcacatggcacatggcgcatgtggactttgcgtgaggcacatggcatggcatatgatgccaacactggacgttcgggcatgtgctaacagggggtgtgtttctatacctttgcttatatgcctgtgtagctatgtgggtgatttggaccgacggggacgtcgggtcctttgaggggggtgtgtgtcagacatcccgacccaataaggattaggcctgtgtaacccatgataactgtgtgcgcatgtttagtaccactttctagtttagcaagggtgcgcccttataaggcctcttccctcaaactatatcactccgggttaaccttttagacgaagtatggacaaaagtataagtgggatggtatgtgtaagtgggcccgtccgtcggatgggctggctacgcggttctggagggatgtgtgattgaggtgaagatggaatattagttcatgtggtagcttgaactactccatctaaaccataaaaactaacttctgctacaaaccgtacatagcctacatttatatttatagctaaaagttgaatttcttttatgggacagagagtatatatacgaagatagctatacatccatctaagattatatgggcacttctaagtgtgttaaatagcagaaataaatattgaggtaaatctctttgatgtacttggaagtttatataattatgtactctacttgactggaaaaatcacgcccaatgatgcaactatcaataattacctaatgatgcaactatcaataagtacaaatttgttggatgaattgaaaagtagtacactacttcacaaacgatttttccatgcgactaaaatcgattttcccagataggggatgacccgcctacacccagatgtccaaaaagtcagtatttttacatggggaagagcaactgcatgtgaaaatacagtattttcgcatgcgggcgcttaagctgtcataatgcaaaaagttaaatcgaatgaaaatgaacaatccaaaaccatagtgtaacgccccacttttcgcgagacgttaaaagctaatttattaaaaatcctaattgtgaaaatttcgtt

SEQ ID NO: 76238 - DNA, 8204 bp, Oryza sativa
  unsure (1)..(8204): unsure at all n locations
aattcctttttatgaaacccaattcccgagtatttcccctctctttgaaaccccatccaagtaattctagaacaatccccgagtatagatctatcccaggataatatccgttccaaataatctcgcctgaacccttctattcagatttctcttctaaatcccttacccacatatctcgtcgagtagtccaactcaaactcccaagttacactctccttctctaaattatttgactcgtctccgaatattgttcccttccttgactccttcctattatcccgagaccaagtatcgacttcgaaattcgaatccagactccagccctaaaaccttccaattaaatctctctgtgaaagtctatttaacctccctcataggttggattccttcttcctttttcctggtccacttcttccttctattccagcccatctctctccctctccctaaagtttggacctatcaatctacctacaccaatccgagagttcgaatttccgtattcggattcctcttgtaaaaccctatccgcatttgtcgtcaatcctcaaaattcaaactcattgattggttcatttcgtccctctctctttcgatcgatctacctatctacctatccatcgacctatctgtctctcgatctaatcatcgatctctctacctgtcaacccatctaactatccgtctaccgatctctctgttgatctatctatctctacgatatccatcggtccgtccgtctacctatctatctttgaaatctatcccaaagaaataccgaattcccgcttggatgcattcccttgactcctccctgttttcctgagaccaagtttcaagttcgaaatccaaattcaatttccaaatctcgtttcctccccggcgccgaatcccgccgcccccactttgaccgtgccggcccgcgctccgcgttcaaattcgaccgcttgatccaccgacctcgccgcccaacgcatcctcgccgttgccgttttcgggtcgcccacgaaaccatcgccccaccgccagccgagcgccagctcgtctgtgatctcccccttgcctataaatcctacccaccgagccccaaatcctccctcaacctcggtcgccgtcgcgcggccaaccccggagcaccgccgcctccttcgtcgccacggccaagaacgccgcgccgtcaccaaaccgtcccaccccgcgtcccttccttccctggtgcgcccgcttcggcgtcacgttcgtccccgtgcgccgccaacggccttcctccccttcccatcctcaaatcgccgccgacaccattcctcaccgattggtgagctccccgtccccttccccttaccgtacgccgaaccagctcgctgtcgccctcccggaactcctcgcgccccctctctgtttccccggccatgccactctcgatgctatgaccaccccgccgtgctctgttcccgccgacgccgcgctcggctgagcgccaccgttggccaccctctcggcgactccccgcgccaccacccgccttgagctcccttgaaccaccccaaacagtcgctctgcccgattcgctgccgccacgcatgaccgcgcgccgccgtcggccatcccctcgccgtatcctctcgtctccaccctcctggagccccctcgactctccccgaaccgccggcctagccgccggccttcttttttgttcccacgtcgtgccgcccgattcaccaccgcggcacacgggcgcgctctggcgtcggttcccccctttttttcgaacccgctcggcaacaccttcctcgggcccctcttgacctcccccttgctggcccgtggacaccggctctcccttcaattttcgcgcggcgcgcgccttttggttgcccgcccgccccgcgcacgagcaacaccggagaccatcagccttcgcgcccaacgcgtgtgcgtngcaacaccacaccgattcgatcgaaccatagcccgcgcccccttttccctcccatcgcgtatccacgtcggcaatccggcgagcttcgccaccgtcgccggccgccgtcgcgccccttctctccggtccgatccgtggaaccgattccccgcttcctcctctcgcttccagtgcctgccgcccactccgattcgccgccgttcgctggagcgcaccgagcgccgttggccatccgatgagccgcccggcctcctctcccttccctgtccgacgtggcgtccacctggacgccacctcagccgctgaccccaccagaccaagtcaacccctgcctagtcagccacccccccccccttctctctccccgctcgtgggcctggcccatcgaccagctccccctcctcggcccattgaaacaaaggaagtccatttttactccctccgccaaacacaatgaccaaaagtctatatctgctccctcccaattcacctctctctcaccatatgttggccccacatgtcaatgagtgataaaaggatattcttgagaatattcatttccataaatgcaataaatcatatctcctgctccataaaacatttcctatattccaaattccataaaatccttcctcttaatctggggattccaataattcaacccattggtcctgcatgtcagtgactgtcaataatattcttgagaatattatttctataaattctataagccatttctcgtactccaaaaaatccaatagatcatttccttgtccagaaatccaattaagcttccaaaatccatatctcctcaaccgctcgaccgattgactccgttctacttccagtagttccgtaaaattgatatcaatttaatggcactattaattagtctaaataggatctttctttcagtcttttggttaggtttttgattgtttgcgtatagttgcggttaccggattttcgtcaagcggatttcttgaagattcgtgaagatcaagaccctgagcaaggcaagccacctttgaacatattgagcctatatttgaacttaattaatttgcttgaaaaatattatgcattgataggattgcacttaatctatttgccccgtctgcaaggcagaccggtgggcctacccaacttgttgcatctgatccttccattgttaattgttatatcatgttcccttgtaactatctagttgcgcctcgatattcgtgcactctgtgcgagtatcgacggtctccttcaaacttaaaatctgtgtaacttcttgggtaaaacttggtttacaaaagctttggaaaacccgacgcctgggtcggtgccttgtgaaagaaaatgagttttaaaaataaaatttgcgacacaaggccattcctgggcggaatacttgtgcggtcgcatctaaggaccgattcctttggaattacatccgagcatacaatagtgcgaccacacgggtggaatgggacgcccctggctgagtaaatagctaatcaagggagccttgatgccaagagacatgtggattcaacggggtggtgtcggggagaacccccgggcttcctggcacagtatggtctgggacctaacctgttgttggtctgggactcctctcattggcatatggtaaccctgtgtcggctttcgaaataccttgtcgtgaaagccccaaagtcaccagacgtggctgttctgcacgggctgggtgaccaaggctagtaacgtcgtgtgggtatagtgtaccccctctacagaggttattaaactgttcgaacagccgtgcccacggtcatgggcgaatgtgaggtgattccttagcgtagtttttgttttaccctgttttatgaaaaggtgttaaggtttgggaaacctaatgcttgggaagcaattagctgtccgggggacagtgggaccggaagtccctggaagtgattggtcgtttggggaccactattattgggaagtttggaaaaatggtttggtttgggaaaaccagctttgaggccaactctgggagttgtgaaaatcttgataaataaatttgttacttctcaccccgactgagctgagacttgtctcgctctggttgtggaaagcacacacttagattgttgaaaaccttgaaaacaaaactgattgaaaaataacaacctattctttgaaacttgcattaaccacctaagttcccctggcttgctgagtacgtaagtactcacccttgctctctatataaatatagttctgccagctctgaagatgaagttgaagtgaagtgaagattagggtttcgtcctagaccccagccgtcgcctgtggtgttgggggttagtccgttgtttccgttgctgctgccgctgttggtgttgcctcgtccgtgtcgtcggttgtaatctcgggctgtcctgagttgcaacctaagttaaggtaaataagtcctctatttattctaaggattgcaatgattcatatttgtcaccgtgggtaccagcgctatgtcctgggactagtactgagatcgcggtttcgtaggaagcggttcgcgccgtttttcctacgacacgctcctatcaggtgccgttgtacggcgatgccggattggggtgtgacacatagcaactcctatgccccgcagccgttgccgccgcccccgctcccacccccggggttcgtcctcgctgttgctgatgccctccctacctcccatcagcattgccatccctaccgccaaccgccggatgcaccatcgctgcccacccaaccaccggatccattgccgccaagctctccaccgtcctccccaccaccggatccgccgctccctgctcctgtatgccgccggatccctctggtgctggccactcccgctcgtccgcccacttgccaccatcgttgtcgtcgtagccatcgccactatcatcgtggccgcggtggaggaagggggaggggggaggggatggccgcttgaggagggggcgagaagatatgaggagaagataagggagtggagtggagtgtggagaagttaggaaatgagatattttaagaggagagaataaagagagggaggggacgggtaaacggcttggtgccaggcgggcctattaagaagcctgcctacgaaaattgttttttcgcatgtggtctttgaaccacgctctcggggcagcgatttttgcaggcgggagcagtttaatttgccagcaacctcaaggggtctcatccgaaaaaatcgtttctatagtagcggtaattaatttagaaatatcttaatgtaaaatgtagtttgtgcgctgctgcctttaattgtccatgagaagacgcgttccaggcacgaacgtgaccggaacacacgacgctcacgctgcaaacatgcagacgtgctcatgcaaaaaatcgaaaatagacgagctacagtacagtacaatacatcacaggacgctggttacaactttaagcaagaacacatgaaatgaaaaggcataggcatgcaggagaggcgcgcgcgttctagctgtacgtagtgtgtcaggctgctagctagtgctgcaggtagacgtggatctcgacgacgccgccggcggcgaggctgtagtcgtagctgctgctggccatgtacccgcgcgcgagccggaaccggccggtgccgccgacgaccaccgactcgcgcacgccgacgccgacgtcgatccggcccttgatcgccaccgagctgccgcggtgctcgccggcctccatcaccaggtgcatgctcaggtccgtcaccaacccgccctccgacacccgcaccccgaacccctgcgccgtgcccacgcgcgcgctgccggcgtccggcccctccgtcagcgcgttgttcagcaccacgatgtccccgaactgccgcggcggcgacgagccgtcgacgatgtcggtggtggactgcagcaaggagcggccggagacgacgcgcatggcggtgggagccgggccggtgtaggcgtcgtgcatgtagaagtggaggtgggtggtggtggtggtggtggcgacggcgctgtcatggcggcgaaggaggacggcggccgcgatgaggaaggagcagccgaggaggagggaaggagacagggaggatgacgccgccatgatcgacgttatcgagcttgctttgtgtgtggttgctactggcaggcagccctcatatatacacacactatgtacgtactggtttatgatttgttagaatctagttttaaacttaaccaaattgatatttttttctccttgttttaaacgtgggtttatttattaagatactgactagaccacctttcttttgtttcgctttgttccagttgctttcgatccagtactacctccgtttcatttcaggttataaaactttctagcattgcccatatttatatagatgttaatgaatctagacacatatatatgtatgtgtagattcattaacacacacacacacacatatatatatatatatatatatatatatatatatatatatatatatatatatatatatatatatatggataatagtagaatatcttataatattaaacagaggaagtattagctaagtgcaaggaaatatagggtctgtttggggagcttaagattctgcgaagtagctggtcggtagccagcttatgagaatctggaaaagctgggtttcccagcttatagcttctaggctgtgtttagttcacactaaaattgaaagtttggatgaaattgtaacaatgtgatggaaaagttggaagtttgtgtgtgtaagaaagttttgatgtgatggaaaagttgaaagtttgaagaaaaactttggaactaaacatggccctagtttattttctggtttatacaattacagcttctcaaaatctagaccaaaagctgaactgtttgggggagcttctgattctggaagaaactgcagcagctagaagctctctcaaacagggtcaatccttgcatataatttttttactcctttcttgtcattttcgaaaagaaaaacttcgctttagttagtactactctattggttcttttgacgccgtcaatttttatatgcgttttaaccatttatcgtatttaaaaatcttatacaattatgcaaaaatagaagtcttaaatgataaaattaatcacaataaaacaaataataaaataaatgatattatagcatttttaataaaataaatgttttacatatgttaagtcaatgatgctaaagagatactatacacaagcatgatgtgtgggagtggtaataatatttaacaatgaaacatagagaggcgtttttaagggtggcatttctggttgtgtgcgagtccctcccgtaggggtgaaaatggagcggattcggacggatagtggtcataccatatcctaaatcattgaagttaaactttatccaccttacattacccagtgcaacacacaggcattgtgcttgtttaaagaaaaaaggaattagcaacatctatattagataagtttcattaaatttaacattgaatatattttgatgcaatatttgttttatattgaaatgttaccatattttgctataaatttggtcaaaattttaaaagtttgactaaaaaaagtcaaacgacttctaatataaaacggagggagtatgatttttcacatgcaggtctatttttaagatgtggtgcttttaacataaccgcctacgaaaatcgcaacaaaatataaaataatgggccgggtgatgggagtggcaaaactctcgcttaattatcctctcccccgtcccctcttaccctccatctccagtacagcgtggtagcgtgggaagcgggcttcggatccagtggagctcgatgaggagtacctctgtgatggcctccatcgcttctctccccctcccttgtgttgggattgctcactcacagctacaagtgttaatcacaaacacttttgtctctctggtgggaaatcacttcctctctctctctctctctaccgtatttttgccacaaaggcttctcaggtagacacacacaagcagcacaagatgcaagtttctgttgattcaaccacccacggcctcatcatttttctcattatatatagactcaaattacatgcaaaggataacaaccagccaattctcttgaccgggactcacgccatgcactaacaaactaaccctctatgcaaggctgcatgtacacctacatgcaagctaacaaccagaacgtgcatctatccactattgcgt

SEQ ID NO: 76239 - DNA, 4956 bp, Oryza sativa
tcaaatccaatttaaataaagcagtaaaaaaaactcaattaaaatgaacaaatgagagcagaattttgtcaattaaaactcaaatagatcatttttgcatgagagcgaataaataagacggacttacatagcgataaaataatgagaaattagatacatactaataataataataagagcataaatacctagcaacccatattcctgagttaggacctaatgcattcctcccatcaaatcccgactgactgtcgaataaatttcaaataattttactaaaaccctagactgacctaatttgacaaatctcacattaaatgagcgaccaagatttttcccttgaaccacaagaacagatcccaattttcccggaacaaatccaattgcaaagaacacatgcaatgaaaaggattgtcctacggtcaaggttggctctgataccaacttgtcacgcccagaaattcccgaatagaattccaagcagaatgtgcattaaaacccccgtctaggaccggccggggtacacaaacgataaagttgacatacagatcaacgtcttacaaacattataaaagtcttacataaatgcagcggaaaattaaaagataaatggagctaagccttaacttgaatttgcagcgggaacaccactccacaggcatcttagacgggacggacgaagcctactcttcggggaagccaccatctgacacgtactcaaactccgggttttggggaaaatagagttaggctgagtacaaccaccgtactcagcaagtcataccaaaatagggggtatgatgcagggtataatcaaggtatggctagaaaggttcatttgcataaagcgggcatttaaagacggtagttcaaagcagtaaaacagttgtagtaattaatcagtattaaccaatcactgtccaacgctacaccacgttgcaacaggcccaaccaaccacctgaactacaccagttcattagctaactaggggtgagactaatcacggtgaatctggttgaccgcccgtaaccgcgggcacggctattcgaatagttttactctgatcagaggtgtacaactgtacccacaagacacagccccacgacatgttaccgtgcgctgacatgccaccacgacataccgaaaagaggccgtgacaggacccttcgcataaccccctctagccaagcacaccacacctcaggtttcacccccgtccccagcgggcaacgggcagtcccctctcgtgcctaggtgaatccggaaggacagaggccgtcgcagggcccgtcccgctccatcacgcccacccttgcctggatgcgtcatctagaggaaagctacactacaagcccagccgttgcccacaatggcttgtggtaagtacgataagttcttccagggcatcccgcgaaccggtccttaattgctatgggcgcgaccatcaaaaccatgcacccacaacccaccatttaatatattttaattaaccaacaccggagcggtggcattaaccaacattattactagaatctgatatcaactcaataatgtattttccccattgtgtgttagttgaactaagcatggctaagtaatccctagtccaatatctagtcatgttatatccccaagctaacaaaggagcatggtacagaaatagcatggctgtaacagtaggtaaagatcccatagtaacattataaaacgatgcagtttttaaaggaaaacgatagagcatttgcaatataggatcaacatgttcaagtgacaagcatgacttgccttgctctgctgctggaggaacctcggcgactatttcaaagtacaccggagcgtcaggagagccggaatctaagcgacatacaaagcaaacaatgcaaacaggctataagactactgaaacagagaacaaaagcatttttaatggattttatgcatttttcttgatttactgcgacttgaataggcttaaacgaagctcggatgaattagatatgaattttagaagattcactgtgtttttactttaaacagaaaaatccttaattgatttattgcgcaatatatcccagggctgacgtcaacaagggagggacggcgccgacatgcgggccccacatggcagtgactcgggtggcggtccacggtggaccgggtccacggaccggggaaggaggcggcgcaccacgtggcgccgacgtggcgcacacgtggcagccatgtggcacgccacgcgggcggccgaaccgacggccccgatctacccgagggtagatcggatggcggcggggagcacgcggccggcgcgctcgggcggctcaagccggcccggcggccatggcgcacggcggcgctaacgcggggcggcggcggcagacggcggcgaccgatggcggcgtgatgagcggcggcggtgcgacggcgcggacggcgatagtggcggctaagcggctaggtggtggcgcggcggctaagtggcgcgggagagagagagaggaaggggagaggggaaaaggtgtctcaccgacggcgattgacgacggcaagcgacggagggcgatgacggcgacaggacaagctccggaaccacctagcgaacacggtgcaaggggttagagatgaagaggaaaatggaagagggcgaggacgccggccgaaggcggcggccatggcagtgctcaccggcgcacggcgcggagtgagttccggcggcggaatctgacaggagaggggtggacgaggtggcccgcacgacggcgaacgcgacgacgtctacggcgcggctcggcgcagcggcttgcgacggtagcgacgaccggagcggtgtcggcggcggcggaaaagaggacgacggcgctagggcgatgaagggcacgtgaacgcatggttgcaaacggaaatagagagaggagggaacggggaacctttatataggcccgcgggggtcgatcgtggccggggtgaccgcgattttgccggcgtagtgggaagaggtgggaaggacagagaggcgggattcaaaaattgaatcccggccgtctcgagcgcgggcgcgggcggtagagagagggagtgggcgcggggaaggcgggcatgagcggcgacgtgggcgacgtggcctagaatacgtgggagcgaggggtgacggcggttgcggtatgcggcggcgcggctgcaggtgggagacgggcccgacaggtgggccccacctgtcggtgaccccgggagagaggaggggctcgggcggccggctcagctgggtcgtggccttcggtcggcccagcggggagggggaggaggaagagaatgggccggcggcccattcgaaaaagaataaggggaaaaagaaaaagaaaaaggaggaaatgaattttcttgggattaaatattgcttgtgctcatttttgattggttaaaattatttctagagctatgaaaattccactaaaaatcttgttagcacatttcgacatgtagagctcaagaaaaattccacatgccaattccgattattatttgcattaatttatttagggtttcactcttgcttttacaccggtattttctcgagaccaattataaattcaattttggcttgggagaagaacttcagggtgtgacagttgcctcctgctcaaggacttaacaataagagccactatacagaggtaccacattgctaattaacataatgactaggtcagtccccattctagaaactgcggtcgcacccgttcgtttgacataagtacctggtgacaacttatatcgatcgagacagtactagccatccggaaatcatccaattcgtatgtcctgtcccaatctaagtataaaacattttaaccagattgtaagcaaaataagcaatactaaattatctgggtttctatggttgaattatgcatgtgaaagtagagtattgagtagaaaggttataaataaataacttgtaaaatataggcttaaacgatcaaaatgtgtatagtaacttgccttgctcgatgtcctgagattgactgatattatctaatgtgtcataagattcctcaagaccaagggttaaacatgtaaaattcaaattcaaaagggattcaaataaaatccaaaaataggtaaaaataaaataaaatataaaaatagcaaaagtggtctcaaaagatagagaatgattttagaagaattttggttcaagtttcactggaaatgaatctatattttaaaatatatgggcttctaaagtttgaaaatcaaattaaatgttaaatggtattgtgtgtgggtcccaccgatcagtctctccctctcttctcttcttcaacctccaactgttccccatttacggccggcggcgctagggttagggattatggcagtaataaagggggaaaggtgttgcggccgaggaggggaggtagatagggttccccggcgacggcgagcggcgccggaggggttaatttggtgtgtgagtaacctagcggctagggtggcggtgacatggatgagctgaaaaggtgatcggggtggtgagagttaggcatggctcagggaaggttcctagagcatctatgaggtgtctagaaggatttaagtagcttgccgacgttcggcaaggtatggaagatacttgctgacttgcgcctccattggcggtggtcgagctcacgtcggcagtcaagagggtgatgttagtgctaaccaattacgaaaatggaatctaaggagtatgtcgatggttaaaatggaagaactcaccgagataggttgaaacgacggattgcgaccggaaaaacctctcggcagcgaagaacagagcagagcaggggcggcagtgctcggctcggtgtgacgaggtgtcgacgcagagcttcggttaggctttagtatgctagaacatggttgaatataggtgttctatgggttggttagggtagagggtggatggagtg

SEQ ID NO: 76240 - DNA, 1171 bp, Oryza sativa
atcaattcagcgcgctgttttgcatcaaagttcactctctctgaagttgggaggggcaaaagatcaattggagtatggggcagaaggccataaacaatctcaaaagggcacttcttagtagtagaatgttgtgaacgattataagaaaactcaacatgaggcaaacattcttcccacattttaatattctttttcaaaacagccctaagcattgtagataatgttctagtcacaacctcggtttgtctatcagtttgggggcgacatgtagtagaaaataaaagtttagttcccaacttagcccacaaggttctccaaaaatgactaaggaattttgtatcgtgatcagaaactatggtgtttggcactccatgccagcgaacagtctcatgaaagaacaaatcagcaacatgtgtagcatcatcactcttatgacaaggtatgaaatgcgccatcttagaaaatctatctacaacaacaaagatactgtccctccccttctttgttctaggcagccctaaaacaaagtccatagaaatatcctcccaaggcacactaggaacatgcaaaggcatatacaaactatgagggttaaggcgtgacttagctttttggcatgttgtgcagtgagcaacgaacctctccacgtctctcctcatcttgggccaaaagaaatgatcagtaaggatatccttcgtcttcttcacaccaaagtttcccatcagccctccaccatgtgcttcctgcaataatagcatacgcacggagctagctggaatgcataacttattagctctaaacacaaacccattggtgagaacaaatttgttccaagtccttccctccttgcaatttaacaacacatctttaaaatcatcatcgtgcgcatattgctcttttattgtttacaagccaaaaattttgaagtcaagttgggatagcattgtgtaacgtctagacaaagcatcagcaatgacattttcttttcccttcttatgtttgatgacatatggaaaaaattcaataaattcaacccatttagcatgcctacggttaagttttgcttgacttcgaatgtgtttcaaagattcatgatcagagtgtataacaaattctttgggccataaataatgatgtcatgtttccaatgttcgcactagagcaaacaatt

SEQ ID NO: 76241 - DNA, 13080 bp, Oryza sativa
  unsure (1)..(13080): unsure at all n locations
acttctcaaggttaccaaataaacgtgcatctcgtagagcatcaaaaatagcaggcaaatgaccatgatgatcctctattgatctgttatatatgagaatgtcattaaaatataccaccacaaatctgccaatgaaagcacgtaaaacttcattcattaatctcatgaaagtactgggtgcattagtgataccaaagggcatgactaaccactcatataggccgaatttagttttaaaagctgttttccatttatctcctaacttcatgcgaatctagtggtaaccactacgcaaatcaattttagagaacacaagtgaaccactcaattcatcaagcatatcatctagcctagggataggatgaggatatctgattgtgatgttgttaattgctctacaattcacactcatgcgccatgagccatctttcttaggaactaaaagcacggggatagcacaaggactaggagactcacgcacataccccttgtcgagtaactcttgcacttgacgttgaatctcctttgtttcctccgagtgggtcctgtatggtacacggtttggcaaagaggccccaggaatgaggtcaatttggagctcaatccctcgaattggtggcagccccaatggaacttcctttgcgaaaacatcagcatactcctgcgaaatgttagtgaccggagaggcaaagaaatagagtatcctcaattggaaataaagtttgtttgcaaaccaaagcatagcaaacaacagtgtcagtgtcaacttcatccaaatctgattttgtttcaatgaaacaagatcccttcagcttaatctcatttttattattttgaatagagttggtggatttcttcttatgcttctcaagttcattagccacaatatgatgctagtatgctcctgtttttttgtttgctagctctagcaagttcattctttaaaataacttaaagagacataggatgtaacacaagtttttttccattatgcacaaaggagtattgattggatttgccaaagtgtaaggaatctttatcaaactgccatggcctacgtaataacatagaacaagcttgcatagacacaacatcatagttgattgaatcatgataagaaccaatggcaaaatgtactcttaccaatcgtgttacctttaccttgccgctgctattaagccattgaatatagtagggctgcggatgtggctgtgtgctcaatgcaagtttcttcaccatttcagcactaaattattgcagcttcatccatctatgatcatgcgacaagagcgttccttgatcacacacttggtttgaaacaaggtgtggcgctgattctgttcagccccttccatttatgcgcttagcactcgctgcaccacgaggctctcatagtcctctgcagcctcggccccaatgtgttcctcatcttggtggggcgcgtcgccttcccctgcattgttagttgcaagcaaagcataggtttcttcatctaaatcactagcggaggagtacccaccatcagctctcacgatcattacacgagtgcttggccagtccttgcgcacgtgaccaaagcccttgcagcgtaggcactgaatatctcttgtccttcctgataatgccactgatgatgagctcttggaagatgtagcagcaacccctcttgtgggttcactcgggcatggtgtagagtttgttgtagagggacgcaacttgttgcttgaggacgatggtgctgctgctcgagttgacggtgcagcagcgttggaaggggtccaagagctagcacgacctgcagaaatgttagtcctgaagccagctcttcgtccctgcacttccatttcagctttacaagcaagatgaaacaaacgatatattgaattatattctttgtaggctagaatgtcctgaatttctcggttcagcccacccatgaatctatccataccagcatcatcattttccaccaatccacagcaaagcattcctgtttgcaaagcttgataatactcttctacagatttgttttcttgtctaagttgttgcaatttatgcaacaaatcacgtgcatgatatgaaggaacaaatctagatcgcatgaatcttttcattgcatcccaggtttggggagtgttatttggattggaacaaacaaattcactccactaaatggatgcaaaatcagtgaactcactagtagcaaccctaacacgtttattctcaggaaaatcatggcaagcaaatttctgatcaatggctaactcccaagtaagatatgcatcagggtcatattttccatcaaagcaaggaatggtaaacttgatcttgcctaaagaatcatcattatcacgtgcctcccgccgtggtggagcgcccatgccatggcgctaccggcactgttgtcttcgttgacgaccaagtaccttctcatcatgctcggtgtcagcagcgtactctagttcttcccttgctgcgatgctgctattagcatcatggccattgtggttgcgcctagccgatccatcatgaccatctttgctcattctctccaatgtattcaagatacctgcaagagaagtgttcacagccacaagggacctctccaatgaggaggaaaacttggagttggtgtcaatttgagcagcctccaattgaccaaggcgatcattggcgaccctatttaggggtaggtatgacggttatacaatgcgaattgtcggaaatgccccgcaaccgccatcaggagatgatcaagaccgtccacgccaaaccccagcctggatggctgagattgtggttcggccgaacctcggctgaacctgggctagtgtcacgcccagaaatttagcccaaatttccagactattttgtgtattaaatccctgtccaggaccagccagggtacacaaaacaataagtaatatacagttccaaacgtaaataaagcgtaaaatacttacagaagatgcacttagtcctcacaccgaaacaaaagcagcagcagtggaaaaaggcgatcctagcggggcttcagcttcacttcacaggcaaaactcgactggggtctgagccttggtcttctaacctcgtcttcagctcagaagcactacacttctgnaaagggggaataatagcaagactgagtacaaccaccgtactcagcaaaccacaccaacgatgcagacgtgcaagggacaacaagacggttttgtgcatatttgcataaggcagttgtaaaacattttattgagcaaaatactaaaactgttgagtaattaaggtaatattaaatctccactgatcaacgctacaccacgatgaacaggcccaaccaacccacctgaactacagtgcattgagtcgattcattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggtcgtgacaggatccttcgcataaccctctctagccaagcacaccacacctcaggtttcacccccactcctcgcaaggcagcgggcaatcccctctcgtgcctaggtgaatccggaagcgacagaggccgtcgcagggcccgccccgctccatcacacccacccttgcctggatgcgtcggctagaggaaagctacactacaagcccagccgttgcccacgctggcttgtggtaagtacgagaaattcttccagggtttcccgtgaaccggtccttaattgccatgggtgcgactagcaaaaccatgcacccacagcccacccttcagtcgcattttagttggataattatgaccatgaagcatggccagatgtctcgagcacgcagctcattctgatactaaaaggtctaatattgtaattatcccatcaactgagctagtggtaattaagcatggctaagcatatagttctagctaggtcacataagtaacatgagctagtcgatttattacccaatgttgacaaaggacatatatcaagtaaatatggcacaagcgagcagataggtaaaccctgatcccatgtaattagcaaaacacgcatatttatttgcaaatagtaaaacatttgtaaattgggatcaacatgctaaaggggaatgtgtgacttgccttgcttcttcactttgatcttccgaactcttttcctcgtgaccgcggacttccgaaacgacgagaactacacgctggcacgcaaaacaaggaaaaactctaataaaaaccaagaaaacggtatataaaaagtaaacaaacatgtagagctcaattttagatgaattttgcaagttgaatggctcaattcggagttcgaatgaattagatatgaattttagaaggttttgagccattaaattaatatctataattattaccaaattattgcgcaattattaaatattttcacaaaggaaaaggactgccgctgacgttagcaagagagggggccggcgccgacaggcgggtcccaggcatcagtggctcaagggggctcggtccaccatggaccgggaccacaagggcggtccaccgcccgtccacgggatggacggcccagatcggcccaagccgatcgggcggctgaggagagcggtggccgggcacgggcacagccggggctggcccgaccgaccacagagggcggcggcgcgcagtcaccagcaacggcggggggcgggcggcacagggagcagcggcgcgcagcgcgggaagcggcgagaggaaacggaggcagtgagggagagggaggtggcggagctcaccgaggggcacggcgacggcgagagcagccggcggagggaggcggcggcgctccacaggtcgacaatgagaaggggctcccggcggcggaaggcggcgatcgggcggcggacggggaagagcgggacgcggcgaagccggcgatgcgttgcggcggcagccagggtgaagccgaacggcgaccggaggcggaaaaaggcggccggtagggtggtatggcaggaaggtggttctggtggtggaggggaaaaatggatggcggccgagcttgccctcgcggtggtaaagctaatgccggccgcggggtggctgagagcagtgaggtgtggccggaggcgacgaccggagtggcggaggaatggtacggcttgggtgggtggtggaggtgatgactcggccacggattggtggaacgaggcagtggccggtgctctgcttggagcggcgaagccgacactggcggtggtgcggcttggcggtggctagcgtggcgaggagaggcggccggagttcggcggcaagcggcggagagaggttacatggtggggaggtggttccgatggcggttgaaggaaaccgagtggaggccggcgtgcggcgcgggatggcgaagctgatggcacacgcgatgaggcgcggcgacggcgggagcagcggcggcgcgcggctggagatcgccggcgagcggcggcgatggggatcgacgtggagagctcggtagagggcgtgggggactcgggaaaacggggaaaaaggaagaggaggccacgaggattgattttacagctcaagggggcgaggagagggccggggagcggcggatttcgagggggagtggggcggcgtcttgggggtggtggcggcggtttttcgcgggacggagtgggggaggggagcggggtcgtgggtgacgaggtcccacggtcgggcaggagtggtgcagggtggaagaagttggcgggaaaagcggtgacgtggggcggctcgggcggccatggcggttgcagccggctagccagaggaaggaggaggaggggccgtgggtcccacctgtcggccaaagcaagagggggccggttaggggaggaaaagaggacttgagggagagggaggggaggagctgggccggcggcccaaaggagggaggagggcggccgggccggaggtgaagggggaaagaatttgggccgagcccaaaagggaggaaggggaagattattttattttctttttatttaaattgattaaatgaactttgtattattataattacttcttgagctccgaaaattcacggcaaaatttcagagaatatttagggcacaaagaatattacaaaatattctcgcccaatgatttttaaaggaaatttttaattccctcaatatttcacttgattaaattgctttaacttttatttaatttctggaaaatacattatttaatgatttttaatcccaacgaaaatcggggcgttacagctaggcccatctggcctggctctttgcgcatcttcccccctgaccttctctacctatttctcaggattttgggttgactctcgggtattttgatgaagttcataacccatccttgtatggatacataattctcctcactttagtctagatttcctcccaacatcgaggtttatcacctgctgacggagcatgggggtcctcaccgggagaccgcgcaggcccccctttgccggttcggccgggggcgctaagtgaggttcttcgccctcgatctgaggaacgtccgcgagagaggaagtgcacaagacacgggcgacgtagacaggttcgggccgctgggaagcgtaacaccctactcctgtgttctggtggatctgtgcgtgaaggaatacagagagctggagagcgagccagagttcagggtctagcacccattccccttttttctcctccctccagagtcccctttctttttttcttttctcttttctctccagagtccccccctcttaggcctgggcaccctttttatctggtcaggggtcaccacaagggcctccagctgcctaagaaaggaaacatgctttttacaatgagggctagtctacagccggaagtgacctctgacaagcagagcacacgcctcctgcccgctcgcccgcttttccggtggacgcccatttcaaccttcatttaatggccagcgacttccttgccatacttgcgctgaagcctggaatggttctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgactggtcacagaccggataagcgtgcgctgcgccgcattaaatgcggcgtggcgcgctcgtccaacctgttataaatgcggttaggtgagccccgcagtgctcacctaactcacacacgtggcgccaaaaccacagggggtcggggcgtcgcagccctcggggccgaaacgggggcgccccagccctcagggccgaaacgggagcggcccgacccctcggggagacagagggaggggtggccacgtcaccctcgggcccgaccccccccccccccgagggggtcaggccacgtgggtgaccgcggctacccaagcctctagtcacgatacccctggccccatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcagcaagggaaaaccgaccgacaataatgagcggcttctttaagactgctacattactcgagcagcgcgcgaatcgggacgagccggttcgtttcgcctggagacatgatgatggcgcttttcacggttggcgagcgtagttaatgcgcgcacgatctgccccatctcaaccgccacggccgcacatctgccgcgtgcgccgcaaacgagcgagtgggttagtggaggcgtgggcgcgagaagccgggtatagcattggcaagggtgtaaagacgtcgaggaagggattcgttcctttcctctcgccactctcccccttgccttcgccacttgtgctctaactcttcgtttcctgtgccctacccttgccgcactcgctcgctctcaagctcctcctccgccggcgtcatggcacggagctccgcaccgctcgacggtagcgtgctgccgccttcccgcatcgtgagcgagaggcaggccgggctgccgcgccgattcatgccagaatccgccaccggccgggaggtggtcgcgctgggcgagggacgcccgacaccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttattggggtgcgcccatctctccggctgttccggtggttcttcaccgtacagccggtgtcgccgccgacggtagtcggtggctgctacttccagccgcgggggcaggtgctgaaccgctacattctctgcgtcctccgcaaaaagtgggatgactggaagagcgattggttctacacccccctcgccgacgaagcgcgcctccgacttccgagccagcccccggcgcaggcctccagctggcgggcgacggtagatctgggagacggctacgacgccgttcttgaccgcctggcgggtctgcgatcccaggggctcacgggggccatggtgttcggtgactaccttcatcgccggatcgcgctgctccagcggcgcgcccggggcgcctgggtgtacaccgggcccgaggactacgtgaggacccaccaggggcgcaaatgggacttggaccctgaggacttcaggatggtggtccaacgggtgctgaatctcagctccgtggaggcatccctcatcccccaaggggtcctccccatctgctgcgatccagagcgcgccaagatcctggccatcatgtaggtggtcggggcgtcgggggagcgggccccccgaggccacgatggcgcgggcgggagccgcaggagggaacaatctaccccgggagggggtcgtgcttctgggccccgcgacgggggcccgggggtatccgccctaccgacgcccgggggaagaggaagcaggagggtacccctcccccatctcctccccgagggggcggggcggtgcgtgccagcagcaggcgcccggagggtgctgtgtcgacgccgcagcccgagggggagcgaaagaagaaacggctccgcaagatggggggaccgagccatgccgggagagcctcatctcgcccccgaggtggtcgtttagccgacatccccgcaggttcgtccccgcgcccaccgcgagttttcaaggcgagttttcactcacccgtttctttttgtcttctggtttttcttctgcctaagcgagatcccgtcgcgccctccccgccattccaagtccagccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggctagactccgccgggccggggagtccgtccgggaggcagaggcggcgcgcgcacgccaggcggcctgccaaacccccgacccgactccgcccgaggcgacgccgacttccgaggccacccacgacgaggccgcgggcgcgccgctcgggcccgacccctcgggcgacgcttgggacgagccaggttcgggggacgcccccgagtccggcacgtcgatcggcgggccgagccgcgcggcacccacactgaggcggctctcccctctgccttccgctgccccactgagcgcggagcccctcctgcaggccttggccgccgcgaacagcacggtgctggacgggttaagtgcccagatggaggccctgcatgcggagcgggcggagctcgacgcggcgtgggcgcacgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcgccaccgccgtgctcgacgaggcgcgggacgacctccgcctccaatacgggagccgggcggcggagctagaggagaagctcgacgctgcccggggagtccttgacgccgccgctgcccgggaacggcgggcggcggagaacaaggcggcgtcccggcagcgcgaagaggcccttgaggctcgcgccacagcgctggaggagcgcgcccgcgccctggacgcgaaggagagaaacctggcggaccgcgaggccgcctgcgctaaagaggagtccgcactccgcctccgcgaggacgcgctcaccgagcgggggcgaactctcgaagaggccgagcccgcggcgcagcgactggcgaacagcctgttcctccgcgaggcagcgcgggaggagcaggcgcgccgcaatctggaaggcgcccgcgccgagagggccgcactggatcagcgggccgctgagctcgaggcgcgggcgaaggagctggacgcgagagcgcacagcggcggggcggccgcgggccacggcgacctagccgcccgcctcgcagccgccgaacacaccatcgccgagctgcaggcgcgctggactcgtccgccggggaggtcgaggccctccgcttggcgagcgaggtagggcccggcatgcttcgggcagcaggcgggcctctggggcgggcggtacgcgaagtacaccgccaaccaggggggcctcgcccagcgcctctcagagatggccggggccctcgagcggctccccgaggagctcgaggagacgatcaagtcatcctcgagggacctcgcccgggggccggtggagctcgtactggcaagctaccaggccagggaccctgacttctccccgtgggcagcactggaagatttccctcccggaaccgaggacggcgcgcgcgcgcaggtccgggattccgccgaccacatcgtccacagctttgagggtacggcccctcggctcgcgttcgccctcgacttcgacgaggagggcggtgacgacagtgcggacgacagcgacgacgaggccggcgacccgggcgcgtcggagtgagcccccaaggccccgccaatcttaataacttttccttcttcttccgaggccttcgggccccctttttgtatagactgatttaatctgcaatcaagtaaagaggaaatttctgcgtcagttctgtttgttgtgtgtataagacgaggatggtctgtgccgcggtccttctgtgtcttggcttgaacaagggctagtgcccaggtcccagcctcaaacggcgcgggtcggggctagtgcctggggagatccacgtgtcgagactggccaggccgggagagcggtgaccgagggttatggatgacccgattgtgggcctttgccgattcccccccggagttcaccacgccccgggaaacggctcggttctgggccccatttggcgattttagccggcccgggccaccgagggcagggtcgagcacgagcgtgctaattcaagccaagattcttcaaaaggaaacgatggcacagacacagtcctcaggaaatcgaaaatgcttttattgaaatacggaagagaaaaaagataagtatatgcatgtggtagcccccggccaaccctgcacgcccgggggggtgcggggttggcccgagcccgagacatgacacccgacccccactaggggtagaagcgacgaaggtgttcgatgtttcacgggttaggcagctctgtgccgtcgcccgtggccagccgaatggagcccggccgggggacgccgatcactcgatacggaccctcccacattggtgagagcttgctcagtccggcacgcgtttggacgcggcgtaggacgaggtcgtcgacgcagagtgatcgggcccggacgtggcactgatggtagcgccgcaggctctgctggtagcgcgcgccgcgcgccgccttcgctcttccaaatagtcgaggtcgtctcggtgaagctgatcttgatcagcctcgcaatacatggtgacccgaggggacctcagggtgagctcagatgggaggaccacctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcattggcgcgctccacttggccattgcttctagggtgggcggggtaggcgaagcagagcttgatgcccatgtcttcgcagtagtcaccgaagagctcactagtgaactgggtgccattatccgtaatgatacggttgggcaccccaaaccgaacagtgatgcccctgatgaatttaagcgcggagtgcttatcgatcttgatgaccggataagcctcgggccacttagtgaacttgtcgacagcgacatacaaatactcgaacccgcccggggcccgcctgaacggacccaggatatcgagcccccagacagcaaacggccacgaaagaggtatggtctgcagggcctgggccggccgatgggtttgcctggcgtggaactggcacgccctgcaccgccggatcaggtcgaccgcatcgttgagagccgtcggccaatagaaaccctggcgaaaggccttgccaaccaaggtgcgtgaggcggagtgggctccacactcgccttcatggacatcggcgagaagctcgacgccttgttcccgaggaatgcacttcaggaggactccgttagccgcgcgccgatagagggtcccttccaccagcacgtagcgcttgaagatgcgccggacgcgttcactccctt

SEQ ID NO: 76242 - DNA, 7954 bp, Oryza sativa
attacctctataaaataagagattggtattaaaaatcaaattaccatgctaatctcgccatcagttccctcattcaaacttccaaccctcttccctcaggtttccaaacaagctaagagaggaatgtgcatatttaaaactcatatgagaacccccattaaatacttcatgtagggagttttttttcctctatagacgatttgacactcatatgtctaagacatgtatgacccacatgtaaacgagccattgggtagaacaacttgaaattgccacctgaaagagtgacaaatgctcgtgcttcagcctccccaatttccacaagagatcttgcttaatctgtgccccgtctgtgcatcaccataatccgtcgatgaactggccgcctcccaccatgcaccgataagtcctgcatcgtgattatttatgtcctttttgcattctctcttttctttttctctccctaggtttgatttaatacttggtcgatcgttttaattctctgatttctctttgttggatttgttctagttgtgttttgtcgttctgtcctgatctaacttcttggctctaagtagatttaggccgctgagtgaaaacaaattcccctatagatttaatgatctttttgtaattaatagtagccatatatctcctctagtcgatggtttcatggagaaagatttggtcttggtggtgcacgaaagaggcttgatctaggaagaaaggcgtcttctcagccatggattttctcctccttactcctgatagaaaagatattaacattccccttatagaacttagaaatatcaagatatcatttccttgatttttgattttgctaggtagataggttaaaccaggattttgaaaattcaacggtaactgttcgtttatcatggttattaaactaagtgttcaaagtcatgatgttgcttatgttgagggggtgctgccatttgagacataatcggtagcatgcagacctctaattaagtcaatggtaagtaggccagagcatgccaatcatgcctatggtagcataggggttagagtagattgcaatctaaaatataccttggtcacaagagaacattcatcactactaactactaacatgttaaatagagcattatccacaattgatctagattgcacacaaacacaacattgaacacaaaaaaaagcacaaagaaagaactcacaaacaaatagaacattgtcacacctcctttcttatcgccaccgtgtcaacttccctccgatcaccaggcgcggtcatatcgacctccctccctggccgacaccacgtcctcttttgaaatccgtcgccaccactttatgccttcttcctatacaattgctaatgttcttgaagaggttatatttaaaagagagcctcacatttatttaaaagcgctagttgatacgtcacacattgctgaagggcattgtggttattaaaaaaattgcaaaactttgtggttacaaacagatttggagaaattaaaacaccaaaaatagatgtgcaaaaataatcattgtgcttttcaagcccatcaaacgattagtggcctaatcatacgattagaaagttctcatgccaaatgtaatatgggtgtatagctcatcaaaagatcgagatggctcaaatcagataaaggatatcgatctaacgtgacccatatttatggattatgtggtctcatgtatcatcaactttcgataagtggttgcctcttattggttgtaattatatagataaatagatttgctatgctacttgctatagaaaatcagtcgaggagaaacttctcttttttgatagttgggtttacttgaagattcgtgtgtgggagtttcatttttacacacatttctttgtttgatagtagagaggagaattatatggagtatggatgggaattgaattctaagtgatgatgtacgactcagatttatctcctcatacttagaaggggattccctcccaattacctgcgcctacccagatattgaaaatgtgggagttcgctcttaaactctgcttcccaatctcttataaaactccaacgatttatcaacgaaacaatagacttaacagtccccacccctcaaactcacattccaatgtaactatttcccccaaccaaatgcgtcgtaagcgttgtgcgggaggctggactcgaatccgtgacacgtaatgtgcctttcacgtgccccaccattgagttataatctaatcacgtataatacttttgagttgtattgtaattacactattttcattatataacagtagttatatctaaaaacttttagagaagttctccaaaaaaaataatgtgtttttaacacaagagtctttgcagtttgtatgtgaggtttcaatagaagaatgaaaagaaaatgtctttcacacatatatgtgccagacggacggggtcatcttcctgagctagtcaaacccgtccacccgccgcccgccgcacgccggcgaaaaccagtcgcgcgcccgcatgggcggcagcgctgcggcggcgccgccggtgcccggaggtggctggaggaagccggcgtcgccttcgacggatccgaccgccgcgccttcaacgcgatgcccctcgccggcgcgcgcgtctccctcgcagaggccggccgcgccgtttgctcgctccgcgtgaccgtctagctcacggtacgcgccgcatcccatctccaccccacggcgccgcggtctgcttccgccgcgcgccgccgacgcgcgtccctccgctctcgccggcgttttcttgatttgatttgatttggttttgattttgacatcggcgcggcggcggcaggacgcggaggggaactggcacccgggggcgatcgcggcggcggcggacgacgtgtgcgcagcggcgatcatgtcggtggagggcatcatcaaggtctccgtccactacgacatctcctacttctcgccggccaagctccatgtccgtaaaccaacctactccccccattgccatttttttcctagcaatttcttgtcccaagacgccaatagaggagaaaaaaaaaataatagaacagaacagaacagcgaatagtttaggttagcacgacacaacacgatcacaatcaatcgatcaatggttgactcttcgtatttcttttttcaagcactacaaaaagtaacaagtaaattagattatcggcttggtcatgctggaacaagtatgattatattctgaataataagatttatagtttgcctttgtgttaaggaacctacattaacaggaaagctgattttttttagcgccaagaatttcgttttataactatctttatttaatgcacacacaaaaaaaactattttatttacatacaatgtgcaatactgcaatgtaaagcatagttgtgcttctctggagacttttatgaacaattacttcttggactagttaggcaagctctttcatgatcaagaattgaagattgcaaggttatcattcatttctgtcaattcaacttgggttgcttggttgtttctagtacaagcccctctaagccttttttagctaagatgcaccagaatcagaattcccagaagcaaccatgatacggtgatactgtagtagtcaaaacagcaaaatttgattcagtggcaccgaaagatcagcagttcaatttatagataaaactatattctgattatgtattctaagtttatagacctgaattcaagtcgtgtaaagataagttgttatctttcagtgtcaatgaaaccagatttttccaaaaagtttagtccggaacattttcggttgcagcacattgtgctttaagaacatattctagctagagcccaaaccaggcatctcctgtgtccagacgcttctctgttacgatccaatttgtactcgtcaaattaattccactgaagaaagtacttttcgaatcatgctcgctgctattctcattttcggaaacttcaacagagcaacatcattccattagcttctgaaaggttgaacaaaccttgaaaaagagactgaattgtgactgaggcctggtttagttcctaactttttcttcaaacttccaatttttccatcacatcaaaactttcctacacacacaaacttctaacttttccgtcacatcgttccaacttcaatcaaactttctattttagcatgaactaaacacagcctgatgcaaaacctccctgaactctgtactgcaggaggaagttgagctggacggcagggtggtggagcagaaagggaagatgacggcggtgacggtggagatccggaagaaggattccggcgagctggtggcgatcggccggcagtggatgtcgaccaccaggccaaagaaggatcaagctagcagcaagctgtgactctgaaccaggtatgcctacctagctcccaatggagttcttcagttcatctattgctcaccttagcaaccatcgaggtgattgtaacttttgtgtgttgcaagaaaaatctctctcattttttgtatcctgaaacatactgaattttaacttaattgaaagggtatagagaactagagagatccatgttgccaatgtgaattgtccaaaaaaaataagattctttctgtgattgtgaaaggggacagctggacaggttctatgttctaaaagcctcaaccactaactttaaaaacatctaaattactcctggactcctcgtcgtcgtgaaaggacgacggcaacgtgatcataaataaatttaaaattgcaatcgatattagcaaaatcctatcctatctgaaagggaagccatcgtgcaaaatacacgaagcttctcatcatggaggagatgaagaagagctttgctcggagagtgagccagtgaggcagtcaagctagcattagcaagggcggcgacatggacggcgagtcgccggcggcggcggcggcggcgctgcggctggccgccgtggcgaggaggtggctggagaacccccgggactcgctggcgaggagcagagaggaaggctgcggcgacgcgttcaacacggtggtgatgcccgggttccgcgtctccctcgccgagcccggccgcctcgtctgctccttctgcgtccccgccgccgtcgccgtacgtgcgtcctccttcctttcccggcggccatgtcggtcgccacgccgtgttcgttcgcactccgattcggtctcacctgcttgttcttggtttctgctgctgcggcggtggcggcggcggcgcaggacgcggacgggaggtggcacgccggggcgatggcggcggcggtggacaacctgtgcgcggcggtggtgtacacggcggacggcgtgcacaggttcaccatcagccaggccatgtccttcttctccccggccgcgcacggcgtacggttcctccatggatcatcatcttcatcttgctctcttctcctgtgaatcgggcagccgccattaacccgctcttctccggcgaatgatgattgcgcgcgcaggaggaggtggagatggatgggagggtggcgcaccggaaggggaagctgacgccgccgtggtggaggtgcggaggaaggcgtccggcgagctggtggcgatagggaggcagtggatgacctctactcgggcgaggccggagaagaatggcgagagcaggagcaaactctgaaacgaaaatttcctctaaaaatcgctttctcttcttttctgatttcatcatctcaacacctaaagaaaactgttgtaaattctcaagatagtgataatggcgtccattcgaaagtgccagtaacagtaagtaaactgttgtaaattctcaagatggtataaaagctcttttcttctattaatatcaagtaggagtatatgaatacaaagccagccacttcttttttctgtttttgctagggaagaaatgagtaattcagtatggacatgatcaatatgtacacattgcaggtcatgcaaaagcgtgccaacaaaattaaatcaaattacaagcatatcatctctatcttctcactttattcaccacaaggaatacccccaacttaattattccttaatctccctccaatgtccattaatctgaacaatccttttttgtccaaaataatctcaacaatccttttctccacaataatctcaacaatccgatcaagtcaatccccaagcctgcaaaaccaagacaagcccaatgtgagtaccacaaacaaatctcatcattctcaaccagctctgctctctacaattccttaaccaagaaacagaagaagaaaaaaaaatgcattttcttttccaaacctgaattctgccgtccgatgtcccgacgacgatgacatcgccgtcggcgtcgacggccatgcactggacccggccgctgccgccgccgccgccggcctggagagcgccgatcctggtcagcttctccctcgaccagatctccacgacgccattcctggagccgaggtacaccaggtccgagctcaccaccagcgacctcacctccaccgacgacggtatcgtcccgaccaggctgtagttcgagctgctccatatctgcacccagaaaaaagagaacaaaattcacatcctatttcatcatcaccacatgcctagaccagaaaccacactaatacatcgactgtgtgcatgaatttcacagggtacagttcagttctgattgaaatttcgtcaaactttgctgtgtttcaaacggagcctcgacatatttcatagttttggtcttctataggaatgacattttttttcggagagtttcaagtcgaaattgctatatttagcgcagttgtgttctcagcacgtactttcagataagaggaattttaaagttcttgaaaaagtaccttgaggtacctaaattttacactaaaaattttggtaccttgaaataattagtatctagatgtatcaaattttacagaagaaaacatagtacctctaggatggtaaaattactcttcacataaatgtttccagagttgaaagttgtatgatagagtcgactgttttgtatgaagtacacattttcagttgagagttatatgatttgagttcgaactttggcatgtttcaaactgtcaaaactttatcaagctttccgagtttttcatttttgcttttttattggtaccttgactgatgcgccgtcgagcgaggtgctgccggtgtagaggaggtcgccgtgaagatgcagagagtagatcgggctggccttgccgatgatcctcttgctcccttgctggatcacgccgatcgtcccgctcgccaggtcgatctcctgcacgccgccgtcgttgcagccgcagaagagcttcccgtgcaccagcgccatggatctcaccaccttgctcgcgttcaggaccttggcgccgccaccattgttccagcttagcacctgcaaaacacagaccaagttaggtggccatccatggaagcgcctcgccggatgatgtgatcggcgatcgatcaccttgacgccggagccctgcggcgcgaagcaggccatggcggcggcgacggcgaggctctgaaccgggtccttggcgtcgtggacctcgacgcaccggagggcgtctcggagctgccacacctggtgatcaggtgttcagcagagatgaacatgttaaatttctgaaattttgtgcgatcttttttgtttcatgattttgccaagaaaatttagacatactctgatagttctatccagtgatccactgaacagtttctcctctgagtgtagcactgctaagctggtgattgctttcgtgtgttcttgggattcatggactaggcgaaggatattctcacttccctcccagacctgaacatttaaattccacagatttctaaaactgaaactacaatgttatgatctcaggaaaaaaatttcggaattttgaaagagagaattaaaccttt

SEQ ID NO: 76243 - DNA, 3716 bp, Oryza sativa
gcggcggagagcaggtgtcgccggaggagcgggtcggcgatgagctccgcgaggaacgccgctgtgtgcgccaccaccgacgagtacgtcggcgtcggccccgccatgtctgacgagcacttcacacacaaacccatgggaaggttttgtctcgagggtcgtggaggcgaggtgacgcgcaaagactgaactgccccctcgagctccgagtagtcatgcctactcgagcaggggtaggaccgggatttcgtctccttggggtttaaattatggcgggagaggagaccggggcggcagcggccggcagcgcggccgcctgacgcgtggagggagacggtcgccgccgcgtcggaaaggaacgtttcggagggtctcgccgtggctgtttcatggaagtcaatatatgactctatagctatcttacaagttggaagatttattaatccagaggattatgttatgttaatcacatggttttcgaaattaagaaatgaagttttaagttgtctactattattagagtcgatatgactatgtgtgatatttccatggggggtaggtttcaaattaacgctgtaattgtcacccgaaacattagggatggccggatgagaacatgccaaatggagacaagagagacatcacatcacaaaatcagcgctagcgagagttggttgggatataattgatgcggaaaccagttaattaattatcatcttgttatgcaatcttagttcaaagatctttgtaatccagcttaatttaattatactaacttcgctattttttttaaagatcatccatcttattaaaaaaatacgtaaatgtcatttactttgttgccttattttatcatattaaacgtttttaatcataacttatattttatatatttacactaatattttttaaataacacaaatatcaaatatcatgttcaaaaaatcatatatatagcaccatacatttaaaagcagatagagtaattgtcacacttgtacatcggtaatttttttttaattaggtgttatttgtttgtggactatctatatatctatcaatatttttttcttaaatataaatttattataatttagtgtaattacataactacaaacaatataatttgtacatatagcttttagagacacttcaagggaggccgtgggattgaatcccctcatttgtatgtctatgctatgaatttttttccttccttgcttggacgaatctcggaacaaatctaacattccaaaattatgtgaaagttatacatagttatacaaaatctttttagcaaatcctattttttatttggcaaattaaatcgtttgtttgatgtgaggatgcatgcatgggttcttgaaaccaaccagggtgggtgacagccaaaatttttctctggaaacataattcaataatgtgaaagacgtagtactgcattccaagctgaaaatttcaaagtacaaatgagcaaattaatcacggcgacgaggccacgtaaacgtgggcacggtcaattatttctctgcaactagagcacttaacaacggtacggttacaagttgggtttaatttgcaaatcggttgatcatgtcgtcgaagttgcatgcagcagtggctcgatcacatgtccgccgccacggcgtcgtgcgcggcgccgccgtcggcgaggagcgggacgaagttgagcatgacgtcgacggcgttctgggcggcgatggcgaggaactcgccggcctcgttgccgagcgaggagccgccgccagcgaggtcggagagggagcggatggtgaggaacgggacggcgtgctggtgcgccacgagcgccacggcggcgctctccatctccaccggcgtgcacccgaacttggcccgcaggaactgacggtaggcggcgttgtcgaggaacacgttggcgctgcaccccctcctcaccctcgtcaccctcggcgcccgcggcaggcacgtcgtcgcgttcacgcacgccggcagctccatcccctgcaccaccaccaccgcgcgtgtgtcagacaaccaaccgatttttttttgaacttttttaatttttaattttaaaaataatttttttcaaaataaacttattttcagattttgaaccttctgaccacaccagcctgtctggctgaccagggttcaatctttagttttcgaacatatttaatcaaatttgaagaaaatatttccaaatttaaaaaatgaaaaaaaaatcggttgaaataatatcatatcaaaaaccgacggaaccgaaatttcattacggaattttgaaccctgaacataacaaaacaacattaatgcatgacagttttgtctaacgctggtcacgctagccagaccgatgagctcgtcgagctcagtatatgtatgtgtgtaccaaaatttcgttacacaattttgaaccatgggcgttacaaaacaacattaatgcacaccacacacaatgagagcgtgacagttttgtcttgccacacgcgatcaaataacgctggtcacgccagccaggccggtgatctcgttgagctcagtatatgtgtgtacctctagcttctcagcgagggagaagtagcgggagctgacggggacccagaaggcgtgttggcgctgctccggcttgccggagacggggaagatctcctcgggctggaaccagatgctgttgagctcgttgggggaggggccggcggcggtgtagtcggagaagttgaggaagccgaggtcgcgggtgtagtcgccggcggcctcgagcggcagctcgttctccgggccgtcgccgtagcgctgccagttccagagggagaggtgcgcccagtgctccgggatggtgacgtcgccgatctggaggccctcgtcggcgttgcgggcgatgccccagtgcacgatgcccttcaccctgaacaggctcagcagcagctgggtcgtcagcccagcattcagctgcatgatgcataatttgcagattaattaattattcgattagggaaaccgatcgattaataattaatactttctaacgtaaatcattctagcattgtttatattcatctagattacatctacaacagttttagttgagctacttttgataggtagtagcataattgcagtcatgtgtgtatagtagtacgtaccatgctaagccctgtcatgaccatgacaacgttttggcccccaatggcaccgaagcgaaaccttcgtccttaattaattacaaggaaaaatgaatcattagtgtgtgtgtgttaattaacgttttggtcgtgttaatcagttttcttcttgggtaaacgttcgctcgtccatttcaatttctgatcacagtatcaaacattcactattcaggtagcacatctctttctcgccatatgtacgtgagcttaattaagtcacacatatatcttgatcattaattatccgctgatagtgtgatgccactttcaggttattatattatcgcatgcacgctgtaattagcttcacgcatgcatgcatcgtccttaactaactgtccaattaatttactgatgaagaggctatagctgcatgaaattagcatatgcagtaagggcacccacaatggtaaagtaaggtgctctctataaaacatgtacatcttagcaatagactagctagattaatagtaaaccacctcaatagtatgtctatatgggtatttatagctctctaatccattg

SEQ ID NO: 76244 - DNA, 649 bp, Oryza sativa
gtgtataaaaaacttttggggtgacgggcaaatttgaagtggaaagaaaaaattgctaactagatccggccttgagtggaaagcagaatactgggtctatcccggctgggctcgggagcctggaccggtgctaccttaactggaccgtattctttagcagacctgagccggagaaatgggcttaagaaggaagagccttatgacacgtctctcaaatggtgtttctcacatacaaccagatgacgggtccaatcccaacttctcttgggaaattaacacatttgagtttcctaaattggaagatgaatcactcgaatggggcaacgccactaacacaaggcagtatcctagttctcaactggctcactcatgtcactgaataatctagaggggaaccttggcttcttgtcttaccttattaatagccgacaaatttggagcattaccttggatggctattctttcaccggggatgttcccgagcataccggatacctgtctgagcaatggaggatattttccgtgagcgataataagctaacgcgtggggtcccatcgtcactgttgaggttgagcaggcttgaacagcggcaacttgctggaaaccacgtcactgggccaatcccatatccataaccctgaagccaaa

SEQ ID NO: 76245 - DNA, 577 bp, Oryza sativa
atgaagcattagatgtagataaatgaaaaactaattacacaggtagggaggaaatcgcgagacgaatcttttaagtctaattagttcatgattaactataagtgctacagtaactcacatgtgctaatgacgggttaattaggctcaaaatattcgtctcgcggtttctagacgagttatgaaattagtttttttattcgtgtctgaaaaccccttccgacatccgtcaaacgtccaatatggcacccaaaaatttttatttcctcaactaaacacaccctaagtgaacacatttatatctggcaaggtggacgcggtggtgtgtaacctgaatttttttttagaaaaaaagacgcatcactctatatatacgtgtgtaccctgcaggacaagccagtgtcacacgacgcctccgaattcattttcgattcctctcctctcctctccttccaccgcctaacgaaccactcgccatcaaagcccccagagagcgcgccatggcggcgcagcggcggtggccgacgtcgacgctggcggcggtggcagtcgccgtagtagtactactggcggcgtcggc

SEQ ID NO: 76246 - DNA, 8203 bp, Oryza sativa
gacatcgccaccactcactcactcactcacgcactaccaccaccaccaccaccacaacaacaacaacaacaaaaagaacgagtcgaagactaccacgccacgagcaagatgagagcaagaacaaagcggagccaagaaaagagcaggcaagagctttttctccctcgcggcggtggtgatggtggtggtggggaattggagcggattgcgacctgaggggggcgagaactactactaccaccaccacccacaccgtccccagtggagtctactggcgacgcgacgtgggggagaagaagaagagagagagaggagggaataaaagcgcggggaatcgagcgggtcgaagggaggacgagccggggaggggaagaagaacacggcgagaatttctattatttttttgaaatttcttttattttaaaagcaagcatttctaaaaacttatttttaaaatgtggatcttttaatcatgtggttgaatggctaaataatactccctccggttttatagttcttgatgttttagataagattgtagtcaaatttttataactttcaatatcaatgactttaaaattatttaatttaaaagaatcaaaattatatatatatatatatatatatatattcgtctttcaaagttatataataaaaataagaatgcatttatttgttgtatatattatacagtaatagaaaacacaaagtcaaaatatatttcgaaaaccgtgtctttaatttggttgtactgcgttctgctacattaatttggttggcgtggcagaaacggatattgaaaagtattggaaaggtttatttttaaaattattaaaacgttcaaaagaaaaggaataagaaaaaaattcacacggcgacacctcctcctacccgcgcttttcggcgaagcaacccgttcctcctggggcccatctgtcagtgaagggggtgctgtcgagtgggaccgggttgtcaggctcacgcttgcttctctctcacggcgtgattatggcgggggcgttacgcgcgacggtgacttgggtgagggtggcgttactgcgaggtgggtcccacgcgtcagtgaaaggagggttactcctgctgctgtgtcctttttcgcggcgacacttgtcgtgtgagctaagggagaaggtgacgtgtcatgactcatactatgagagtactatatataattattattggatgagagagttgccatgtcaaatgtacgggtgaaaactgaagagtggcaattcttttccaaatgagttgacaaatttgatcgataaaagcaggcaaactaggggaaatatgcggtggtttcaaggaaaaattagcggtatatatatgcatttaagggcccgtttgatttgtagaaaaagtgtaggaacaatcctatagaaaaatttctatgaaagtttttgaaataaaggattgaatcatattatatcctttaaaattcttatggaatgggtaatcctatagagattttgaagagaaattagcaagaggtccaacctcttgaaaaaattcctttgagtctatctctctcatccgattcctgcgattttcctgtggtccaatcaaacggtcattcttatgtttttcctgtattttccaatcctctattttacacctgcattcctgttagaatcttgtgttttttctattcccccgtttttccatttctacaattcagaggagcactagatgatcacattaatatatatatgtaggaccacctagcgtagtgaaattaattgctactgatgggttgggtacgtaggataattcatcaattaccccgtctatactttttttctattataagatgaactttttttggctaataactattttactaaataaaaatatattagtagtacttttaagtacagatctaatggtattaaatttgtcccactgattatatcctaataggaaaatggttggtcatgttataacgaagcaaaatatgctttatttttcttaacagatgggataactaagcttgcaaatacctgggaaatggtgattcaagcaataggcacattattttttctattttttactgtggcatgtcgattttttaaaatacataattttgaattaaaatactcatgttgttctgggttgtcctaatatttgactatcaatttcgataaattattatagttccatacaatgagattccaaactcttagagattcaccataacaaatattctctctgtttcaaaataagtttattttttacatatctcacacataccaataaagaactagaatacccctgctttataaaatctcaatgcaactatttcttactaacttcaatataatgattacttaaaaaagaacttattttggaatggagaaataagtttcgtaatataacccacgtgttattaagctatacagatttttttaaattaatggtacatgtttcataatttaaaataaaggtagtattttgttagcgtggtttactctaggcctcacgtgtatcgcgggtacgcggtttgtgattatatggtctgatgtacagtcacaatatagattctgtgaccaccacaacctgacaaaccatcaacctatgtgtgcacatagtatacaagtgtcagcaccaaagatgatctacgcaacaagcctatggcagctagctagcaaggttaaatttggagtgttgtttgatatgacgtagacatggttaatgaagctatgattgatcttaatatgtggttgatacagctacgagcctatgatgggagtttgaagcatgattggttgatatttgctttatttgatctcttattctttaatcaattacttactatagctaacagtcttattcaagctagctagaatcggtgcgtatgcaagcaaagttaatcattaattgcatttgtcttctgtacaccgtttctgtggctgtgtttacttgcatgtcttataagattgacagcaggtaggagtagcaaatatatggaacaactgaaagtcagcaccaaattaatgacgttttgtgttgcaaattaaatcccgttgggaggttttatgcataaatgtgtgtcctgcaggctactggtagagtgctagtcgatgccctcgttttccacatttgattttggcagaaatactatgatcaattgattagatagttactgcgaaattgaaactaagggtatgtttgccacggctccagctccaactttatctcttctagagttgaaactcagacaaacagtttcaacttcatctaaataagaatggatatagctgaagcgctttcacaaaataaattagagatgtggagctgggtttaagatgctccacaatttaactctaaacctaacttatgaagttaatttaggagttcgagctctaccaacgagccctaaaagaatggcatgatcggtagcccaacgtattgaccaaaccgtttagcatacaaaactcgtgaacattgtcactgtctttggtttatatataagttgcccaaatttgctacatttattatgtctaaactcgagttggttaggttatcataatcagcatgacacggtgccagcgagatgaaaatctcgcagcaccattacacattaatgacacgtgggacctagatagtaaaaaaagtaatattttcatcgcggttgtggctacaaaccaaatgtatgtctaactcaaaggaattcgatcatgataaccaaaatctctattaattgagttaaccacattgcctgcatcatagtccttccaaatattttgttcattgtaatgattggaaatgtttggcaatcatcaactatttttttttcttttagaaagatcatcttatctgagcaattcatcatgcatgtaggacacaaaggtaacatgcaggaatctcagcactcatagcacgtgaattctgatggccaagcacagttctaaatttctaatggtttgagtctcctaagacaatataatcaaaccacggtaacatttcatcaagaatttacattctattgtccacaaattattcatgtctgaatttctctgaaaaatacagttagcatatcagtaaaaattattgaaatttaatttgcttcagccaccgtaggccccattgcagcattattacgccaattctgatctgtagggtacatttccctcatgacctctgctccaggccattgattttttttttcagcagcatagtccaaggacagcacatgcttcttctcctttaagagagggacggaaggtacctacctattgaaatgaaaagcagaggatgcatatctatatacatgattatggattagtttagttagttactccaatagtttctgcgtcaaaccataggttgtctatctccccaattgttattttaattattgtcaacaaacggattttttttatgtgcacaaattttccagaacataccacgaactatatatatcaatgattatatgtagtataattgtctataccttcaatttccttttctttaaaaaaaatataatcatataacccaatgcgttatgttccacgcatggtcaaatttccctgggaagaaagaaagacatattacatcgacctttttataccaaaaacatgacatcaaatcttgcaaagcaatagctcggtgcaaactctacacaagatcacacaacattacgccaaaaataaaaaggttgcagattcgacagtggccgttgctttcgatccttctgcccccaacatgctcacagcatcacatgtgtgtgtgactttgcactggccatgcacgcatgcacacatcgcgcaatatcaaaaatatgccatttcatttcatgcaggatgcaatatatcatctccacgcaagggtggattagcatgggcgcaatgaggactcgaacctccgctacttacgtgagtactattggagccctcataaaggtcactgttcttttctccaactagagttggatgtattaacgtatgattgattaagattttcatgtcacgtttttcaaactactaaacggtatgttttgtgtgaaaactttctatatgaaagttgctctaaaatatcatattaatctatttttaagtttataatagttaaaactcaatcaatcatacgttaataccacctcgttttatgtaaaaaacttaatcatcatcatcatcttcagaagaaaagaacaccaccaaagcccccacaaatttttttttgccacatgtagataggagagggctgtaactttgttctaagttgttcagacccacctattattttttttcttgaatatgccactgtctccactccacgcgtgcgttgtgttgtgtatattctgattcatgcacatcgccttcagctatagacaagccccatatgaacatcttttgatcgttttggaatttggataaacattccaaaggctaaacctcgatcatgtcctcatatgataacggccaccaattaaatatgagatatgaatatgaatatgatgcggtgacgcaccgggccggataacttagcctaatccccctttgtgatactagttcaaatcagtgacttaattagtgtgggattcgtcttgtcgtggaatagattgtacaactactctgcctagctctatccattttatttctgttgctttaagattttaaaatgggttaattttgtccttgcctccttggtggtaagttggcaacttcaaccttttcagaactccagttccgatataaattgaactgattcttgtaaaattcatataaaattcagtaatctcttttgtttggaggaaacctagtgtgtggatgtacgattccgctttgtgcatattaattatgcatgagagtctcagatggttgtatcatcttgatataattgattgagttcaataaaccttttattatttaaaaaatataaaaaaggaaaccaattccaataaaaattgaaccgattattgtaacattcccgtgtattgaaggaggcacggttggatagtaaagctagattgagagatctaaccgtgtccatgtgcgacaaaccatttctccatgaggacaagcaaaattattctccaataattcttttgccttgagggctccacagaccacttacataaaatacatgactacatgaattcctccatggctccatcctgcatgcaaagccatccacaaaaaaggagccctctcccagcacaagtggatcggacggttgagttcaatcttggagagcactcacaccgtctagtcgcgtcaagaaaccaaaaaaatcattgacctcaaggcacatcagccactgttcaggatgaacaccacgccacattggaataatctgtactggtctggcagtggcatgtatgtacatgatgatggcaatattgaagactagaaagaaaaaggccaagaagtggctttgctaggtgaattaagggtgtgtttggttcctaaccatactttgttgtcatttatcaataaatattgtcacacggtctaagttgaggcgattaaattattggccacaccttagtaagtctaagagaatcttgttacatttttctaagtcaatgacacgtgagactcagtttattagaaaagaatcttgtcatagctatggctacaacaaacagctgctaatgggattaaatctatctaatcttagatgtagtaaacagcagtgtggctcgcaaccaaacaccctctaaacattgacatgcaaaacaaacgccgccgtggctgctgctggtagcaagctgcaatcagaggtccaagaggagtactactgtaccagccatgttcactgcccggccagggcagtcaacttgtctgtagttggttaatccaatcaaagtagcagcagatttagtgagatttcaatcagctaagcaattgcaagtaaatgcgtgttagtaaggcaaagtttgcatgcatattttattttaaccccagtgcttaagctgatggaaaattaaagggcatatatggatagatcagttcaacctaaaactatcccctaaaaaaaaagttcaacctaaaacttgactagtagagaagaacgggcaatgcacttaggggcagagctaggtaggagagaggggtgcccagaaacctggccaagaaaatttttttagctatagtttttctatttttactatatatgtacctccttaatccaaactcaaatactcatattagcttaaacttgatttaaagtagagtaaagcaagtgaatggtacatctctctatttcgttttagctccgcccctaaattgtcttatactcccaacgaacaatgcagaagagacaggattggtgacattggggcctcggactcaagaaggaagcttccaccctccaactaatggaaggtgccattgctcagcagaaaaaaagggagaaatcgacacccaacttcggaagtgcacgctgctatcaactctcggaaagaagcctcacgtcgtctccagcttgtagttcagaaaagttgccaacgcatgctccggctcggctgctcatcagcgtgtgcactctccactcaccatcagatatttttcatgaaaaaagcactagcctgtattttacttttggaagaaaagaaagccccttgctcacaatggctcgcacacagaaatccgtacattgtttgtacgaggtgaagtgaacgtcctgcttccccatcaagaagaatcatcactctgcaaggctgcaggtgcaacaaactgcataaatgatagtagtagtataccttaatgcaacttctgaatctcccctgttgtgatcaagaattcaaatggacaaaaacacaggattactgtcttactgatagctttgcttttagctttgaagaagctttccttgtgatatataacagactgatgagtcatatatatacatagcagatgctggcttgattactctcacttactttcagttctattggtggttgcaacatacggtgcaaccgtgcaactggaagcgacgaccagagaattacagtcatcaaaactacattactacatgcatgtacagcagataacattgtccatcgaatctgttcgtgctcagtttagctcagatacacgtttttacaagtcagcttacaaacagtggaatgcccacacaacaaatgctatttacccatttttactgagcacatggttagcttgaccttaaatggtgagtggcagctgatgcttctcaccgttgggcgtatgtacgcagt

SEQ ID NO: 76247 - DNA, 5606 bp, Oryza sativa
  unsure (1)..(5606): unsure at all n locations
cccccccccccccccgagggggtcaggccacgtgggtgaccgcggctacccaagcctctagtcacgatacccccggccccatgtcaccgacacctgcatatacatatacacgaacacttgtggaatatgtgagattaagcacctatcactatattggatgttttattatctgaactttatgcagatgttgtcggtatagaatctgcatttaacatccgccaacattcactaaggtttagggtaaaggaaataattagggtaggttaaaagagttctaaagaaataatacttgaaccaaaattaagaataaaaagagttcaaataacaatgattttaattttgctaatatagtcaaaagccagcatgatgcagtcaaattttagtttaaaatttgaggatgttacaaacctacccaccttaaataaatctcatcccgagatttgcttaggagtcttcaaaaagatacgggaattccaattgtaaataatcttcccgtttccaggttgcttggtcctctgtatggtgattccattggactttaaacaactttattaccttagtgcgagttgttctttgtgcttcatccaaaatagtagcatacaacataaagagtctcatgaaagaatcacatattcattaaccaataatgagttatctatttcaaggaacaatatcggataaatatgtaaatatagtatgtgatacaatcatctctatgattgcctctagggcttatcaccaacaggtatgatggttatggaacgcgaaaagacacttctgccctccaaccgtcatttaggagctcatctagaccatccacgcgaagccccagttcgaacggctgtggtagtggttggccgaaccatgggttcgaccaaacccaggtctggctcgacagagcccatcttcggcctgttgctccttctctgcgtcctctatccatttctgtgagtggaaagcccatttgaagatgttttctggtagtttttggcccactcttggtatggataggaattattcttcactcaagtctatttttggtccaactttggtggtttattacctgcatacaaatatacaccaacactcgtggaatatgtcagaatttaaccctatcactatgttggatgttttatttccttgatttatgcaggtattggtggcataaagtctgtcattaacaacagccaacagcctcatagttaaaatcctccattctcgcattagcaagttgcttttggtgcaaagttaactggcgggtatattgtcttgtgctaacccctgctcgagttcgctttgtattcttgcctttgtgcagtcatgaggagacggctctcccacttgctcaagggatccggctcccgatccaaccagtcgagcgatcgggcatctgccgacgtgtcaatggagaacactgacgctgtaccacagctcctgaccgacaacgacctcgatatcgttgacagacgagagaaacaagcctaccagatgctgaaggaccgatcattcgctcacaaccgagcgtacgatccaaagctactccggaaaacaagtatggatgtagattttagtgtcatttggagaaccatgggttggcacgcctttgcaacggtagacgagcttggctcttgtctactaactatacagtttctgtgcacacttaggctcttgtctactaactatacagtttctctgcacacttagagaagcagagggtggtgttactttttgacttttccgtaaagagtttaatcttttatgtagtggattgagcacacttctcggtttccccgaatcctgtagagtcgatttttggaaggcaacttccggttttgagaaaaacatattctgtgaagatatttctggtgcaccgatttataagaaacccagaaccaatgacatccataatctaactcttaggcttatgtacaaatggattgccatgtctctgataatgaattgattattctatatgccatggttcattagaaactattaagtgtggcggaaggggcggacgctgggcgtgtccacgtcggattttgctacagtagctacagtgcgaggttggatttttgcgaaaaagccctccggttcttcgtaatcaggtataggcccctcgcgtcctgtgtttgaagagaaaaaatcgcggacaggggcttcgttgtgatatgtggaagacgaggggctttttcgaaaaaatactcccactagcgcagacccctcaaaccctagccgcttgctctccctctctcgcgccgctaccaagcactggcgcttcgccttcccctcacgccgttcccgtcgcctcgcgccggcgacttcacccccgtcgncgactgcccatcgagctggcaccttcgactcccgcgtccccatcgccggccgagctgccgccgtccgtctcccctccgccctctcttcccccactctctccttctccctttccctctccctccgccgtctcctcccccaccctcgcctccgccttcccctcgcgccattgcctccgcctacgcagccgctgtcgtcgcgtcaccgtctccaagcgcctctgcttccgcatccccctcgcgtcgtcgccatcatcgtccccgtcgccctgcgccgctggcgccattgcgtcgccgtctccgaccgccgtcaccgagtgcagccgtctccgcctccggcatccgtcaacgacgaggtcggagcgccgacggctgcatcacaggcggcgcgaaaagctgagggcccaatcctggcggcgggactgccgcgaggttccggacgcatcaactcgagggggagacggcggagggagtgggggttgaggcgggcgcggtcttcgtcctcccggcgccagatctgcttctcatctccacaaggacaccccagcccaccactcatcggcgtcgccatggtcgtcggcgtcgccctcactgtcgccgtcgccaacagactgcgttaagaagccacttcaccaccagcagcagcaggggcatccaccgtacgccgcaccaatgccttccccttccctcccatctgtgccctctgggtcacaggtagtcgcttcatcggcagccgcgttgccgtcaatgtacaaggccaatgaccagcagcgagcaactcatggcaccagagacggcggtggcgacggtgactactaaactcttggcacaggagcttacaaaggatgtgcaggtttgtgtgagttgttcttttaaggttgccatgaggaatagttaatctcgttttttcccctatacaccatgaattgttgcacatcaacattgacagtgattttcatttttttattaatgcaatggagcaacctaactattataccaatttaccaggtgctctaatgccactgttggtgatgaaattttgagagaccctaatcttgccatgtttatgatgttctacagaacctgcatccattccatctaaaagaactcatcagctgggattgaagtactgatcagatctttttttctaggtgaactctagaagaaagttcgaaaaatgggacattgcaatcacaacattggaacctaatatcaacactatgctcattgccataggttctcccatttgtatagcatttagagatttctttttttataaaaaaattgtgaacaatttccataaactcacatcaaggtgtctcatgcagtgccaagtaaagaaagggactacaatgcttattcaaaggattatatgtcttccatagtgaagcagtcttgcactaatactagaagctgctttagagatggagacatcccatcaaaaatctgcaattacccaatgagtgagccattttttccccatgataacttactatttcagatatgtatttctatacatgtggcaccttttcattctagtgtttttttgactgggcttttcattccagtgttgtgcctgaggatcatataaatgactctgatcaatcctccacctaagctggttgctctgcttgctgtgaccatgccacgacatccgaaaacacagaggaccaggttggttagcatatttcatactcggtgccctctggaacnatcgatagagaatcacttctagcnatctgttatgattcatttccagatgcattaatctattctctttcttagtacttacttgggtattttaggttttcttggggcttagttatagaatagggttttggagtgggtttgtgaggggtgattgaaaagttgaaactcttttgccgcgaataaatctgcagtaacatgcctatcatttcacttcagagccaatgcatttgggtaatgtctcaaaatttgttttgtatttggtggtttcggcttttttggttgaaggaatctgcaatatatcatgcttccccaatgagtgagccattttttccccatggttacttaatatttcagatttgtatttctatacatgtggcaccttttcattccagtgttgtgcttgaggatcatataaacgactctgatcaatcctccaccatagctggttgttctgcttgctgtgaccatgccatgacatctgaaaacacagaggaccaggttggttagctatatttcatactcgttgccctctgaacaatcaatagcgaatcacttctagcaatctgttatgattcatttctagatgcattaatctattctctttcttagtatttttcttggtattttaggttttcttgggacttagttatagaataggattttggagtgtgtttgtggaaaaatttagaagcttcacatactggatgaatttttttagtagttagcgtattggttattggcagtcaaatttttttagtacaactggtaggaggatgagcttatatttggcactattattcaaaagatgttaatctcaatctcccattttactgtacttaatgtttcttaaatgttaaatacttaaaatgggactgcagttggtcactgatggttgcttgatagccataaggaaaagagagacaaaaataattaattcatgcagaggtttcagtcaattgcaaataatatgagattggttgacttaaaattgaggatggtgtggtatgatgagcctctgttgatctgatcattttcctttttcatgtcaggtttgacacctttggattgcataccagaattttccatgttcttcagctctcaataattcatcttcaggtaatatgatggtagtccaggtttttagatgatttgcatcaaggggtgaaaataaattgatcagcactgcaacattgatctttcttatgggttgtcgctttagctaccacaatgcttatttgcaagctcgtgatgtgttgcaaggtctagagtagtctagtgaaacctatgtcataagcgccacaattccaaaccgaacctcccccagtgtactgttcgatgtggctgctatagttcttttactaaaagtatgtaaatttatttgttctatggcttgtgtagaggagaaagggaagtgaggaaaatttgtaagtgaagaatttgacagattgcgacgggcaccagttatgctggtaattttcttgaacctgacactaatttcagggtacgtacattcttaatccaagccacaacaatgtctgagtggttttatatgtcgaccatctg

SEQ ID NO: 76248 - DNA, 7186 bp, Oryza sativa
tgaaatgctacctcacagtgttacatgattatgatgttctttcttctttcttttccttttggcatgataaaatgaaaacaggatagaagttggtttaattatgaaaaggccatggattttctacagcattatctgtggtgacttatttgctactcttcatgcactcaatgctaaccaaatgcatgaatagaatgagaaaatagtcccaggtatcgggaaactgtatcagacacatgcccattcattctaacaacatttcagtttgattctcaaaattcttcatgccatcaaagtaaatactatctgcactgtctcaaatcaactacaaagctgtcaataaaaaaacgacaaagaaagggaagaaatggtgaagatagagcttactacttattttaagcacatgtcttgattctcttgagggctcaatcacggacccctttggtaatttgtattcatccttgaaaagtgaaatgaaactgtggagaccaaggtgtcaaagacagaagaaacttgtgtagttatcattttaactcgacaaaggtatgctaagattggaacttacgcattaacaaaaaaaagtggaacaacattatttactaaatagagtgacaaacctgaaactataatatgatttatttttctcagctgatgattagttctgaatcagtattgctcttcttcacaaatgacctctctctctctctcagcatgatgacagcattatttctatacatgaggatattgtgtatccggataagaatagcattatttgtaggtaagacatataagaagtaaatatatttctaatttataaactgagaatgtattattaagtgctttaacatgtcatatgcagaagttgctggaatgctagataatcttgtcctcttttaaacatagcatgggaattatagtagaatcaagatgctttcctttgcttggtaaaaatgttttggactgcatttcagaactcagaccatcatctatttcagtgtaattacattattctgcagaaagacacacaaaactgtcatggaaatatggaatagatagttctatatttataaggcatatagttcttaattcatttaatcaagccgagtgctattttgtgtggttcatgaatctttgcattacctgtaaagctgtggtttatatatttctttgggagctaggttcgcttggtaatataattgactggtagtaatatacattggttgcactttgaatgtgctgagaatggggtcaccttgcatgcttttttatattcttaaataatgatgaattttcatgtgaatgtatgtatagcatccacattgttcatgtcactgattaggaaaaatgtattatttgttcatgtatatatcatttgttctgtgttactataggctggaggctatagaaaaatatttcagccttgaaacagtcaaggacattgtggaagccatggtgagtgatgcttcagttgttttatacttccaaatctctgggcatggtatgtgctccttttcatttgaacatgagtaaacagaatgctgttgattggtacaatagctttcaaggctacattttatttccatctcattatttactcaaatgaatctcgtggatatttttttttggaattatcaagtattttttcaaatatagtagttatcgttaccgttttggcatagattttgttccttagactaccttttagtttgatcttgaaggttttggttccatatagcatatacataaattttgcttatggttcaaaacttttaaggagatgttgtaaacttgtaatcaggaaagtgaagcatctaagttagatgaggattgttgtaccttggccatgaaatgattgagagagccctatccagttctgttgagagcctcacagtgtttggtaagtaaagaaaatagaaatgctcacactgccattgccgatggctgacagattttattatatgcctgtcctacagatgaattgcaagctacaaatgctttgctgtagatatgaattgcaagcttacagaaaaggttgtgcactgtgggctaaaaagtcccattaaccaggaaggtgagtgttgtttttctcctttaatataagaatttgctacctcaattttttttactcatgtcagcactgagatataatactgatacatggattgatgctgaattatatacatactccctccgttttttaatagatgacgccattgacttttcctcacatgtttaatcattcatcttattcaaaaattttatgcaaatgtataagatataaatcgcacttaaagtactatgagtgataaaacaactcataacaaaataaattataatttcgtaaattttttgaataagacaaatggtcaaacatgtgagaaaaagtcaacagcgtcatctattaaaaaacggaggtagtatttctctagcttttactcatacgattaagatttcttttaaatgtcaatatatcttctttttatgtatttaagcgtccctttgtgcttttatttttggtttgcaagttgtttatgtatttcatttaagaaaggtgtatggattacatgtatataatcctcgcaaaaaatgcatgtatatattgtggatttagccatctattttccctgctctttcatgctttcaaaagggccagcggtcacttggtattgtgtgggtgctctgcacatgactatttttataaatatgtaaatcatgtttgcgtatccctgcatcttatgctagacgttgattagttttcagcaaaaaattgggaagttatacttggttgaaatcagtattttgtcgatggttgtcataaatatatcaaaagttctaaactagaaaaaaaatggtatccccaaatctaaaatatttccttatgagttcacgttaaatgaaatggcctcatgcatatacagatgagtatctaatggaatgattcactcatttaccaaaaagatagtacaatattattcatcatagaatgctaccatcaccgccactatgtttttttatattagtaaaagatggatgagcctttggagacttattagttattaagttacttatgcttttctcactttcagcttgaaggatactaatattagtaattccacaaatgacacaatagatatgctacaattttggctccacttacactatcctgtatatggctacaaaactgcagctgtgagaagatagaatggcattacttcaagggtaaaatcctttttttttttggtttataacttgatgaatgtgattttgcaaaatactcctatatattgctgctacctcataaaaatacatccatggatcaatgttcctctagcactgataggcctagaaacaaggttgtccttttttcccttagtgtgtgcgcactatgataagatgttactattagggtattagtatgtacctgcaggtctgcaggttcttttgaatgtgatttaattagctaatgtttgctttcatttcaacctgtttacatttttcaggatgtgatgcgatgctgaatctaatattggaaagtcgagccctttgttcttcaattgtcctatttgcaaagattatgacctttaaatttgtcatcaattatttatgacaccaatgcattctcttggtgtatgtaccaaagcaatttgtacgcggaattacttatattttttatataatgaaagcattgtgttcatgtttgaactaatagtgtaacaaactgaggttttagtaggggatgctttgcattgataataaagtgcccattactttgtagttacatgggatatttgttacatagaatggattactgactcaagtctggtgtcattgatatacacaggagagttaatatagaatatatgatgttactaatatatttatcaattgattgatttagtacatggacgtattttagtgtatgcaggcagcgcgcaatggcgcgccctagcatctagtaaaattaaagtttctcctgtgcaacctatgagtaggcaatggttacaaagtataaagttccctgctccagttgatctgttctgtctctcaattgcctaaggtggtgagaagcgggtgttctacaatttttaggcgtaagggtaagcctccgtgcacatttacttaacatgagagagagagtactcaaactatgcacttgtacattttaaatataacaatggtagcaactcctgatcaacaaccaagtttattttcctttcgtcctttacttgggacgagcaaaggtttaagcttgggggtttcgttgacggttgttacagacaatatttgactgccaatagaactaaaataatgaagaattagctatgcttacaatgcatgtttgttttcaaataatatatttccacttgtacttggagaataacatgttgcaggaatttatcaaataaaataaagagaaattggagaaaacctcactcctaaacaagcaaatggatacggagggcccacatgtcaagtgtaaccgccggaaacagccttaactgccaaaatcgccatgaggtcccacctgtcagccaccctgccgaagctggaggcctgttgggccagcccaggttcggccgaaccctggcggcgtccaatcagcctagccttacacgtggatatccaagattgcttgctgatgatggttacaggggtaaaatcgacatttcgcatatcagtaaccgtcataccgaccctataaaaggaggagttcacttcacttctcaacacactcaagcaagctcaattcctcttcatacattagtattagtggtataatgctaagtgtagtagtatagaatagtgttcggagtcctcggagtcttcggaagagttttcggtatggctctagcagctcttgtaatctcttctgtaatactttccgtattaatgaaatactcttctttatatatcttcggtgctttgcttagtcttagtactggtcttactttatatctgcattatatgaattgtgtgggtagcctaccagagaggtgtaatggtgcgagtttaatgtctaatttatcagttgctctatgtcgggtgcacggctatagagtagtatttagtaatgttagcatggtgcttagattattaaatatcattaattgggcatatatgttgcaggacattagaggtgggccgctgatggtgatagctcagtatgggtatttctccacgttagtatatattcctaagacaaattcgaagggagggtactcctctatatgtagccccggttggacggccatgacaggttgtcgtaagtatctcgccaacccagggtggtctctcgaagtaccaggaggacactgttagggggtattggccacatgattgtatattagcagatgtaaactaagatttgagtgtatattagaagaatagtaatagagtgctttatgtttcttccacttagttaaacttattttactagtaatatgtccgtgctaacgctacgacattatttataatgtaaagcaaacaaccaaaagtaacaatatatgtttcaaaagttttctgacattatgttcaaacaagatcacaagtattaagcacaaaaacgtaaaagaaagaaaaaaatctaaataaataaattatgttctggagccttagcatcgacatcatcgttaagaactaaattagatacaatactattgcatcgtgcttatggagcattaatgtcttccatcttagagaaaacctacccatcaaaaccatcatcactaccaggcaaccatatgcctatcttagtaaataaaaaacaagctaacttattcgttaggaacctttggattctcccagttctctcctcaagcaacgatcttattgaatatgccaccatcgtaattctgatagacaattgtaatatataccattaggaataatacactgtagtgtagcaaaactgatgtctagactggagagataaaccttacctgaattcaaaagaaaaccaacttacagaggctacatataaattgtttataaattatatatgtttaaatctacaaatagtactactccatttctttttcacaatctttgccatgtactttcggcataaattcaatggttaattaatcggggtccaattacatagaagcatgaaaacaaacaatttgcttgaaaagttcaaaagtgaaaaattgaagctattagtgcagattaaatcagagcacaatgaaaaatccaaatacactccactaacccaatttaattgctaggctacctgtatggtagccaaacccctcagccattaaatgcttagacagatccctcgagagtagtagaaatccctaagaaaacatgcagttgtcggttgctaaattatgcttagcatcctaattacatacttacggcaacatgatgatggtgtttaaccacctcttgctattttccattttgcaccctttcattccttcgcatgcctccccagaaattggtgcagcaaacacgatcccatctacacctccatacagtcagattggttctttgacttcttctggaccatggctacattggtttctaaatttgttaaattcagaaatggtctctctgtatcatgtacatttgcttgttgaaattataagcacataatgatttaatttattccataaataaatcatgatattgcagatgtaaactagcatgaacgcatcattagatctacacatgtaaactaagcagtaaaacatgaacagatcaaatatgcgcaacatatcgaacacgtaccgaggtggtggaaagactggttgctcagcaggaactactcgcggttgcgggagtcgacgaaggcgcgcagcacgcgagcggagaggaaggcgagccgtagcgaacgaacagggagcagtcgcacgaagcgcttcccaaaaactttattgccgccttctcccggtgcaggacgtcgaaggcagaggttccggagacctgctctcccgatcgctggtgcacgccggcgagcgggatggagtagtctacgagcgacggcgcagcacagagtaggaggcaaatcctagattgatttcgcgtatgttacgtgaaggcggcggctcggtttatatagagataggtcgcttgatcagggcgcccgcacgatctctactccgtgtaaccgaaccggataagtcgcgcgtaacttatccggacttcacgccgttttcacgcaccgattttttggaatgtttcc

SEQ ID NO: 76249 - DNA, 10339 bp, Oryza sativa
aaaactgcaaaaggaggctgcatctgcgcaaggatgaggagcacgacgcgcctgcccttccctgccaggcgaggcgaggctagcgcgtgtgttccccctcttcctccaccacacatgcttcaagtggctaggagggcatcctcccttttaaggaggtcctcctctcctagaataagcaaggtggtcctaaactccacatgcatgccatcccatgaggtgggcttttgtgattttccaaataattaatcttcgaatgggtcttagcccatctattaattccaacaatcccccaccaaatctcaaaatcccactgagatttgccttttcaaatgtactgtttatataccagcggttcgatggagaccgattaaggttgaacatccacctagaactccaaactacacttactcacaacttgaacaatggactacgccttgaattgcaagtctcgtgcaagcaagtttcactcagagtcttatctagtactataccgtctgtagactacccctcgggtggagcgtataagtcatactcctaggtctttagtaagcttcctagaagattcacccaaaatctccatagactgcgatcaatagtcaagcttacaaaggtgagttctttcaagaatgctctgcaggataacatcttcgctaattaaagccaacagaactcattaagccataaccaacctaccttgcagctcacgagagtacatgcatcttcacttagagagggtatagattggtactctcctctagtttactaatggtttgttcttcccaggttctaattcacgggatctccgatcacatagactgggttaccaccattgtataactcacatgggtctcaaacccatctccttcgatgcattgtctatcacatttcgtgatagtcccttcgtgaagggatctgccaggtttctagcagtttggatgtaatctaacattataaccccggagtttctcaatttcctaacagacttcaatcgtcttttcacatgtctagacgatttcatattatcattagaactattcacttttacaattaccgtttgattgtcatagttcataaggatagccggcaccggtttttcaacaataggcagatccattagtagatcacgcagccattctgcctcaacagtagcagtatccagtgccgtcagttctgctttcatggttgacctcgtcaaaatgatctgtttgcaagacctccacgaaacagcaccaccacccagtgtgaagacatatccactagtggctttgatctcatccacatcagagatccagttagaatcactataaccctccagtaccgcaggatacccagtatagtgaagccccaattctatagtacctttcagatagcacattactcgctcaagcgcacgctagtgatcatctcccggattagaggtaaaccggctcaacttgctcacagcaaaggagatatcaggcctagttgcactagccaggtacatcagcgagccaatgatttgggagtattccagttaattcctagcaattcttttgttcttgcgaagcaacaagctaggatcataaggtgttggagaaggcttactatcaatgtagccaaagcgattcaagatcttctccacataatgggactacaagagtgtaatcccattctcacctctaattagcttaatgtttaagataacatcagctacttccaaatccttcatatcaaaattttgagacaagaatgatttaacctcatttatcacctcaaggtttgtcccaaatatcagtatgtaatcaacatacaagcacagaataactccctcacccccaccatggtgatggtacacacatttatctgcctcattgactgcaaagcctgcagatgtcaatgttttgtcaaatttctcatgccattgctttggagcttgtttcagaccatacaaagacttcaataatttgtacactttgccttcttgaccttcaactacaaacccatcaggttgatccatatagatctcctcatccagctctccattaagaaaatctgtcttaacgtccatttgatgaacgagaagaccatgtgaggctgctagggaaggtagcacacgaattgtggtcaatctagcaacagatgagtaagtgtcaaagaaatcttcgccttctttctgagtatagcccttagcaacaagccgagccttatacttttcaatagtaccgtcaggcctgagcttctttttgaacacccacttgcaccctacaggtttacacccatagggccactctgtcacctcccaagtcccgttagcgataatggaatccatttcactacggacagcctccttccagtagtctacatcaggagatgcatatgcttctgaaattgacttaggagtgtcatccacgtggtacacagtgaaatcatcaccaaaggacttagccgtcctttgtctcttactccttcgaggagcttcactgacatcctccttagtgacatgttcgtgtgtatgtttagtttgttctggtggtgtgatcgaactgggaattatttcagagggttggctcgaactactatgtgtatccttcattgggaaaaagctctcaaagaaggtagcatcacgagactacataattgtaccaacatgcatgtcaggtacatcagatttaactattaaaaatctataggcaatgctgtgatgagcatatcccagaaagacacagtccataatctcaggtcccagtttgcgcttcttcgttattggtacattgactttcgccaagcacccccatgtgcgcaaataagaaagtgatggttttctcccaatccatatctcatatggtgttttgtccttatttctattaggaactctgtttaacacatgattcgaggtcaacaatgcctccccccaccatgccttaggtagctccgcgatgtccaacatggcattcaccaagtcagtcagtgtgcggttcttcctttcagcaatcccattagactcgggagaatatggaggcgtcctctcatgtataatgccatgttcctcatagaataagtcaaactcgtttgagaaatactctccaccatgatcagacctaagtgtttttatctttctatcaagttaattttcaacttctgccttataaattttaaaatagtctagagccttgtctttcgttttcaacaagtacacatagcaaaatctagtagcatcatcaatcaacgtcatgaaatatcgttttccacccttcgtcaacaccccattcatttcacaaagatctgaatgtaggagttctagtggtgccaagtttctctcctcggcagccttatgaggcttgcgaggttgcttcaattgcacacaactatggcacttagaacctttgacaatggaaaacttaggaattaaacacatgctggaaagccgagacatcaagccaaaattaatatgacataaacgtgagtgccaaacattagcctcatcatccacactgccacaaatatggtttacagacttattgcagaaatcagaaagggaaaagcggaacaggcctccgcactcataacctttaccaataaaatatccatgtttagacacgactactttattagactcaaaaaccaacttaaatccgtctctagttagacgggagccactaacaagattcctatctatagaagagacatgctgcatgttcttcagctagacgatctttcctgaagtaaacttcagatctaccgtgccaataccatgaacagaagcatatgacccattccccattaggacggtggaacctcgtgcgacctgataagaagaaaacaatgagatgtcagcacaaacatgtacattggccccagtataaacccaccaattagtagactaattaactgaaaaaatagtaggtaaattaccatacccgcttccatctccagtgttgccaatggtcacattagcagacttagaagtctgccctacaggtgccttcatccccttgcgttgtggacacttcctagccagatgaccaggttggccacacacaaagcaagtcctctcatcctgattaggattgttattgttcttcttctgcttcttgaagttggtggtctattgagctttgtatttccccttgctcttgttctgggccttgtgcacaacattggcactggactgcccaccatcgcccttagacgcagcatctttttcccgagctttctcctcaacatcaagagacgctatcaacccctcaacggagtattcctgtctcttgtgattgagtgcagtaccgaaacttctccaagatggaggtagtttcgcaataatgcacctggccacaaatttgtcgggtaagacacacttaaggagttcgagttccttagccatggtttgtatctcatgagcctgttcgactacagaacggttgtcagccatcttgtagtcttgaaactgctccatgatatacagatcattgccagcatcagtagcaccgaatttagtattcagtgcatcccacaactccttagcgtcagtcaaatgcatatacacctcgaccagacgatcgccaagaacgctaagaatgcatcccacaaagagagtagtggcttcctcgaattgcttctgctgatcagcagtaagaactccttcaggtttgccagtactcacccagaagcatttcatagctgtcaaccacagagtgaccctgatctgccatctcttaaagtgcacaccggtgaatttatccggcctcagtgcatcggcaaaaccagccatagtaaaatcacagcgcctataataaggtttttggattgtagaaattataagcacataatgatttaatttattccataaataaatcatgacattgcagatgtaaactagcatgaacacatcattagatctacacatgtaaactaagcagtaaaacatgaacggatcaaatatgcacaacatgtcgaacacgtaccgaggtggcggaaaaaccggttgctcggcaggtactactcgcggttgcgggcgttgacgaaggcgcgcagcacgcgagcagagaggaaggcgagccgtagcgaacgaacagggagcagtcgcgcgaagcgcttcccaaaaaccttattgccgccttctccccgtgcaggacatcgaaggtagaggttccggagacctgctctcctgatcgccggtgcacgccggcgagcgggatggagttgtctacgagcgacggcgtagcacagagtaggaggcaaaccctagattgattttgcgtatgttgcgtgaaggcgacggctcggtttatatagagataggtcgcttgatcagggcgcccgcacgatctctactccgtgtaaccgaaccggataagtcgcgcgtaacttatccggactccacgctgttttcacgcaccggatttttcggaatgtttctaaaacaaaaacaaatccaaatttcccgcagcaaaacaaaactgcaaaaggaggctacatctgcgcaagagtgaggagctaattttgcggaccattcgacgcgtaacaacgtgcacgcgcgccgcctgcttggccaggtgagcgtgcgcgtgtgttccccctcttctctccaccacacatgcttcaagtggctaggagggcatcctcccttttaagaaggtccccctctcctagaataagcaaggtggtactaaactccacatgcatgccatcccatgaggtgggcttttgtgatttttcaaagaattaatcttcgaatgggccttagcccatctattaattccaacattgctttggtccgataagtatgtgccctaaaattttgagttatcaatatacaaaatgcattaccgatgatgtagacagggtttaggtgctgcagctatcaagacagaatctgtaccatttagcattctagcaatctagcacaggtaagaactcactaaatgagcatcactgatcaaaatgcgacagatcaaaggcactggttgatatcgcaccgtactaactcaacatagccacgcgtagctgaacacctgaaccgcgctgccaccggaggccacaagcgtacgagcaaatggaaccagctcccagaaacaccacaacaggtaaaatttcattaattttttcagggttagtctgatcataattttcagtataacgctctcagctggaagaaccttaggttgagtattgcatataagtatttatcatgggattagagtagtaccaaatcttaattcagatgataagagtgaacaggtgtcgatctgtgcaacattactattcccacacaatgatatcttcagaagcttctgaaacttgaaaatggtttgcaaagttcctgccaaggaaaaaataaaataaaataaaattttgccatcagtaacattggaaacaagagctctgtttgatcaaagtcacagacatctagcgccaacagtctatgaaggccaatatctgtagcacgatttgacaatgctcaaaattttagatctactaaaaattgtggtagcatgttctttccaataaaaagtacaattaaagcacaacacagagatcaattgaagtacaattaaagtacaacttatgctacaggacctaacaagaaacatggtttattcaaaggacctaatgcaaaccatccaattttcatttttacatatatagttgtatgtgacaagatgatatcaagggattgttgggaaataatctctcggctaaggaaaccgagagaaaatcacgcgatcctgttttccacccgttgaccagcgtgattagctcacgattaaatttccttaaatgcacgcgcaatagtcggtagcgcaaccaacgtttccttttggagcagcccccgattccctcagtgcaaaataaaaggggaggccggcccgtgagaaggtgacaatctcactcacggttccaatctccccgacatcccaaaaccctaatttcccgattctcagttgcgcaggaagggattcgtagtgctgttccgggacaatgtaagtggtgaccggaaggccgccgccaccccgcaggtgatcaccggtgacctcttcgggatcaagccggtgtactcactactacgaccacttctcctacaccgacaattcgcgaggtggttcgaggttctgcatctctacatccactccagactaagcgagaacaattgcaatggcttcaaacaacggtcagtaatcctaaattctgcattagggtgatcatgttaggccgaccggaaggccgccgccaccccgcaggtgatcaccggcgacctcttcgggattaagccggtgtactcactgctacgaccacttctcctacaccgacaattcgcgaggtggttcgaggttctgcatcctctacatccactccggaccaagcgagaacaattgcaatggcttcaaacaacggtcagtaatcctaaattccgcattagggtgatcatgttaggcttagcacttatgtcttagtagatcgcaatatctacagggattaccttgctttcaggcagatgttccagatgattagccgagggcgtggagctgcgttggttcagagacggtcgtggaagtggagcagctatcagcggagtaggcagtgatgcacaacctgatggaatacgcgtaggctacgatagcataaatcaaaattttctaccgcgtaaaccagaaaccatgcaagtattagatcataaatcgttaccactcgacacgctgcgtagcggaagaaagcgctaagaagtcgaaggaactttcgcgaagtagcgcgcgttgatgtagaggaagtagtcgatcgcaccggcttgaccttctcctcctcgtgcgttctcctcgccgtactcccacgtcgaccagcaccgaaaccaacggcgcctctaccggtatccacacgtacagggacggaacgccacgcgcagatgtgctagcacccgctcgcggctagggttttgctcggggaggggagtggcggctagagtttctcacatgatgcaatacctccgccgatcacacccctcacgaatatataggatccatgattcgggcctccaaggcccataggactcctatttgaatccctatccgaattaaactcatattggatctccatccaatccccttattccggcccattaagcgtgcgaccctgtagattcatgtacactcggctgtaacccgaaaactcctttcggtccacgtgacaatagcggtccctagcagaacgtattgacctaccgggcatacataaagatcatattggctgaacctctagtgtatacttgtatgatccactttgcctcacgatatcgattaagctcaaggctagatatgtgctatcctctaatcgctcaatcattcactcgaacctgtgatagattatataacttgtgattgactcatcaatcacctttggcatggccatgcatttccataatctacaacatcgaggggcccagagatatctctccataggaggggcaaatcccatcttgattattcatatcacactacatgtttcacagcatacccggaaactacttttataactacccaattacggagtagcgtttatcagtctctaagtaagctactacacatgttgggaaccatgataatctcaggtctaaggattcaacaccaacactaaatgagatcactgatgacacaacacatatggctcttgcggtgtctcatgttgggtctatccaacaacatgttccccaacatgtgttcacattattaatttggtatctctactagttgggtgcccgtgcattgcaacgggaaaaaaataaacagacatattaaattacattgcgtaaaatgcgtaaaatgctgttaaataatcattgagcctaaatttgttgtaacaaaaaccttaatataacatgaaccataaaaaccaatctagtcgcagtaaaggcttgtcatctacttcctccgtttcacaatgtaagtcattctagcatttctcacatttatattaatgttaatgctagaatgacttacattgtggaacggaaggagtagaataaatagccgaaaatgatctaactttaactcatgccacctattatttgacctcctaatccagcggtatgcaagaccaccattcctccaggacgcatcaacgcgtactttcatttgtatatgcagttccttcgaacacgtgagtaccacgctcctttcatattattgaggagatcaaactcataagaaaccatgagggcggatccaacattgtagagatggtgccacatgacatcaattaatttttactacacataaatgtaggtcagaacttgtacaatgtatggtttaaaaatatatattgccaatttctacagaacttatggataaacagaaacaaaataaggcttatgaatgaaaaaaaagaaaataattggctggtagaacattttagtatattcatagctagaaaatgtgtaacatagttctgatgttctatagatggcacatctcagttttgataatgaaaggttgctagcacgggtgcaaaacaaaagagtaaatcaagacacctcacagatactctagtctggcctaccaagtccaatagaattcataagcgaaaaatatatgctacaactacgtatgaatatacaagagaacacagttcgtaagtacattctatcagcttgcaattgagttccctctgtagatcagaatcttacctttttccatagggtgttttcaaagtttcaacttcatgtcaaaaaagagaggaaccattcaaaacaaatgatcatatgatatgttactgaagatccatttgaaaagaagttgaataaaaaaggaactaaatgaagcttactggcatcttcttccccgccagggtagggatgcaagcgggccgacccgcgagttcacttataggtcaaataaatcatattttatgggttttcgcgtcggtccagtttaccgcatcatagatatgaaaactcatttatagatcaaattgataggtaacccgttggtcaaacctgcaggttacgtactaattttgcctataagcgggttcgtggacaatgtcacgcctagaaattcactagtaatttccgaactaatttgtgtatagaatcctcgtccaggaatcagccgaggtacacaaactgacaatttaatatagaaatccatcataataataacgttacatacttacaaaacaaaagaaaatcagcagcggaataacggtctagcgatggcttcagctccactcccacaggcagctcaactggggtataagccaaacgtcttcttctggatccttttcttcaactgaggttgattgattattgcaaggtgagcatatgacatactctgcaagccacacagcaaatatgcaagtgcacaaggatacc

SEQ ID NO: 76250 - DNA, 15231 bp, Oryza sativa
  unsure (1)..(15231): unsure at all n locations
ccaggagctaagcaaattattaccagttatagcatcaataattactgtgagaggtgtgagactaatcacgaaaaacattgttcaacctgcccatgatcgcgggcacggctattcgaatagttttactctggccagaggtgtatcaccactgtacccacaagacacagctccacgacatgtcaccatgcgcctcaataccaccacggtaccttggaaaggaactgtgacagtacccctcgcacaacacaactcaccacagtgcaccattcctggatcataatcaccccctctacaaccagaggcatggactccccagcgaccctcatggacttctcgccgcttctcagtctggtgccccgcaatgaaccatgctatacgaaaggtaaatccgttgcccacgctggcttgtgcttggcacggtaaatatttcacaacaatagctcgtgaaccgttccttaattgtcatgagcacgaccttcaaaaccatgtgctcacaacccaccattatcaagttttaattatcaattaattatcataacacaattaaccatcgtgagctaccattaaatatagccataagtaacaatgtagtgtgattcatctcatttatggctaagcaattatatatatagcatttagctgaaccaatccaatatataaagtccaagctaatcaatttattacccataggaaaataaagtcatcttcggccataattaattgggaatggctcaccacccgatgacattcgaaaataatgcataagttgaaataaaacaatagctttagataggttcaacatgctcaaagggttgtttgagatctgtgtgacttgccttgcaataatcggtcttcaattaatcttcttgaacacttccgacgcactcacgaaccttcgcaacgacggaaacaacatgctaacacgaaaaacgaagaaaaagactaataaaaaccaaataaacagtacataaaaagtagacaaacatgtagatcatgattttagatgaatttagagacttgaaccacttaattccgacttcatatgaattagttatcaattttacaagataaatatgattttagccttatacagaacaggattaacaatgtcatgacgacatcattgccggcgatggagggtttaggcggccaagccgaggcaccagaagaaagagcacgacgaggggaactcactgaggggcggcacgacgatgaaaaacggctggcgatgagatcgggagtgacgacggggtaccgatcgatggtggcggcggagtttcagcgacgggagacgacaaccgaggggtggacggggttctcctcgcagctgcgatgccgagggaggctgcggcgaggtccggcgaccttggggtcgatgaggaggcttcgccggagatcaaaacaaggcggcaacccactggttcacggtgacggcaatctcccggcgggatttggcgcaaaagaaccggtggccggggtagagctgacccttgcgaagccgagggaggcgacggctcaaggcggcgttgaccagagaggcggcgcggcgctgctggagatggtggcggcgctggagagagagggactcgcagggagagacggctagggcacgggagctcgagctaggggttggaaacgaaagaggagagcttgggggttctatttatagccacgggagagagatatcgggcttggaacgcaaggaatcgcgtcgggaaaacctagggtttggtggagagataaactcgaaaacgaatccaaattcgcgtcgaattcaaagggataaaaccggatttttggggaaagagatagaggaggataaggaaacaagtcccctcaactaattttcggaaaacacgagagataaggccggattcggaggagaaaaaccgagccaactcggtctcagttcggctgtcctgaggttgaagatgaacagtagcgagggacgtaaagcagactttctccgagagcatcctctactaggccggattgaaggagggacctgaaatggacttcggaggagggataaggccagccgaaagggagggagaatgggccgagaactaaaggtgaacctttccagtttcggcccgaaaaggaaaaggggattttaattacttttccaattaaattaatcactgaaatgatccttgaattgttaaaaatacttctattgctcaaataatttcaaaaaaaatcctgaaagtacttgaacactataagtatttaacaaaattaaaatcagaccatttaatgattaatttaatatgtgaataattacttaaatgttgtttgtattattaaaattaagaattgagctccgaaaaaatcaaagaaaattccagagagtataatgcgaacttaataaaaattaaatccagccatactttatatttaggaaattttatttcccacatttaactttacttgtaaattaatgaacatttaatataaattctaaaaataatttattaaataatttatgaatcntagagtgaaatcaagtatgtggcagacaggcccacttgcacccctagcgaagggagaggcgaccacactggtgctgccacctcccccgccatctgcgtcgccgccttcccccaccatccgtgtcgcttctttcttcctcaacttcgccggcgccgcccaccacctactccgccaccttcctgaccgcgccacctgcccccgctattcgcgccgcctttctcgccatccgtggtgtcgccttaacccaccatccatgccgcttcttcttccccaacctcgccggggccgcccaccacctgctccgccgccttcccggttgcgccgcctccccacaccgagccgcgccatcgcaactgctgctgcctgctcctcattctaaccgccctcaatgtcgtggatggtaggggaaggcggcggcgccagcatggttgcccctccctttgcccttttatcctctcactcggctcggtctcagttgtgagtgcgtggtttagagagagagatggcagtgaggggcaaaaagggccaagaaataattatttagatgaaaaatagtattttgcaaatgcaacagacagcgaaaatggcattgtagcgaatgcccacaacttgagagtagcattcgagcgaatcctgtaaacaatacattattaattacatgctaaaaatgtaaatttagttgctactgactataggcagatttcatttcgttcttgaataaattctgtcatgaaaaggatatacatttagcatgaagagatgtataccgtttattagttgactatagatacgtgtacctacggtcagccaagtcagccactgaacagcaactgcccccctccagttgccaattctgggttagccaacatgccatgcaagttaagcgagcagagcagatcaaaaagaaggaaatggagtacacagtggagagtgattatctgtgggaagtgaatgggggtggtactgcttgagatactaacagttaccaaaatgaccaaatatatatttagtttctttcacatagaaacataattgctatgtaaatcaaaatgtatcttaatagcatgtgaggtggtatacaacagaaaattctattttaataaccaaatggacataacaatcatttagttgagccagcctgatgcaaaaattcactgctttcccatttgctcatgtactgtcatgttaagtcctaagggctgagtgcacgctacagaaccctataaagattaaataatcaaataccctcaacctagctccacaactcgagaattgaagtttcctaaatgacggtggtgttggaaatttagtcataatttggcatattttaatccaaaatattaagacaataaatataacatttgcaatattagtagatatagtgacagtgctacatgtatacaacttgagtatgcttaatatagaataagcatcagcatagacaagagaacacaataatattgcgaccgacagttgtaggaaacaaagaacgaacggtaagagtgaaacgttataccctgagaatggccctccgctggagtttgagacagtattgcctccgttggtgttgacgggaagctccttctccttgtctctagtgttgttgttgtcgccggttgtcaacatgttagtgaagatgatgcagagcagtcgcgcttgaagcgctacccaaaaacttgatcgcccacttacccgtgcaggttctcaagcggacggagtttcggaggcacctgctcattccgatcacccgtgcgcacgggatgaacagaaccggggaaacaaagagacagcgcaggaacagaacgagagtatcgctaaggaacaatacaggaggaagacacacactttgagagcctctgccttgcgttatatatagagagagatctccattaccgcaaaaataaatctaatttgttgtggatgttacaacacaatcaatctctcatttgttgtggagggtacaacacaatgaatctctcatttgttgtgaatttcattttttaatggtgacttcattctcgtttgttacaaaaccgaaaccgaagagcaccagcaagctctgcttggtcagccaccttccctcgctacgtccatggccgaggccgactcagcgcgtgcgcatgcgtgtggcagtccaaccatcacctcaaccggtcaacagggaatctccaatatcaccctatttaagttgaggttcttccacctaatttttcaaggtagtattattctctctaacattacttgtgggctcttgagattttaattaaattaaattaggcctagcccatttatttcaacaatccccaccaaatttcatggctcacaagaaatgttctcaaaactgaacctgttagttataccagtgttttgatggagactgttaggttgaacttccacctaggaaaagagttacaccagatcataactgaacaatggattatgccttgtaattgtcagttttgtgcgattcaggtttcactcaaacccttaactggtattgggctgtcgtttgcatcccctctgtttggagcgtataagtcatactcctggccttttcatgagtatctagagatcacccagatctcatagactgtgactagcagtcggagtcatataggcgtgttccttctaagatgttctgtaggccaacatctctgctttatgaaaagccactcggatcacattaaggtgtataccatcctaccatacagattagaagagaagtgcatcatgaagataagctcatttttgggtctcttctctcagttacccaatagtttgtttcgccatccaaattcacgggatctccaatcacaatggacaggtttccaccattgtgcaactctaagtgggtcttaagcctatctccctcgatgcacagtctatcacattacgtggtagcccctttgtaaactgatctggcaaatttttagccatctggacatagtccaatgctatcactccggagtttttctgctttctgacagacttcagtcttcttttaacatgcctggatgacttcatgttgtcctttgaactgttcactttaataatcactgtttgattatcacagttcatcaggattgctggtactagtttttcaaccaccggcaagtccatcaggagctcacgaagccatttggcctcaactgtggcagtatctaaagatgcgagttctgcttccattgttgacctcgttaagatggtctgcttgcaagacttccaggaaacggcgccccttccaagtgtgaacacatacccacttgtggcctttatctaatcagcatcagatatccagtttgaattactatagccctccagtacttttgggtacccagcgtagtgaactccaaagctcattgtcccttttagatagcacattactctttcaagagcatgccaatgatcatctcccggatttgaaacaaaccggctcaacttgctcacagcaaatgagatgcaggcctcgttgcactagctaagtacatcaatgaaccaataatctgggagtatctcaattgatcccttgctattcttcggtttttccttaatagcacactaggatcaaaaggagtaggagctgccttgcagtcactataaccaaagcgactcaggaccttgtccacatagtgagattgcacaagtgtaatcccaccctcatctcctctcagtagtttaatgtgaagaataacatcagccactcccaaatccttcatttcaaagcttttggatagaaagtccttgacctcctcaatcacattaaggctggacccaaagatcaatatgtcatcgacatataaacacaagatcactccctctcccccaccatagcgatagtacacacatttgtcagcttcgttcacaacaaagccaacatatgtaagtgtattgtcaaacttctcatgccattgcttaggcgcttgtttgagaccatacaaggacttcaacagcttgcacaccattccctcctgaccttctagtacatacccatctggttgatccatatagatctcctcctccaactctccattgaggaaagctgtcttaacattcatctgatggacaagtagaccatgagaggctgccagagcaagtagtactcgaatcgtggtcaagcgagcaaccggtgaataagtgtcgaaaaagtcctcgccttctttttgggtacaactgtcacgcccagaaattcacgaaccagaatttctaagctgaatgtgtattaaacccctatccaggaccagccagggtacacaaacgacaattgttgacatacagatccacgtcttacaaaaacataaaggattacaaatgcagcggaaaaggtaaaagcgagctaagcctgaagacttgactcctgcagcgggcgattccattccacaggcaacccttgacggcagcgacgaaaccaacctctctgagacggctccaattgagaagaacttctactctggtgtgggggaaaagagagcaagactgagtactacccactgtactcagcaagtcataccggaagaggaggtatgatgcaggatataaccaaaggaggctagaggttcttttgcataaagctagcatttaaaagtagtagttgaaggcagtaaaacagttgtagtaattaatcaatattaaccaatcactgtccaacgctacaccacgttgcaacaggccgaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacttttccacacatgtcgccatgccccgaagtatcaccatgatactgcaaagggggaaatcgtgacaagaccctccgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagtaaaaccatgcacccacagcccaccattcagtgtattttaattaactaacaccattgcggtggcaacaatctaaagctatgccaaaagacaaagtctatgtaataatgtgatccccatttgtgtactagttgaactaagcatggctaagcatttcctaagccaacatctagtcattttgatacccaagttattaatggcatagggtaaccaatatgtggctgaggaataggacccatcccacattacattgtaaaagaatgcaacattacatagaaatgcgggatatttgtaaattgggtacaatatgatcaaacgtattgcatgacttgccttgctctcgaactgatgagacctcagcaacgtcttcgagagaccgcggatcgacgaaaaggccgaaatctacgcgacaaacaaagcacgcaagcaaaacatgctataagactacagaaacaggaaacaaaaccatttttaatggattctttgcatttttcttgatttactgagacttgaatggacttaaacggagctcggatgaattacttatgaattttagaagataaactatgtttttactaataaagaaaaagtccttaattaattattgcgcaataaagcccagggctgacgtcagcgaagggggggcggcgccgacaggtggggcccacgggtcagcggcttaaaggggagaggaagggggcgccggcaagcggggcccgcatgtcagcggctcaaggcggccggtccacgggaccaagggtccggatcggcccaagccgatcggacggtgaagggagcagccaccgggctcggcctcggcttcaagccggccggcaagcatggcgaacggcggcggcatgcggtcgccggtgacggcaaccagcggcgtgggaggcggcggcgggcggcgcacagaccggcggcggcggacgaaggcgatggcgagcgcagggagcggcagcgcgtgcgggacagatggaaggatggaggagaggagctcctcactgtgagcacggcggccggcgcgaaggatgaagacggcggcgatgaccggcgacgcggaggcacggacgggcagcggcgacaccctaggagaagatggagaggcgttaggagaggagacgacgaccacggcggcttgaattgccggccggagatggaggggagggaaaaactcaccggctcgcgaggggagaggcgctccggtgggattccggcgacgcgaggcggcggccgggaaagctcttgcggcggcgaagctaacggcggcggcgatttggcgcggcggcgactctagcggcggcggctcatggccgaaggcggcggcaagcggcggagctcgggtgtgacggcgcgggcgcggtagggggcgtgggagaggacggcaaatgggggaaacgagggaggggactcgggggagggtttttatgggcgagagaggggcggacgtggccggggagatggccgaaaccgccggcgacatggggaggagagagagagacggtgaggtgggattcaaaatgaatcccgcccacttcgtgcatgcgcgcgggcgggaagggcggaggagtggggcggcgacgtgggcgcgcggcacgggcggagtggggcgtggagaacggcgggaaacggcggcggcggcatgggcggtttcgacggcagcagttagagctccagctccaacggctggaggtgggagacgaccgacaggtggggcccacctgtcggcatcccagagagaggagggaggggcgcatgggccggcccaacaagaggaaggccgagcgggagagggatgggccgacggcccaagaaaggaaaaggagggaaaagaaaaaaaagaaaaagaagaaaggatttttcctgggatttaaaattgcactttagtgatttttaattggttaaaattatttccaaggctctgaaaatttcactaaaaatcctgttaatgcattggagcatggggaactcaagaaaaattccaccacactatttctgattattaagtgcatttattaactagggatttagctctaggttaattaagataatttcttcgggcaatttatttaaccaatttttaaagcaagcaaaagggggaaaacttcagggtgtgacaaacctaccccccttaaacggaatctcaaccccgagattcggaagagctggcgaagaggtgcgggtgggtggccttcaactcatcttctctttcccaagtggcctcttcttctgagtgatggctccactgaaccttgcagaatctgattgctttgtttctggtccttctctcgctggtttcaaggatacgagtcggcttctccacatacgtcaagtcttcctggatttcgatttgatccggacttgcctgttcctcaggaactctcaaacatttcttcaactgggagacgtggaacacattatggatgccaagcatgttggagggaagctcaagctggtaagcaacttcacccctgcgttccaaaattcgatatggtcccacaaagcgtggtgccaactttcctttggtttggaagcggtgtactcccctgagcggagtgacacggagatacacataatcccctgcttggaaaacgagctcccttcggcggttgtctgcatagcttttctgccgagattgcgcgattctcaatctttccctaacagctctgactttctcttctgcctcatttaaaacttctgtaccaaacaactggcgttcccctgtctgatcccagaagagcggagtacgacaccttcgtccatacagtgcttcaaatggtgccatctgcaaactagcttggtaactgttgttgtacgagaactcagcatacggtaagcttttgtcccatgctccaccaaagtcaagcgcacaggctctcaacatatcctctaggatttgattgactcgctcggtctggccgtctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattcggatttctttccacttccattctggaatttaaagtgtctgtagcaaacctgctggcctttggtgttctgcctttactcggtgacagacgtcacagagtgctacgaattcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttatcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcagatgttccaaatcacgttgaacctcacaacatagttgctctacccatgcaacattgcactagctcttcctgctcaaggcatctgcaaccacattagccttgccgggatgataatgtatttcccatatcataatccttgatcagctccagccatcttcgctgtctgagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcatgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacttgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcctcgcggatcctcaactggtgatagtctgatcgcaggtctatcttagagaacacagtagctcctttcaactgatcaaacagatcatcaatccttggcaaaggatatttgttcttgatggtgacctcattgagtgcgcggtagtcaacgcacatcctcttggttttgtctttcttctccacaaagataaccggagcaccccaaggcgatgtgctcgggcggatgtatcccttctgtaactgttcatcgacttgcttcttgacttccgccaactcgttggctcccattctgtaaggcctcttgtggatcggtgcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactgatccctgacttctgcggcactggagactggaaggttaccacctctccttttgcattggtcaacttgatggtgcggctggcgcaatcaatcactcctctgtgtcttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgagcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcacggttgttgtgactgccactatggtggttcttgttgaagctacccgggtggtagggacggtactgccggataatcatggtggaaggtccaccgtgatgtcccatcgtggaacgaggcttctgactcttcccctggggagtcctgaactgagctgccttcctcttacggtttactttgttacagtgctcctcctgacggatagccttatccaccagcttctcaaagtcctcataatctctagagatcaactggttaatcaattcatcatcaagaccagacagaaacttctcctgcctcttggcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagttggacgggtcaccatgtagttgtcccaccaaatagaagcgggaccttgtagctggtgtgtagcaaaagcaaccttctcctgctcattgcattgcaaaagattcagcttcttctcaatggcatgaagccagtcatgggcctcgattgggttggtggtgcttgagaaagtgggcggcttgacacgaagaaattctaatagtttggactgaggaggtggaggaccaaactgcaggttctgttgctgctgctgtgcttgctgctgcacctgttgcaacacctgatggtactgttgctgcatctgttgcatcatcattgtcatcatctgagtctgattgtccaacacctgagcaattgttgggttcttaggcggtggggacggattgttgtcagatgcaccgttggcacgtgctccatcgatcggctcttcgctgccactggcattgttggagtcgcgtgaaccattccttgtctccatctgaaggggataggtagaaatatgagaaaaggaagaaaacaggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacagaaaactagcaagcaaacagactaagaaggcaataaagctaagggcggcgactctgaagctcggagcggcgcttgcgatcgaggaataggactgacatctaaagtagacaagggataggaaccaattcatgctcaaatccaaattaaacaaagcaacaaatgactcaaataaatactcgagcatgatgatttttatgcatagaacatttttcatgaactcaaatgaggatactgatgcactggctaatcaataaattaatgcataaaataaatgcatagctataatgatacgcatgaaattgcccccatcaacctagacacgacttagtgcatatcacctgacaaattcccgactgaccgtcgaataaaccccaaatagatttttttttctaaaaccctacactgagctaaaaaaaaccgatccgaatgaacgaccaagatttttcccacaagccaaagaggcaaaaccccaaattttcctgaaacaaatccaagcgcaaaagggcatatgcatatgaaaaaaaaaggggttcagagggctcttaggtttccagttggcttgtgctacgggcaaggtcggctctgataccaacttgtcacgcccagaaattcgcgaaccagaatttttaagctgaatgtgtattaaacccctgtccaggacca

SEQ ID NO: 76251 - DNA, 15794 bp, Oryza sativa
gatatatcattgtcgatgaaaaagtggttactaataggcttcattgatgtcgtagagggacacgatgtgggtgtgggagggggggggacgaggtggtggcaacaataagtaaatctagaggataggtgttccattagaggttgaactagggtataggtaggaggaaggctttcacctttgtatgagatccaatagcctaaatttgacgggattttgattgaaaaataagcgcctatcaaatacaattcatttttaaatcttttaagtttgtttaaaactcttttctgagtgtttttttcactctataatgatgatttctatttttaactcaaatttctgtaagtgcaccggtgtagaatcgaactaacataaaagagtgggacctagacccatggttcttaaattttggttttgttaggtacctcacggcgtatacaacgtttttatgtaggggccaacatataggtattaaaaatcaatctttttcttctaatgtctcttccatttcccttttttatctttcttctcatgtacattgataagcaatgccaaagtgagtgagtagcctgatgacggtgatgtgaagatatgatttaatggaagccaccttgatctagaagtggggaactctgatcttgtgatggatacacgatctagtgtgcaaagatttggttaattgagtagtaaatgagctccattccggcaacatcaacattcatctagtggctttgaactccaatttgacaacatgacatagccttcttgtcatgtgctgccacctctttccctcgaggtggggactcatgcgtgagcttccctaaggtggtcgcgcttcgatgagtgggctccttcctattggtggtgggtgccaacttatgcatcggttacttgactccttcttgctagtaacaattatgattttgtacgctagcgactcggactagtttagctagctttgttggttcaaaccaaagaatcttgatgttttgtttacttgctccatgctcaaatcgaacgaaatcctcacctctatctctcttggtttgattttatcggcacaagccacacataaatatcctaaggggtggacctagaccctaaacaacttaggccatagcacaagcctcagaagtgaaggcctataaatccaccatgtgaaaatttgacgtgagctaaaataaaatgtgccgatggatccatacgtgaggattgaaagcccactatgtaaggcatatttttatcatgtaaattcaagcacgaagcaaagtgcaataggttgtccccgagccttaggctaatgccatgttagtccttgggctgacccacgagcctcactaaattaatgccagatgtttttttataatggattaaaactcggccttctatatcatgtgcggatatacacggctaacctacacagaatatatcattgatttaaatttcaacagaataaatacttttgtagtgaagagtccaacaacacggcatcatccccatcccaatgagggagaatatgcagtgaaaaacatatacatatacatacatacatacatacatacatatatattggaaatatgaaaaataccgtaggatgaaaaatggacatatgagatttatccacgtaagcacgagtaaaacttttactctcataaccatgagtaaaagtgtaacggggagtaaatattttcctaacaataacggagacaaatatgtaccagacgtctatttttacgtgctaaaatagttttcatatattttttttacactacatattttcttcgcgcaattaccatcaccatgtgcaggaagcatcagcggcacaggaacctcagaagatccgacaaaacgacgtgcaacccagggatctgatctccattgccatgccatgtcatgccaaatgcccgagtgcgccggttgcgacacgggcactcgcaaccatccatcgctccgcttctttctactgtgtgtctgtactcttgtgtgttccagtggtaaggcatcccacctaaaatttttcatcctgtcacatcaaacgtttgaacacctatataaaatattaaatataggctaaaaatatataattacatagattgcgaataatttacgagacgaatcttttaagcctaatatctccatgatttgataattaatataatgctacagtaaacatttgctaatgagggattaattaggtttaataaattcatctcgtagtttactgatggattgtgtaattagttttttattagtgcctgaaccctatacaacatataatataatagccgatgtaacacgttaaaactttaggccactggatttaaagcccgtgcagcgtcccaaagctaaagacaaagcttaagctcagtgtcagtgtcacagtgtcagacacgacgagacgacacgacgacgccccacgtgcaaaccgcagtgcttggcaccatcattaacacgccatacttaacgctgattgcacttattaattctgtagccacgagatgatgatggcaagttcaaacggagctggaggcagagctagagtgagactgtgagagtgaacaagagataagctaagctagtacagcaaccagcaagaacaaagaagagtggccggagtgggcgggggagatgagctcggcggcggcggcgacgaggttcatcaagtgcgtcaccgtgggggacggcgcggtggggaagacgtgcatgctcatctgctacacctgcaacaagttccccaccgttgagtgccgcgccgccgctaatcccttcctctccgttcttgctccggcccgccgtgctggcctatcttctcttcggctcgatttggtttggtttggtttgatttgattcggtttggtttgggcaggattacatccccaccgtgttcgacaacttcagcgccaatgtctccgtggacgggagcgtcgtcaacctcggcctctgggacactgcaggtggggaaagctagctcaagctcaccctcaatctcaatctcaagctggggcttgcaaatcttgttctcctctttgattttattttctcaagtgttgctgctcacttgtgctcagctcagagaaagatctgatttagtgattttgattctcgttttggttggggactgttggttgcaggtcaggaggattacagcaggttgaggcctctgagctacaggggagccgatgtgttcatcctgtccttctccctgataagcagggcgagctatgagaatgttcagaagaaggtgaactgcttagaaaccccttgtcattctgatgcaattttttacttggttggatatgttactttccttcgcattgcgctagtagaatcgctatggtttcctgatgcattgcattggcaagattgtagatatgtagttcagaaatacgcactgtttcaggtattcaggtgggcattatgctgaggaggtatcatgtcaaacaaacatggaagaatattaaaagcattgaacaatttgtcgtgtgtaataataacgctttctaaaagcgtgattcgtacaattgctttcctcgaaaagaacaaggccagttgagccgtggagacttagactttgctcgtcacgcttttcttttgcagctgtttgtgcattatatgcaaggttataatataaagccgaagatgaaattgcgagcaaaggagataatttctgttaatgccgaattaattaccagttgacaaaattgttaggagttgtggctcacttttgatttacttcgataatggtaaaacgcctccggttgtttgctctataatagcttcctaatgtaaataagatatcaacacgaagcttactacctagagacaagaaagcccatttacatgtacaccacattgcatcatgctttgtctcattacctttagaatctctaaagtgtgtactaatgacctgacttcatctggacagtggatgccagagcttcgccggtttgcgcctggtgttcctgtagttcttgttggaaccaagttgggtatgctatgctattcattaattcaccctttaccttctgaaatttcttaattttttgaacgccattcaaccccacgaagatatttgatacagtaaccacagcccagtgacattctttgctgatgctgcattaccgatttcctgtctgttcagatctccgtgaagatagggcctatcttgctgatcatccagcttcttccataataacaacggagcaggttggtgttttgactgtgacaagagaatgacacatttttgccacatttaggttagccaggtttcacatttttaggtcacagtttggttcatgccaaagttgtggctcaacacactttctgagcaccttgtcacacttgtcacacacaatttttccaaatacttgtggcacttgatttgttagccatgctttgtgtgtgttgcccacactttcggaagaaaactgtggcaagatgtggcacacatcctcaacaatgagactttcctgactctttctacatgttagggagaagaactgaggaagctaataggagcggtcgcctacatcgaatgcagctccaagacacagagagtatgcttctgttataccctatgcaggaaaactttggaattttgagctccttcatatttaatcatttactcacatcctaatctaaagaaatgttctttttcttggttacttgtagaacattaaagctgttttcgacactgccatcaaagtggtgcttcaacctccaagacataaggatgtaaccagaaagaaactccaatcaagctccaatcggccagtaaggtacctttgaagtttacactgtctgctcacacttcatcagtcatcacttcatcagtggtgcatcatcttttccagttcagcattttgatttccaatgaggcctttgacacttgatcatgattctgtaggcggtacttttgcggaagcgcttgtttcgcgtagtcaataaccaagaagaaaaaaatgtggtttttgttccatcaccatgatgttcagatggccccatggatctactcagaatgggatagaagatcatggttgaatcaacattgcttgcagctaggaggaacttctagttctctttttttctgcagtggagctccttttgtttctcctttctctttttttcttatgttgtaaaagctccagaaagttttacccttggtaataagatgtgctcttctggatggctacctttacccgtatctcctttcactttgcgaaatgttggaaactactggacctaacagacctaacagacaaacaaaaaagaagccacatgcttcaaccttttcttatatactttggattgaatacataggaagttaattacatcatggtatcaccaatttatcatccatgttaccattaggccaagcaattgaagcaatgaaacaacacgtggctgaaaaaggagaatgcaagtctcctatacatgaatggattacaagaaacaatcaaaacaaagaaacaagaagcatatatacccagcttcttcagatcacacagacatccagaaaaatggcacggcaaaaaagtactgtaaattctccggtgttgacttcaagagtaaggtaacacatcaatctagaagtttacaacacattgataacgagagctagtcgtttcaaccttaacaccgacaaaaccatttctcgccgtcagtcacacacagctcacaacactataaacctccttatggtaattacaaaatgggggagacattttttcaacaaggttacacatttctccttgtacaaacaagcgcactagtatgagtacaactacaaagtaacaggaggacgtttcttggactggcaaaacaaaaaccggatgctgcaccttgcaaagcccttgttcactgtctggcaggttcccatccagaaaatggggcatccacaacttacaagaagcctgcaagaaccatccttgctaacataagtaatcattcttttttcttaaactgataaacttgcaagaagaaaaagttcaacttaccttacagcagatccagcaaagccctcctcttacagtatgactatttggcgccataaagatgaaatgtatgattgtaaatgttcaggaattatgcacaccactttctgcttcagcggtaatccatatactcgttatcgttactgattgtagtaaaatcagctgggttcttgttagttatacagatatcctgtctcacaaaccgatccaagggatgaaccattttacccttgcctctggtccaagattgagctatgctgttcctcgctgataaaaaatctgcactggagctaacagaacccaactgcaatgcattccattttgctgaaaacattccagaattcagggcttcaaaatgttcctttctgttcatctgatgcgatgttattcctgttgacactcctaacttataaccagattgtgtgccacagttctccgaccagtttgcaatttccttctgcagcaaggagccaagcacaccaactctaggatgtgggcgtaaaggtctgtgcagatcatgcagctgatgccgtgataagtcttcgaatgtcaatggaatctttccattcaggttactgccatatgatgtgctggttgatcctttgtactgattatgtgcatactgagaattatgaagttgagactccatctggttcctgctagaagttccatagttggggaagcttgctaatgttgatggatccatcattctcagaagatgcgtcgcaggcatggattctttaggatacaagactacttgtccagcatttctccgatcacataacttactcgcttccatggttgctattgtgcttggaaaatttcttgcatggacctggttaaccgctctttcagcatagcggtccagtggcgcaattactggttggcgagatgcataattgctggaagatcccatgacatgagtagaagtcaagtcaactgcttggataccaggtctaaattgagcaccacatgttgctgctggagaatttcttgtagtggccttaaattgctcccacgttagcttctttgcgtcttacggccccaatgttcagttggtgcttcagcaatatactgatcatcatgatgtgaaaatagtggtgagcttgcagcaatagtgaccatttcttccatccgcaaatgtgtctgctgttcctgagtagactgaaagttctgaggatgtggagactcttgtgtggtcaatgccaaatgaccctgtaactccttctgtgtactttgggatgccaaggacttctgttgggaattagtgtcaaacacacttgatgcataatctgaaccatccttggcagctactattacacaatcatcatcagcagttgtcttggattgaatacggttgatgtcagaacaatcagtctcagtcataagctgcctctcatgctggtttttagctagcagttcaacaatatccatggggatgtcatctatcatggtctgtttttcacgagtcacttcaagtttttgcttctttttcttcttgggtagactctgctcatgaaggtcagacataatttggatatcatgctcagctggagaaacctgagatgagaaatgaggaaaatgtcagtccattacaatcactataatatgagtctaaaaaagaatattgcgccacgcacgtgcacacacacgcgcgcacacacacacacacacacacatgcacacatgcacgcacacacaaaaagagtatcaaaacataagtaaagaagaacagtggaaagcatataaataaacattgtatgcatatttcttaacattgttatgcaccaatattattccttcatacagataaatgttgattcagtcaatttaaaaagcaaaaattcctcatgattcacaaaattcgtacctttgccgagtgactcagaacagagttttcggtttccatctggcattgatcttctgcgctgagtacatgtatgttctgaccatttctggtgctttcaccaccatatttggtactagcagctgaatgtgttttccccttactcaaacccgctgttttcccctttgatgagcacctctgtgtggagatttctgatacatgctgacagacatctgtcttatgcatatttgtgtcaagaccattttcagtatcattctcatcatcatgctgagtactcgcagtgggtgtcacttttttgttgctcaaattcccagctggatgagcaactgtgtgatgcacacttccagttcttttcttttttccattcagccagttcataagtgatgatccatcatctacaacatcagagtatttgcgttttgtcttgttcttacttgattttaacccatcttctcccactgtatggttgctaacaggaatatccatgcttacttccatcgggaccgggatggtacttctatcatcctcacagggatcagcggcattttcacgatgaacttcgtcacttctagaatcctcaacctggttagcatttataatttctgatagaagccgcaccttttttggctttctccgacaaagctttgcatctgaaacatcagcctgggcagtgcgtttcttgctgtgctgctgcttcttcatcaacttcttatccgtcttcctcttagatttggagcttcttttgagaacaacttcttcacatggctcattgcagatctgctcacatttctgcccagacactggtttcggatctttggtcaaattgcactgctcagcaacctgatcacgttcctttccagacattgggttaggatctttggtcaaattgcactgctcagcaacaagagtctcttcagtttttccattttcatcttcatttcttttgaggaccacttcagaaagttttggagtggatggaggttgatctgcaccatttacttctatgtgccatgtaatctggggaacttcaggtaaagccccaacatcaacagaagtgttgtcctcagagacatttgctgccacatcataattttgggctggcccttgcaaatctgagaaaatcacacaaacattagtttattctataccttaaataaaatcctacttaggaatttgaaaggctctacatctaccatacctttcattggtgaatcagtattggcctcagcagctccattcttgccagaaggcgcattgcatttggagtcattgccttcttgcacactctttggaagagttgatctatcagcattcttcccttgagatgattgtgtgctaggagacactttttgggaaccaacactagcaggcacaaaagtgctccgaacaaatgtgatggagcaaccatcacttgtgccattctgctttgcgggaagagttcttggtgctgttccattatctgaagttttcaacttatccaagcacttcgagcaatcccatcgtcgaaactttgctacagaaaatgggcttgaactagctttgtgttcatcacattttttctggtcatggaaaatccgagatagagagcagaattttggatccttcttctgaagaagagcaacataccctctggtacaagaaaaataagattatcattataaagatgcatggcacatatatatagcacattgcgtgcttcagtcaatatacaactgataaactcagaaaaggccctacataatctaaaggatgctgggaggtaggcatttcatacatagcttgtacagtccagaaaaagaggaccttcaagataatctaagtattgcagtttgaattcaaagataatacaaatagcatgacaggataaactacaaaaataataatctaattagttctagaaagtattaaaccaaaacgtgacaagtctatggttgatatatatcatctctagaatctctaaacaattgaaaaggcttaaaataataatggactatcaaatcaaacataatgcaaatatgaagaaaccatcagttctaagaatctcctaggatgtaaacatgcttatgataaaaaagttttatgctgaacctcagcacaaaggaaaaatgattacaaaaatgtagggcccaatatatgagtgtaccccaaaaaggttaatttcattagtaatcagcttgttcaacagaaataatatacaaacacaaatatctagctacagcctacagcatggcctgaataaatgcatgcgcaccccaacacaaacaaatatgatcaaacacctaatgaacacacatacagacatgcatatgtgtagcactcacaatcatgtgctcagattcatacattgaagatattaatggatgtacgtagagtataaagatacatgaaacaccaacatatatgcaaatattatatatattttttgctgctagcctgctagctgtgctatggcataaatgagttcacatggctagatatagagctagtagtggatgtattgacttcctaaatcgaaccaaagtcataagcatgtcgacccagtgtatacgatcgtacaaaacagatgaccatataagtcccaacagcaaactgtgcaaaaaccacgatcaatcatactcttccatcaaacagtgcaatatggcatgacatgccgattcattattcatccacaacgcgatactggaattggaaatacagaaaatgattaccttatggagaaatgctcgcattggtgttgtgccggttcgtctacaccagcttcagcggctgcatcctgacgaggcgtcgctgtcagctccaacactggcgctacagcaccagttccaccacgagcaagcatacagttcgtcccaacaacacgagctccctcctgatctactgcaacaatctccatatcgatcaccacgacgaggagagaatcaacacacagctagcacagccgaggcacaactcaatatcaatccagcagtgatcttgtaacgccgcgaattagcacatcaacaatccaagcacaaaccacaaaccacaaaccacaaaacacgagctctggatatatcacagaagacaatcaatcagctagccgctgcacacgctagaacaacctgaaacagaaaccagaagaaacaaattaatgaagtagtaggcaagaagaagtcaagccgatgtagcaatagcacgcacgcacgcacaatatatatccacttcaatcagctcatggaatataagagcaccagaaattcgagcgggcaaaattatagcaagaaataaattcccccaaaacctagataaacaaagagagagggggtgcgaattaaactaattaattaccgcgccacatatacacaaccataattaaccttccaaataatacaggtatagctaagatagacacatgcatgcacagagagagagagagagagagagagagagatgggtagatctaaaacctagagggaggggccgcataaaccgccgtaactaaaatccgcgcggtaactagggctcgtacgtagccgcgaggatccccgcaaaagacgggatttttttttcttccgcgacatgaaatataagggctttggttcccatggaggcgaggagctcgaggcccgagagaggggcacagctggaaagggggcggacctaacgtggggcttcggatgagctgaacccctctcctcccccaaaaccgcaaccccccaacccgaaaggaagaaaaaaaagtggggaaatcggaagtaaatcgaggcgaaattggatgggtcgatttggggggaggggggaagaaatcggtcaaaaccaaaccccccgcgggagctgttcttgcggcggaggaaaagttcgttgattacctggggggtttgcgtttgctccgacagccgcgacgcaggcggggcggggcgcgatctacccggcgcgccgtcgacctctccccggagctagctgctgcttcttcttcaggcggggggagcgggaggggggcttattggagaagactagtagtagtcgtcgtcgtcggaggaggaggaggagatgcggggtggggcggtggattcgatgaagctaagacgcggttggcgcccggagagggagatcgactggtcgccgtggtcggtcggctcccggggaaggaagaggacgcaggcgcgcgggcgcgccgcggtggattccgatcgagtgggtctcggaacgcggccggcggcggcggcgcggtggtggtggcggcgagtactgcaggaggaagagaagctgcggggggaggggaatagggtaagaagggatttggagtggagaagagagagagaggggggtggaatggaagggaaaagaggaggaggaaaaagaaaggattgtatattttatttgtacgggagttggagttggagttggcgttggccagtccgccctgcccctgcccctgccctcacctcacctccgcagcgctgccctgctgcgtgtgtgggccccgcacgcctttcccttccactctttctctctctctctcctttctcttcttcttctatctccagtaataaaaatgataaaataagctccatatactactgtgtactctacctgccgctgtactctacctggtatgtgtatataggtaggtatagaggtaccgatactgcccgagcatgcgtaggtagtatactccactctaatatcacgcgtacatgcatgctaaataatattgtaccggttaatacgtaaatacgtaggagtaaaaaaaattgtacctatctgtgttttatactcgtgatctacaaagtattactatataacatacagtgctttgtaatataagtagttttaaaatgcagagagcagagatatatcaaactctgacgaagtatagatcaaacaacagagttgattgccccctctgtgtttatgtgttctctgtgtttgtttgtgttgtctttattttttttaagcctagattgattactcactatgtggtgtttaacatgttaaattaaactacagcggctttcttcctgccaaggcatgtctaatgtgatgttccaaccactatatgttgtaccaagttaaatataccacatagttattcttatctcagtcgaattttcaatcaatagatcatataactaggtagacacatgtcactagtggtacataatggctctcaccaccccatgcacagcatatgtatgtgagtgtcctaatctatataaaacgcttaaccttagttctcgacacaggtagaatggatttgacactgacctttcagttgggtttcttctatcaaactcatagtctacgatgttagacaatggggacgtgtaatgtgtgcccttgccacatgcacatgataaccatgttgtaataggcacggccggcatgctccgactctaagtgccattgacctagagaatggcctgctacataccgatgttgcctagctcaaaagtttgtttctccttaaacaaaaacaacttcattgccaataggcagttggccttagtgaggctacaagtcaacaaagccagccttcctccgttgctacccatcctatgcaggacggcacgtacgcacatgaagccatcgacgcctacgtgtatgggaggatatccacaatctaccagcattaagccgacacctctaattctaaattattgatgccaacacaggcagtcacccgttgacacccatgtgcaaccgcgataaacgactagttgtagtcacatttttaaatcccgttctaacctgactatccaactaaaccaatatttttaccaataggagcatggaggagaaaataccaatccaatgagctcattttcttcataagccatgccccatccgtgcgccacaaatatcaaatctttatccatgaaaccatcgtttgaggaagtacgaaggtcattactcaaaaggggattaaattgtaagggaaattgtttttcacttattgacctaaatctaccatgggaacttagattggagtcgagaatcgaaaatgattagtgcgaggaaaaaagggctaccaagatcatatcggggctaagatggtgaaaccaaagtagaccgaatccaatcaagataaatcaaaggattaaaatgacacaattaggtagattaaatctcaagagataactaagaaagatcataaacaatcaagatgcagggccatgggcagacagcaaaccaatagatgaatcaaattgtggaccgtttttacgggttgaaattgttcagactcatctctgattggtcaatgcaaacggagtgatggtcctacatgccattgacctctcaatgttactttggtatagaagtctcgagatgctctgctgaccaatggttggtctttagtaagtcggtaggacaagaacctcttcaagaacagtagtaacaattgtagaagaagggaagatgtcgtggttatggattttgaagtggacacagtggcagctaaggagggaggtcaacacaaccatgcttggcatttggcgatagtggtagccagggaagaggtgttgcagcgtcctatgtttgtttgtgtgtgtgtgtgtgtgtgtttgtgtttttctagcaatgtaggaatgcggccaccaatccgagtagagctaccattcctacattgttgtacatatagctgcatgatgtcgttgtgcatgtgcatactagtgaggattcgctagattcatagtctcctagatcgacacccacatgtcaatgatgctcaaacatgatagcaagcaaatcgatgatgctagtcacactattttcccttccattaagccaatagattcccctataagccgacagaacagtgcaaccaaggcaaaaggacctactatgctacctagcctgttcagacaagccattgtactgctactccggtccaaagttttataaaccattccatcaccaaatagcactcctaagcggttttgtcgataaccatgattgccattcaattactgacaaaaactagtgaaattggacgaattttgtcagcttgtttcttttgaaattgacctatataccaagttggtttctcgttatttattagctcaataatgttcgtcacattttgaacccttgtctacctagctagcccagcgaaatccaatcaacgatagatctaaggcctaccaggcgatagctgacatcctttccagtaggagcacaaggaggagaaaatttgcatccaagaagacccctttcttcctagaccacgcctacggctatcgacgagctgaggtcacctgcctaggctcgactttaacacaagctcaagcaagcctatataatcttcgagcttccaagcgggctcgcctcgacctcgactaccaagcatggctcttaattagtataagatatattttaaggatatataatatcaataaaaataaataatttgttgttaatcacattaatgaaagaggagaaaaggaataagataaatatatgatgccaacaaatactaatccatcgtgtgaatccatacaaatgcatgtaataaaaatcatatactatggagctagatcgagctcagctcgacaaagctcatgagctttggcatatacttgagttcggttcgagctgatcgcgagcctcgaacttcttcgtcagccttaaccacgccccttccgtgcgtcataaatatcaaatctttctccatgaaacaaccgattagaaggggtatatggctaataagatgattaatcaaaaggggattaaattcccacgggaaaaaattttagtcatcaacctaaatctaccgtaggaacctagattggggccaagaacctagatcgaagcaaaagacataacctaaacagatcgaatccaacaaattcagaggattaaatcgatgagaccaacaatattgaattaaagttagagagaaaacataaaagaaaaggaagaacacaaaaaaggacggaaataatcacgatgagaaa

SEQ ID NO: 76252 - DNA, 7233 bp, Oryza sativa
tggtccgcatgtcatttactcggatggtcccacgtgtcagtgtcacgaatggcaatataataaaagtgacgacatgatagtagcaaatctcaccatttttttctacgctaggaaggatgagaagatactgatgatgtgggaagaaaagctagaagcaagaggagtaatcaattgtgtgaaggtggctgtgtggacgtggattcatgtttccatcctcgggagatgtgagacatgtgccctcgtcgctacatcagcacaacagcccataccactggccctagctactgtacatagcagcaaataactggaaatgggttttggcagcgtttggttcttgtagctaggtttaattcctttgtttagataaaaaatagacactactgcaacagattaaattagtttatggtgttagcattaccctttttgatcaatgaatgtatacctctccagcaagtagtaaatgtgtcatggacacacatatatatagatagttgatatccaatgcaatatgcgaaaagcataaatggcatggtttatttgattccggcggtagtataatctttcagtgtgtgtgacacacatatatctcacatagtaaaaatggtatatatgaagaaagaaaaaatgttaactatccatatcctatacatatgcaagacatatatatatatatatagataggaaatatagcggaataactataagtctataatattatcaaagaacaaataaaaacaaaacagtctacccgcaaaataaaagtaaaaacaaaacaggaaagtagatgaattaacatcatatatatgcatcgatctttcctgccattttctctaagaatttttgttcgctaagaattaatgttgattctcagtcgatttaaaaagggaaaactacgcatgattcaaaaagagaaaaaatgataatagacacaaaataggggatcgatccatatataaggaccaaagcgcatttcttattcttactgctattaatttgtcaagcaactcttcacggagttttcggattaatccatttggcattgatcatctctctcctgagtatatatgtcactactgtttgtggtttcatgcatgaacaaaatttacaccagcagtttgattaaatgcgttttactcttagttacttgagaaacactgaggggtcttccggctagctccaaaaggtggtgagctaaatgacctgagtttaaagcctcactctttctaattatttgatattaggaccttgcctaatatttacatttttttactcaattttacctttcacaattaagcgcctttaatttgtgtaaaattttggcatgcgcatgccgtcagtcgtctgcaaatttatctccaggtcattttgtaaattattttcatcatcttgctcatgagtagtgatcacttttctattgatgaaattcccagctcgggatataatttatggagatcgatacactttatatattttgaaccccttttttcagcctgttaattaacgttcatatataggtgtactagcaggaattaatcgtatctttcgtgacgatctcagctgtcgatagtctacaacttctggatatattatacttatcgtccttatacagattacctgcagcaacgtatcttttgatcaacttcatcgcttctagaattctcaattaacctgcaggacagtgtctataatttctgacaaaaggcacacgttaatttctgagcagtgcgtacgtttttgtttctgttcctttcttctgctcgtttgcgttctttttccagttagtttcttcacatggcctcaattatataattaattagctagctagcttagttcacatttgcatcggatcgatctttggacaaatatatatttgcagtgattagcaataaggaatctcttcagttttcccccttttttcatcttcgtttagtttacggattacttcgtaaattaagtttgaactgcatgagtgtgttgatctgtaccacttcttttgtttgatctatattaggtaaattaagctgcaaccttccaagcaatactggaagtatatttgctgtctgtcacatgtctcacatcatattattgtaggccaaattaaacccgggcaattaaatacaaggaatcgcaacaacattaacttaggttacgagcatttttacgggatgtatacgtatgtctactgcatgtcatatataccttttgtggatgcatgcgtggataatatatatatctgccttcgatctgtaatacctttcatgcaagaagttaatttgaagctgcatttttgcacactctttgaaggaattgatcattatatatacatcctagcatttgtgagcataaggcacaaaataattcaattaattactgagtagagaattttcttttcaagagagagactagcaaatacaataataaaacacacagcataacgtaatctacaccatgtctaactacatatatacacctgcgataagctaattggctatgcttgcaaacgccaattaatgtgtagttaaaaacccgactaaaacacttttgtaatttggatacggtgatttgtacgtaataaacattcaaatgaacccgtaaaaaaatatgcatatgccttttactagaaaatatatgtaactaataactattatagaatttttaagcgtttcgtgctttatcttatcatgcaaaacatgcatagtataggtccttcttttgacaactgaagttctcgatcagtatttgcagtacattttgcaaaatagtgggccagctagtaggatttttttatacacagcacatacatcttgttaaaaaaaaatagtgcgtctagtgtgagtggttttacaaaatagaggacatgttcattccaatatttaaaaacaaaccatgaaataaatccgttggattacatatcatggccaccaattgtataaacataagcgttcaaaaattacttccaaaatttagatggtagtgatttgggaccatacatatgccaaaagtagattttctaaataacaagattaatttaatcagtaaaagccactaggaaatgttacgattatttactatgattttattttactttagaaaacatatatatgccctgttttggaattgagcaggtttatttatgtcaatatacaattttgcctgagacgacgtgtccttttcctctgaaccacttaccaattcaaaattcttacatttatgtacttgcacattctattatgtctagtactaaacaaaggtataatttgttaaatctaagcaatttaaggtatactaagactgcccctaatttgccataacttataaaacaaagtacttaaaattaaattccttcttgtataaaaaaagatttccttctcgaatttaaaacaacattagtacgttcatttcattcacaaggtcactttcaagaaataagggcaaccgatgggtttctccccaatctcatcagtcatgcagcagaggcagctgcagggaggggttgcagaagcatctgtgcacagagaatccaggatctgaaatgggtgagggtgagagatcgaatcagatgccaacaccacccgatccatccatccatccatccacaacagcatagagacccccactagcttttgctccactcacgcaaacctatgcagagggccagccaaaaggaaaccctaaccctaaccctaaccacaggtggcttaaccctaacccaaccctaaccggggtgcaggcaattaaataatggtgacaataaaataatgagaaaatgggtgtgtggggctaggaggagtagtagtaccagtagcttggtgggggaaagcaatcaaagcattcaaggagggggactgtgtgaagcaaaaggacaaaataatggtggtggtttgctgctgctgctgtgatgccttttcattttggtgaggcaatgtgcacaccaaatagtgcacctcagaaagcaacatctctctctctctcgtggtggagtatacactgcaatatattaattgcatgagtttaaggggggaatggatgtttaggggctgatttggtcagggtttggtgggtcatatacagggggtttgtttggattgatgcttattaatttgttttatagaaatatgaggatatctgatatactctgaaatttgactgttcatatgttcagaaataaaaaattgtatcattaaacatatctgtaataattttatgattatatcttttaaaaagtatatatagtcaaaattacaactcgaaaaccatgaaaagtcaaaacgtcaagtaaaatagaacaataacaaattatgttgaatcagccattttatcatctttctagtcaatagctgttaattagctttgtgtgtttaactcaacaaaacaaatacggagtagtatggtaacacagttaaacacttaaactacgtatataattttataaattatttcctatcattaaaaacctatctgttacgtgttagctagtgttgttttatttttttaaccccttagtttacagaaaattctctatatccaaatctctattagtaatttgttttttcttccctataattcgtgagcgcatgtgcatacacacacacacacacatatatatatatatatatatatatatatatatgcatgcaaaccttttaatttgtgtgattgtgtcccatcctctcttttcaggctgatatgcatctcccctttacccccacctaccactccttgccgcttagtttccttgtatgtgttcattgtgcgctccatccacaccaaactcactcatgtttccctctttttcccacttttgagcaacatgactatgttatgacaaagatagatcggtgctcttgctgctaataagggcccgtttgaaactctatatattgaagtagcatgcatattaccactgattaattaagtactaattattataagtttgaaaaattatttgattttagaaaaaaattatatattgaaaatatttgcacgaaacgtgttgtttatagttcgggaagcgtgctaaaggaaaatggaaaagttgtagtttggaggtgaagtttaacactcaaatgtccttgatttttatctaccattgtgcgctccaatccacccggccacaccaattttttaaaacatattttggttaatgtatagtagaagcattccaaaaaagaggtgcagacagaaaataatccaattaattagacagtacaattttcatactttcaagcagaggaggtgcaagacaaaagaagattaacaagagggtattatacttgcgagggcaattttgcacttactggcctaaactacaatgggaaggtagatcggagagaaacggaaatatttgctacgcgtgtgtgtgagagagagagagagctagatcagggcaaaatggagaaaaccaaaaatatcaatctagcaaagagaaatttaagaattaaaacaatggaataggtagattgaatcaaacataaggaagaaaaaaaaaggggagaaaatgaaagcgcaagctaaaaaaagaacataattaattacgatgatgaactcagcccgttcatggagataaatagcatgactgtcgttagatgtaccacacgccaacgcctactagagggggagagggtgtgttaggggcggggggtgttccagactatacgtctttcattcatataatctgattaatatgtatggtgaatttaggtaaaacagcgaatccaaaatataaagaaattatcacacattattcagatccaacaaagagaatagaaggattaaaacaaggatccagtaaataaaatcatacggagaataaggaaaaagaaaagggagatcacaaaaaaaaatacattaaatggtctacaatatcaaaggtaaatccacaacgcaaacaaaattatcaaacattttgtaaatgatctgaatttttcaccatttccaagcatgaggaggaatctcacggtcgaaagtttggaagtgaaaatgggccggcatagaccatgcacacattttgcactagaatagtagctattgtggaagaagataaaacgctatatatatgttttggtcgtgaaacagtacatattgtaccatagtagaaaaaatgttacagatctaaaagggaaatgctaacgacatcgtacagacaaattaagataggaaaacaagagaattcacatgatattgcataattacaatactccacatctctacaagctgtgtcctttgggacaaatagggaattctatataaagactccaagtacgtacagttttctcgaactttcttattgagtttcttttgtgacatcacgaaccaaaaaaaccatggcactaattgacaccgtatcttttacaaattcatgcactatcgaaacgtaccccagattatattatattagaaatataaattaattaaccctctgaattgtcgtttatatataggaagctaattactaagagagatctggtatgcatatatagaagaaaaaagagaaaatcccctatgtacccatgaaagttcacctaatcccttctatacctctgaattttgctcaatcccttacatacccctgaattttagtttgaatcccttccatgccctttccgctagttgacagttagttgaccgttaaattcttttgaaaaagttcattttgccctttgctatgaagaaacataataaattaatgaagtatattgttggaatataaaaatttattggatgagactattatatttatgagtatgtgatgcaccatattatttgtgacaaatttacttttacatatgatataaaaagttgatacttatttattagttattaaaagttcttttatgtagcataggtgttttcatagtaatacaacaaatttgtttatcacttcagaacacatatgctaaaaaaatcttttaatagccaataaataagtattaatgttttatgtcatatctaaaagtatatttatcgcgaatagtatggtgcataactatctcatatacataatagtctcatataacaaatttctatgctccaacaatatactctattaatttatatgcttctttataccaaagggcaaaatggactttttcataataatttaacggtcaactagtggaaagggtatggaaggaatccaaactaaaattcaggggtatgtaagggattgagcaaaattcaggggtacacaagggattaggtgaactttcaagggtacacaggggattttctcaa

SEQ ID NO: 76253 - DNA, 8142 bp, Oryza sativa
acttgtttatattttggaatcgatgcactagatggtcattttagatatattgtatacatagttagagtagcaagtatgctgtgtgtactttatctagaaaacgtaaataattcttctatatcaagacttcaacggagaacacacagctgtcgtaatatctagcgaagcaaccattgaaaaccttactaggaaagtaattaactactacccccatctctaaataagtacatttttagcatgtgaagcacaaattaatagggaatataaataaataactatgcctccaaataaaataggaaaatgctatacatactaattttttcttactaaattcttactaatagtactgatgtatcatgctataagtacatctagatcttttataactttcatctacctaaatcaaatgattgagatgattgttagtaaaaacttagtacgtgtaacagagctcaattaaataagagatggttgaaagtgctgaaagtgtagagatggttgggggtaagatgtgtagaaattttaaataagaaacgatttatgaaacatgtactagcaccttagaagtacacttattttgagaaaaaaaaactagagccatagaaacaattagggtgtgtttagttcgcgaaaagaaaatttttgggtgtcacatcggacatttgatcggatgtctaaaggtattttcggacacgaatgaaaaaactaatttcataactcgcctagaaaccgtaagacgaatttattaagcctaattatttcgtcattagcacatgcgggttactgtagcacttatggttaatcatgaactaattaggctcaaaagattcgtctcgcgatttccatgcaaactgtacaattggttttttttctttttatctatatttaatattttatgcatgtgtccaaagattcaatgcgacattcgtgggaaaaaaattttgggaagtaagggcccctttgattcgcagaataggaaaaacacaggaattgaaattgaagtagtaggtttctcaaatcctataggaatcagcaaacataggaaagacaataaaagtcctttgatagtgctatgggaaaaacaaaggaaagtttacaaagaggtcacacctcttactatttttcatatgaaatatgaagtataggaatacgatcctatgaaaagttttctttctttcctatgaatcaaagggatatgtagaaaaaaattataggaatttaaatcctatgaaaatcctttgccaatcctataaatcaaagaggccttagacaaggccttagcacaagggacggagggagtaggtacaatacctggtacgtaaagcatgttgctccccgggtggaaaaacctaggaagcaattaactaggacgtcccatccataagatcaaggaatagcttagctataggattctcacatcatcagagtttttcgtagatctaaagattgccaaggatgggagagatatctctagtcttctggatagtgcgtagtactccatactccctcggtaaaaaaaaaaaagacaaaccctgatttccgtgtgtaatatttgatcgtccgtcttatttaaaaaaattatgaaaaaaattaaaaagataagtcgcgcacaaagtattaatcatattttatcatctaacatcaataaaaatatgaattataaaaaaatttcatataagacggacagtcaaaattggacacggaaatccagggtttgtcttttttttggacggacggagtattcttttactataatatagagaaaaaatattattatatgtagcaccatcaggtaggagtattagctagctagtactacactcgatgactaaatactagctagtactccagtgtctcaagagtagatcagcacacgtcgatcagaaatccactgtactttgctaggagtagtactatacctatctcgtacaaacgggattaaattaatatagattgtatcattaaactactaattaagtaattaagaaacgtacaggtcgattaatttgatgtgtaatgacttgatcgaactaccggctatagctagctagctagtcaaggaagaaattatgatggatgcacgcactactccagtattaatatattgatgtgtattttttttgccagttcacgaaaacgacttaagtatatatatggagtaggccacagagatcaaaaagatactgggtgcggaattttttttattttatagacctttttatgttttaattttattaatagaccgttaaaaaaatattttcaaatttgaaccttttgattgtgtcagcccacctgtaatggccaaatagctctgtcacgccacaatactggccttccatgccattatggcattatgactagcgtggccaaacagccctgcctcagctggcgtggcaagaaggttcatttcttgaaattttttttgaaaatgtctattaataaaactaaaacataaaaaagtctaaaaaataaaaaaaattattgggtgcgtgacagatatatattaacccatattttaagtaattaattaagaaacgtacacatgcagaatgcatgaattactggccggtcatatatgcaagaggctcatgcagttctggcctggtgtttgtggggttcataattggtctggtccatgtccagagcgttttcagtggtgatggatggaatattggaatctagcttatgtcagtccagaaagtatatgatcaacccctccatatagcaagaaaagagatctcagtgtgatatatatgttcagaaaaaacaaggaaaagagatcagtgataatttcgcagacatctgttgatggtgcactaattaatccatctgctgctcataagtacacaccagacagatcatgtgctagatgagtgagatgtaaatttatatatgctttaatttaataataatcatgtgctagatgccttttttagcaggggctactagatgcatgtgtaattgtgtatactgttggtacgaagatggcttaattaattggtggttaggaaattgagaactatatatatacatgaatttaccaaaaaaattgaatcttattaatttggttcaacgtgacaaactagtggtaatgtatgatgaaataacttaattatatagcgaactcgtgggggtcatgccgtcatgacaaaacacaaaggggagtagaatgtatacgctcatctatgatagtaatatataagttcataagttctttaaaaaatatataagttcataattaaagtctttttttcacttctgtacagtacagttatattttcttgctgtgtaatatgcacaaatatgtgtgcaaagttgaaaacagatcgtgcagagtaccatatcagacgatgttttttcatcttgagaattatactcgatcctatttattatcagttcttttccaatcgatcgagaaggaatatccagtagttagtactattagttaatcataattaatagctaaaattaagaaaatataaccttatatattactgcatggtcacacacacgaatgctgacacgcatcccagagcatatggtatagaaagaggaaataagctgttgcagaacatatataggaatggaaattaaagttgaaaacaaatcaatactacaattaacttggagtacataaattaaaaatgatataaacaattcaagtttatatataaatgtgtgtgtgtatatatatatatatcactgatcgaggcatgggccaacttagttgggtcccattggtcattaaataaattggccgggtcacatcggccattagctagacaactggactgctctataaattgtccatatcccagtatcatcatctttcttatctcgtccctttccccatcactctcatccctgccccaacaccctactagtagtagagtattctaacaatctcaccacaacaattaaccattagtttttctttatcttacgtatatactactcctacaaagcaattaaattaataattaaacgacgaaacgatcgaagctagctacccctccgtcaaaaaaaaaagtctaatcctaacaatgaatctggacacgcatcgttgctagctatgactggattttttatcgggaaggagtagtatgcgtagctagctaagtactactccctccgtttctaattgtttgacaccgctaactttttagcatatgtttgaccattcgtcttataaaaaaattatgaaatatgtaaaaatatatgtatacataaaagtatatttaacaatgaatcaaataataggaaaagaattaataattatttaattttttaataagacgaatgattaaacatatttaaaaaagttaaaggcataaaatatttaaaaacggagggattatatagttacgcgcgcggcggcagcgactggccggccgcccgccggcggcgagaggattgtgtatgcaacaggtcagttgttgtagctagttgtgcttatttgagggcaaaagctagttatactagctaggtatgcagctgcggttattgcagctcatcacctggatcgatcgcggcctcgccggcgacatctctactccctcaaaaaaaaaaaaaactaagatgaaatacaattcaagacaatgaattaccctatcccatctttatctaggagtaggttagattttttttagacgaaagaaatatgttgtcacgatacgaggttacgatggataaacactgtcagaaggagtaatgaaaatgtagatttacaccgaagagaaaaaacatttatgcatctgattcattgctttggtctgacccaatgcctgcgacatttatgcatgcatgtgtatatatgtacagttaattagtcagtgctagctagctagacatatatgaccgagtttagttccaaaatttttcttcaaactttaaattttttcatcacatcaaaactttcctacacacgtaaacttccaacatttccatcacatcattctaattttaaccaaacttttaattttgacgtgaactaaacacaccctatatgtagaaaagccggaaaatgaaaggagaataaagaagcatggtcgtcttaggggcctaagtcggttgtgtgaccgtctagggcccaagttggtatgggacccatcaccaaccaaggtggtcacaccttacgttcaattcccacgtggtcacaccttatttcatcgtggctaagacttgtgatgttttcgtcttctcattgcatctaattagtctgaaaattgggctagtattttgttttgttcctgttaattaatttacacaatatttttaggtgtttataatatctgttagcatcatttttgattatatatgatttataacagtatatattacaaattatttaatcttgagggtgtatgttactaggtttgcctaaaaccctctaaaatatagagctggggctgtgaggaaagaagcatgtaatgaggtccgtttgtttatacgtgttggatgattttgaatttctgataattattaattgatgtatacgaatgtattaaattttgtaagttaaaatattgttttaaaatgttttttctaaaaatataatgatgaaaaaggttccaaagaaatcttacttcctccatttcataatataagactttctagcattgcctacattcatttagatgttaatgaatctagacatatgtatgtgtttacattcactagcatctatatgtatgtgagcaatgctagaaagtcttatattgtgaaacggatggagtgctatttagcagcttaatgtatcactgatcatctctaccaccaattagccacgtgtccacgcggtaataataagcaattgagttaattattacctctagctatatatagtcatcttttcgcttatacttatacttatcagccaaaatttaaatttttaaccttaattttggaactaattttgaggtttttttcatcaaagtttatttttcagcctttactgttagatagctaaaaacacgtgtataaaagttttatttacaaattacttttcgcttattccataagcgaaacgatagctagtatctgcatgcctagctcgcttgtcatgcatactggaaagtggatatacatgccaagggatatatatatatacatatgctacgtacgtaacgtacttatgtactgcgtacacgcgatgtacactagcaatggcgcatggaattaactaattttgtacgtgcaagctatagctagctagcgcgtgtaattgaagcaaagctcaaatagtctatacggctgcttgtacgcgtgcgaggaatgacgtcctgtacagcatgagagtttgagcttttttcgctcacgcctatatatatgtgtgtgaagaaaaaccgattctagagaaataaatttgaacatatataatgttgcccaaattcatccagaacttttttttgacagaagtagcttgccacgtcacgtcttttactgagttcttcttatcagtttataagataagctattttcttgtttatcttgaacatgtttcgatcctagctagactgctaacaatacatttcgtgaaagaaaaagttatatataaaagtttccttaaaatcaaataaatttgtttttaaatttataatagttaatacttaattattcggcgctaataacctctaaactaactagctcagccgaactaactgctatttcaaacgcatccttagctagataaaccataacttttttatgtggtttgctgtagtttcttagtttttttctacagcttaccatacataatttcttagggcttgtttggtttggagtaaatttttaccctacagtagtgtcaaaacattggtaaattttggcactatcaaattgggtagtattcaatttaaactattgtggataaaatttggtagcaaaccaaacatacacttgctactattgaagttaccaaaattttggtacggtaataaattgatatcaaaacaaacaagcccttagcaccttacgtgttctatgtatgtgtcatagactcggtggctgttcagattgatgacattttcaactataccattttggtaaagttactaaaaaactatttatgtttagtttgttggcaaatttaataaatacataataaatcctaccaaaattttagcaatattaccctcttaccaattgccaaaatttggtaaggtttattttggttataatttggacaggccctcaattcctagccaacctctaacatatagtatatcaacaggggcggagttaggattatatcaagatcactagagtatgaatttcttgaacaaattttaatagaaaaattagtaaattccttggtattttttctgcctgatcgtaacagttattttccacattatgcaagcttgtgacgacacgagcagcgcatgcaatgcaacgcgggggcagtgcgtcgcggcgcggggggacgggtagctaaggtttaatttgctaccgatcagggcgcggcaaactgaagccgggaagcgaccgatcgagatcatgagcgatgcgtggagccgtgtggacgcatgcatatgcagttatgcaagcagagtacagacatggcaggagtactagctagtaggatatcacacgcccggtgtgctgctgcacaaaattaatactacgtgcatgctccagttgcaagttcctatcgtggatgtatggataaaaaggtcgtaaatagtcttgctacgtaatccctctgtcctaaaaaaaagacaaaccctgggttttcgtgtccaacgtttgaccctccgtcttatttaaaaaaaattaaaaagataagacatgcataaagtattaatcatgttttatcatctaacaacaatgaaaatactaattataaaaaaaattatataagacaaacagtcaaacgttggacacggaaacctagggtttattttttgggacggagagagtactccccaaaaaaaaacttagaagatgatgttactcctagtataatgactctggacaaatggatgcccagatttgttatattatgaggggttgtccagattcattatattagccattaggaggagacacattctctcctaggtttttttttatggatggagtatctctatatataacacggctgattttattcagttattgtcaataatattttttttgaat

SEQ ID NO: 76254 - DNA, 41290 bp, Oryza sativa
gtaactacaaagaaataaaatttcgcccatatgattatgtgttttcaaactaaatagttcgagatgtattgataatcaaagttttaaaactttcacggaataatgttgactgtcagagagagtattaattgtggagctcctagttaattgaacagtaaaaaatgtttttaagactgggaatattgttagataataataatctgaaacgtcataacaatgtccaaagatgtgaaagaaggttggtgatgacagtatataacacgtcgtgtagtagcctttaatttaccctctcttctcttggcagccgggcagtaataaatatgtactagtgacgctgacctgcactccttcacgcaaatacatatatatggacagtagactagctgttgcgtaccatcaataaagatatccatatcatatctagattgggtggcgttcatcgaagatgcctcttttagcaggtaggagtagggtacagcagagactgccaccaaggcaagtacggacacagtcctgctatattaaagacagtagtatatcagaggggggaaaaatacatgcttattatactagatcatcaattaatttaccagcgtatcctctcagcggccgtgatcagtacacacggtactgtatgtataacgaatcaaatgaaatcaatcggggccgggcatcgtacaaaaccggaacaagattatacattcaaatgctacaacagcgtatgatcaagccacgtggggaaaaaaatgtgtaacaattacacaagagatattagacctcttcacactttttttttaatactccatttgattgtttctcattaagccttgttctgctttgttttggcaatgctaagaagatctccaaacagcttgtcctcaggcttcgatggttgccccatggaagatgatgatgaaggtgttgtagagtagggcgagctgttcatccccatgtaagagctgtcttgcatggagaggccatacattttctgggagaggtcattcataccagcgtagtatgttggcctcccttggctgttgctgtagtattgtgccgcttgctgctgcacaagccggtactgggacatctgggggccatacattcgtggttgcggcatggctgcaaactgcatacccggcatcatcatcggttgcgcatacatcatgactggctgcgctcctggcatcggcgaaggttgcatcccggggaattgcattcctggcatggagtgtggtggcatcgaaccgaattggttcgcaaagcctgattgcatctgggttacagcaggttggctgggttgcatggctcccggttgttggttgttgtacatttggtgggcttgtggacctcccatctggttcatctgcgggtgcaagggctgcatcccacccatctggtttgatggtgttgggagagatggcatacctccaaattggccgtttgacaccgggtgagactgcataccgccatttgacatgtcgccgcttggcgctgactgagcttcccaaggaggtgggggaagggctccactttgctcatctacaaaattcaggagacccatcagaatttcttcaaagctcaaacagaacacaagcatggacatgcgtggttctgacatccaatgatagggatgatggtgtaggaaaaaggttgagaaatgtaaatgtataaataaattgcaataccataattcactgtttgctgcgctggaggcgtcgcattgttcgcaatttgaccattccacccagaacttgtggggtatgatgttccagggttcacagctcccccattaggatagaggcccacctgctgaggctgctgctgtgcttgcagaggatgctgggttggagcattgtatggctgtgatccaggaagagtagagctagaattaacaccaaagggatccgcaggtttggcaatgttattggttgtgttgttttgagagaatatgtcaacgatagctagtgcattttgacttggagtagaatcaactactggatcagtaactgggacaagcgctagtgaattttctgttgtagatgggttgtcatcccagctaagaagatcgacgccaagatcggattttggtgctggggttgctgagccatttgacaccggaggtgctggaagcgctagttgctcaaatggtgactgcacactggcactgttacaaaggcaggtcacatgcaaacagatgttattaaagaagccaggtaaaacatgataaataatcaaaaaaaaaaagttacgaatatagatcatcactatggtctagtgatactatgaaagccaagagaaacaaacaaatcaacactaaatgcagtttggatcataaaatttggctaggttcaagaaatgcacatttatctttattttagagagagaaggttctacctacgtgctttctctcaacaactatctttttagttctacaataccttacagagctgagagccacagtttgctctgtttgctaccaaaacaccctctaccataagttacagaaaacggatattcaacaaatttgtaaaagacagcactacgatttccaataccaccaattcaagtaaaataagaacagtcggattgtagatttagtgtagaaaacaaaaactgataccacaccaggtagcagttaagggccccaatcagtagtcacagtgattaccatgaggagtcagtagtcacaggccaaggctcctcatatgcaaacagtggctaccatgtataagatgtacatatgcaaataggctggcatatggacctaccctccaacatgtcctaataattttgatatactagtactgtgcagaaagggagccatgggtgtgattgttcagtggtttgggtcactagcatttgtagatgccattgggcttccatatagccactgaccttttatgattaaacaagagaaagtagtgagaagatgagaaaaatttagccccagggtataatttgatgataaaatggattgcaggggtgttgataaaaacaaaaaaaaagtactatctccgtttcaggttataaaactttctagcattgcgcacattcatatagatgttaatgaatctaggcacacatatatgtctagattcattaacatatatgaatgtgagcaatgctagaaagtcttataatatgtaacggaggaagtacttgtcaagggtataaatgcattgactatcagacttgtaggggtgttcataaacaaaaaatatatgtacatatgtggaggtaagcagcaatggtgatgactttttggattttaatcggtgtttatgatactggctttatcaggaacataaataggaaattttatacacatgacaacatgttgtctggaagtgcatatgttcacaagcctaaacagctacactacactgggcaaattgctgccaatagcagaaactgtattgatcaattacaatgtacaaacttgtttgttctttagaccaagtataattagcagtttagaagaatagaactctgcaatggaaaaggagaagcctgaaatacccacagaaacatggtggatggtacaattgtacatcaccaaaactgaagaactatattacagtgtttaagcacttgttaataaagaataatggctaattactaataaaaaaattgtttccagcatttatgcacaaaaatcgcacgcacatgggctgatatcattcaatattacctagaaataagaaatatgcaaatgtgacaggagaagattataacctttggcttggttctttattagtctcttgggttgtaggatcctcaatatctacaagtgcctgctctttcttagagtcttggttcatagaatcctcagtgtctacaagtgcctgcagagacttaggtttcttctccactcgaactgcaatgcctgcagcaattgcatcgtgttttgcgagaacacgttgcaagtcatcattcagtgcaagcccttgtgacataagttcctcatccctgtaaatggccaaaccagaattttagtatatatgttgcaataaatagttaaatgagataatacagatgccagccaagggctacttttgccagcttttcatgagtgaatattttatatttggatccaaatgctttataagatgataagataattcttatgatcagctcttcttgagcataacattatatctcacacaggaggaaatgttatagagattaattcacaaaaatgacaaagaccatcctttttaccatcctctactcagacacatgcccataatccagggttgtcaaggaagttcagtcagtcaacttcatccatatcttagaagtaaaaactatattcaccaaatattagatttactcacgcggtagcattaactagtagtaccactctctgcttgtaagtgcgacactgatcaacaagctccacaattacctcctgccttagtccctgtgtacagagtagtcagacaaacaaaatcagtaaacctaacacaaaaggaggttgttaagtaactaagtatggaacatataagtacagatttgaacctcgaattaaaattccatttagacttctgtttattcttccacaataaatggattttaaaatataatggagtactcctttattctaagatttttaaatatgggtgtccaaacccacatacgaatgttatcaaaagcatgaaaacaatggtataccatgttcatgcttcgataccttagttaccataccaaatagatttcataacaatatagggtacacggcaaccaggcaaatggtatttcaagtaatgctgcttggaatcaatgaacatttgatagactacaggctgacgtgtcatatactcaaatgtttatagaacataagcaagtaagggcaaaaacacgctccacagcatagtaagttttatgtggttagaacaagaccatttctcaaattaaaagatcaggagttatttctcaaaataaaacaagatggattgttttctttaacaggtatttgtgacactaacatttagatgtgctttttttttgtgcagcttgagtttaaaagcaaggtaagtgttatcggtacctctctgtttccagggtctaaagcatttagcatctcggctagcacatccattataccacgagcattctgaatctctgacatgctgaaaatataagcatacattcagttttacttcaaatgacagaaaaagaatataaggttagagaaacagcaggcaaagcaaggtgaagtagatgagttattcaaaggttctcactggagacggaaaaaaaaaaaactttactccaaaggaattagtgacttggtggttgtgatgaagttcttcatctatcccccttctttcaaggattcttttgtggatgggtttacacaaacattttcaaattatttgtaatatcttctataaaggattacatcctctgcacagcacatgtgcgtataaggtgtcaattgatgtgatgtgaattctgtatgcaattcttttagggcgtatttatttgttttaagtttagaatttatagtatatttatttgagatccattgaaattcacaggtagttaggtactacgctagtattgtcatagcactttacacacaactttgctaaacagatcagcaggaggtaccgactagtgaatagtgatcttctaatagttatagttttccacatgttcatgtgataatctcaaaccagtaaagagaacatataggaaaagatattatcaaatcagaaaatgaaaagtatgaaagcacacctcaaagcaggaaaatcatttccagcagacgattcagcttcatcctgctgatcaggactacgcatatttctgcctgctggagactggccattaaacaatggtgcaggtcgatcagatctctttggaaatgcagctccagcacgctgcaatagtgaaataggaggatagctatgtcaaacagcaaggtgaattcccccttaattctaacaaatatagatagatcagtaaccaattaatcacatgatcaaacaatgcaacgacttctgaatatggaaaattcagtgtgggaaaaaacttcagagcttgataaaccaatctgggattcaaaaccataccaccaagtcatggtacgctgcatagtactgtggatatcttgcacgtggtcccccgaatgcttcttgccatgtatctatcatagttaataccttctctttgacattctgatcagactgtaataggacaagaacatatgccatcatattcaggacattaaaacaaaacagcttgagatcaaaactatggagcatatcaaacctttttcttcactatcttcaccatctcatgcaacacatctctttctgcaacatgcatgtggaatatatccccacagttcttgattgcagtttccaagagctgaaacagagctcccccaaaaaaaatcaggatattattcattttagatcctgtgcaagttgtcctaaacaagatacatctccaaaataataatgaagcataagtaaaataagttgtatcctcatcaaatctccctcccaccttcgtggactggacaaggaattaatacacacatgtttattatgaaatgatgttcctttgtgctaatgatgcttcaggttgcatggttgcaactgatcattacattaacacatgttcatgaaatattggacaataatattaatacagactggaacagtagtgcttagtgaacaaaataaacacacaaatatagctgagcaatagacatatatgcttgatgttaaaacacacagagaagagattcttcccattgcttgtaccattagcaccactcttaaaaaggatgtaaagttatgataaactcacagtcagcgcaagaatttggacttttggatttttgtgcccaatccttttcttgagtgccttaacaacatcttttgattgcctgtacatgacaaatgtttgctcatcaataattgacgaaccaaaacgaaagaaattatttacaatacaataaatattcatcttcagagtcaacctcaaccatttggtttccaatcacaataaccgaccatgaatcaaggcaaactataaaacctctagacaggaacagaatcattgcctcatcaaaaccagcagacacattaaacagcccaactgcatcaaacttttggtggcctccaccactaacttagttgtaagttgtaacaactaatgactaccgttagtagctgtatgctaagtattcaactaataaagatcatacgttgcagcagcagtacagaaatactagtttaaaagcatgcaggtgaatcatgaagcagcactcaagtagctgccttacgataaggaattaaaggtactctaatatgcaattaatgcttcacagtttatcctaaagctgtgcttgttaggttttaaggttaataaatggggtagccgtttaaacaaccaaataatcttggagacacttaactaaccccctgagttctattttctctccagctaacctcctcctcctctatctaatcactaattttgattaatgttgttagctgccaagcacaaaaattgggctaaactaatcttagtaggattaatgtaagctaacctaatttttacagcagctgacaaactgcatcccgagtcaaatgggctagttgtcatttgtttgaagaaaacagtcaagttgcagtggcgagcaaacattcatcatttctatttttcaaccttctcacaataatatctactaccttgctatattgtgggatggagggagtacgaaccatcctaggttgctatattatctgcagtttctttttttttctctctctactagtatgtgtgtcactaggaacacctcgtaagttatgaaactcacaggttactgaaaattgtttatgaaagcaatattattccatatggtagctcgtattttctcctcggttacggttggttccactagcaatttgccagtgaatccatgaataccaccacgctcttgcgatctaactgcagcgtatcatcttgtcacctcaccaaataagccaattgaacggcaaagcaagcaccaatccccagcaattctatctagccatttccaaaacttcctcctcacaatcaaagacctcatggcgaaccaggatgcgagcggagccagatccaccgccaccgcaaatcctgatctcctcctcccatctagcactagcattcattcacccaccaccccccaatcgcattctaattttcagaatagaaggatccaattcccgcgccgctgtgccccatcatcccaacgagaaaccacaccaccaccaccaccaccaccgctcgccgcggatcaagatcaggcagcccgccaccgccacgggatcaagaggagcacacgtacccggggtcgcggttgcagatgtcgcagatctccatgttcttggcccagtcgggcccgatgagcatgtcgctggtcgcccggtccaccatggagcccgccatgcttcccctcctcccaccggccgccgccgctgcccacgctccggcggcgcggaggaaggtggtgcggccaaccacccacccaccctagctccggccagccgccccccctcctggccggattcgggtcgccggcgagcgagcgagcgagcggattggcctccacctccagatgcgatgcccccccacccgccttgtctaacgatttcctcctattttcttttcttggaaatttctccccgccaaattagctctcccaaaaaaaataaaaatgaataaataaatcattttttttattttttttaggaaagttaacgagttcgtttggtaggtggcggcttgtcggatggatctgagctgtcccccacatcataactgtcacttttccctcaacgtgggcctccactaccaggcccattttggcccatactctacgtgggccgaaacactgaggcccattaaaaacgaaaacctggagcggggaggcgtcttcgtcttcctccctccgcacgcgccgccggaagcgcgaaaccctagcaatggcggcggcggcggcggagggtggcggcggcggaggtggggcggtgtacgacccgagctacgtgccggactcggtgaagacgttcgtggcgcacatgtacaggcacgtcagggacaagaacgtgtacgagatccaccagatgtacgagggcgggttccagcggctctccgaccgcctcttccgcgacgcgccgtggccggcggcggaggccgtctcgccctactgcgacggcgaccacgtcttcctcctcctctaccgggagctctggtaccgccacgcctacgcgcgggcctcctcgtcgtcgtcgtcgtccgcgccgctcaccgccggccagcgcgccgagtcgtgggcgaactactgcgacctcttcagcgtcgtcctccacggcgtcgtcaacatgcagctccccaaccagtggctctgggacatggtcgacgagttcgtctaccagttccagagcttctgccagtaccgcgccaagctcaagaacaagtccgacgacgagctccaccagctcaagcagttcgacaaggtgacacacccagctcaccaccaatgcttcttgattatgcattattactactattctttcttagctgcagcctaatctaatatgtaattcagtttctttcttatctgcggcgcataatataatcggcaatccggtttgctgaattgttcttagctgtggggtacaatctaatatgattttctgatttgttcttatccgtggtgtacaatctaatgtggtttgctgaattgctgcaggcgtggaatgtgtacggggttctcaattacctgcaagcgctggtggagaagtccatgatcgcgcagattctggagagggagaaggaagggctcgagcagttcactgccaccgacggctacgactaccagggtggcagcaatgtgctcaagatgctcggttattacagcatgattgggctgctcaggatacactgcctccttggggattaccgcactggcctcaagtgcttggcaccaatcgaccttaaccagcagggggtctacaccattgtgattgggagtcacatctctgctatctaccactatggctttgcaaatcttatgatgcgcaggtactaaagttcattgactgccttggaatcaatggatacttcaatctacagtgccatgttagacgcagagttttttgctcttctatgttcaaattgtacttaaatcacatgaaatgcgtcctaggatataaacattatttccagtaaaattagattgagtcatgttgtacagccacacctaggatataagcattcttttcagtaaaaccccattttatgaatttattttttaattcactttcttgaaattgcccaagatggttgttttagctaatgctatattcttctggtagatatgctgaagccatacgtgaattcaacaaaatcttgctgtacattctgaaatataagcagtaccatcagaagtccccgcagtatgaccagatcttgaagaaaaatgaacagatgtatgccttcttggcagtttgcctttccttatgcccgcagcacaacctcattgatgagaatgttagcacccagctgaaagaaaagtataatgacaaaatgacaaagatgcagaggtttgatgaggaaacctatgctgcgtatgatgaactgttttcatacgcatgccccaagtttattactccatcacctccagccctggatcagccacttacaaattataaccaggtaatgcttttggtgttaaataataatgtatttttctgattcatagatacgtcctatctagttgttactgcagtcaatctagaaatttgtctcctggtgtttggttcacgactgcagctactggatgttgtcactccttgagcccttttgccttctcttcatggactttattgtgtttgccaaagttctgacagctaatttactctttcccaaaaacaaattaataaaatcaaatagccctttagttacttttccttgtttcagactattgcacattcaattttagggtgaaattgttcttccctgttaaacaaagtaaattctcctgcagtaaaacattccggtggtttaaattccatttaaagctcctaaaggggtcataagaaataggcatgttatcttgtcacatggaaatgatagaatgtaggctaaatttacacgtttgttgattacacaaaatggtgtgtttctgattattgtggatgtctaattctataggatttgactttcttgtttactacattttgtttattgttttactattttgtaacaggatgcataccgccttcaattgaagttgttcctttatgaagtgaagcaacaacagttgctttcagggatcagaagctatctaaaattgtattcaacaataactattgccaaacttgcgcaatatatggaagtggatgaggcaacgcttaggtctgtatgataattaacttttcttggtaatatttcaaagggccatgaagaacttaagtcaatatttgtacaggtctatcctgatgacgtacaagcacaaaatgcatgcagttgacaataatggaaagattgtttccagcgcagactttgatttctacattaaggaggtaatgtgccataataatacccttctctgaggcccagaatatttttgtaaccatttcttgtgttgatatacaattcctcttttcagctgtcttgataccttccagctagtaaatagaactgcatagctgtaaaacttctttaacgttgcaaattctccaatttcaagttgatatttagttcttgaatatttgggtttggcttttatgtgtgatcctctaatccttttgcttactcagaggtagctgtagttaaggcactattggcatatgccattatgcatctagtttgacactataattaactgccaataatctatgtgcaaccatgcaggatgttattcatgtcatggagtccaaaccaatcaagcgccatggtgattactttttgagacagattttaaaggtatccataccaccgcttggcataaccttgctgtgaaccactactaccatttgcatttcactatttcttctgaaaataatgtgtatgttgctataccttcaaatctttactattatcctgcagtttgaggaaatgattggtgaactggagaaagtacagtttgactgagcctggtaggaatcatggaggagcggggtacatccccacttagtttagctgttgcaagaggcactcatgatagttattgtgtacttattaatatatgtgccttttgtactcctttttgacttcagagatgaaccggtaaattctttttgaaaattgtaggaacttcagagtctgaagtttgaattctcactactgtgccatcatggcgttttctgtgatgattctatacagtagttgagctattatctcttctagctgttcgatatagtccttgtgatccaattgctcgtgaaattgggtaaatggtaagaaaatattttgcgacattacttctgtttttttaacgtgacccgataaggggaaaaaaacgctaaggcatctttggagcacgggggattagttcaattcttataaaaatcatccaaacatccttcaaattccaaaggaagcataaggtcgctgcagctggctgcgttacaatgttgtctgtcttgaagatgctctgcacagatctgttccagcatacgaaccccaaaattaacgtcaaagaaccttgctcacatccacattcaggtaggggtgaaaacggtacggaaaccatctttatcgttttcgttttcatatttttttttcggaatcgaaatcggtaactccggatacgaaaacggaatcgaatattatcgaaaccgaaaatggagcgaaaacgaaccggcacaaatacggtaacgaaaatttatcggataaaaaaaccctcaaactgataaattcaattctcaagtctcaacggtcaacgattcatcatgaaacacaatcatataagtccaattgttaagtattaacaatacatcacaaaacacaatctatgtaataaattatctatgttttagagagtaacgcagttgataaatctgaatgcaggaaaaaaatattcttatgtaattttatatttgcataaaaaatattttttaaaaaaaaaataacaggaaaacaccatggtattcactattaagtgcttaaaaaaataaacctagagtatttaagttacaaaatttctagaaattctgaaaaaaaatccgaattccaagaaaatttccagaaagtttccgaccgattccgagttccgacggaaactgccctttatcattttcgattccgtttctgagaaaatatttccgaattcgtttctgtttctgaaaaatttcgaaaaaattccgactaacagattccgtttttgaaaataggtccggaatccggaaagttttcagccctacattcaggccatggcaccacattttactgggaccatgactggctggctacatgctttcagctatggcacagtccaaacctccaaagttgaagacttgaagtttagcaccataccatgctgaaatctagctattacactccacaaaagcataattatcgacctggcttttcgcaaacggtggactcgaaatttcaactactgcttatctacccgacttttctggtgaaaagcctggagaaatcttcaccttcaccatgcataaatgcggattatgaatatgtgacacattaaacaggaatgaattaaaattaaatataacagtttgaacagcccatggatcctgttgccttttggaagctatggtttagcttcaacattttatagctgaaaatgaaaatctaggtgtaggatttgagtataacaggcataaacttgaagaatttctaatagccaggtaaacttataccattatcagatattctagtactaccagaagtgtgatcatagagcggaataatgtagcttctgggctgaaattgtaaggtcgagagcaagtcacaagaagcatctttttttacggtaatgaacaagatcgttcgcataatgattgttacagcaagtctgaggtgtattcctcacatggtatatcaagctatctaaaacttttcagaagatgggacgaaggaataggtgagctcagatatcttcccagattgctgccagcatttttgtctgatgatctttcaggtgtggtacactcgaaatccaggactctaccctctgcctgaaaaatatggataaaaattacgatcaatagtgataatacaaccaaacaatgacattactgaggatgttaatttatgctcaaaagtgaccaattacagaaaaaaaaaacaactgctatccttttatttccttttctatttttcaacaaattgctaccattttggcactcacaaaccaagattttgcaagagctacaagctaagaatattaacgcaaaggcagttcactgccgcgtaccatgatttttgtttgcaatttggttgtccctggttccttcttggcatctggattccccgtgttttccttatcagagcttatgttgtcacattggccgccgcttgccagtacctcacgggcttccaccaaagcagcagcagtctgcacatttatctgcttcatcaatcctagtgcgtcgtaactatcagctgggctggtgaagtatgaaccctgggaggaacgtatggacagaagttaaccaaagaaaataacagtaaacaaagtaccaaatgcgtgacagcatgaaggattaatgaaaaactattatcaggcacaacccagtagtccaatatatttccatccacttaacttaacccagtagtccatgctttttccaaacactggatttctatatgacacaatatgaacatgagaaataaaattaaaaaaagaggtaaatgtacctgaaaatgcatatcgacgaaccaaggggacttccatgctgaaggagattctagtcctcttttgatacctggggtatcagccaatctaacaagagcaacagtttagaatttcagaacgacaaattaactgaaggaacaaggatcataaaacaatctcttcagacttcagtagtgggtttaattccctgatgtattatcctaaatgtatcatcctaaatgcattagggaattaaacccacatttcagatgaaataacgtgccaattacagtaagatggtggctaaaaggcttatgataattcatttgatacaaaaatatttttcagtttctgtctaaagatggaagctcttgaagggatattctgattgcatagacaaggatgagcatcaacttcataaatcttgtactggtttaagtatctaagtagatatcaggaaagtgaaatatgccacaccactgaactaagttcaacatgaaaaccctgcaagacccagtttaagtttaggtttagcagacttcacaacagtggcgtagctagctaggtggcactgtggtccacctacaaatttgatcaagattaaaactatagtatatgtactggttaatataataaaaattgtatagtggaccacccttttaattgacctagtacatatagatggaccacctactttaaatcctagctacgccactgcttcacaactattcagaagcatgcaggagtatgggttcaatgcattgatgcttgctaatatcaagaaaaggaggaactcatcattcactagagatcagtttccaaaaaaaactttgattttcacataatctgagaagataaccaaacaaaagaatctgatggaaaacaacaaaggaacatgtgagtggtgtgaagtcttacatgttcacatattcataatccacatttatacatggtgaagatttctccacgatgagttcagtgggctttgatttagcacacactccctccttacagactgataaagatttcacatttgtgttcagcttctgattcatggtatttttgccataatctggggaaatgggatcatcgccgctgtgttcaataagaatacctgcaggttgctgcatcaaacaacaatatagataagaacaagatcatcagcaaaactcatttgctattttgcccgggtctgcccagcccccatatttcatactactaacatggttaaaaagcacttgctacactcagtcattcagggcattaacttggtccacctcctcaaagaaataaggtactactgacaagctaaatatcatcagaaactggaagtacttactaaattgcctgacaggtcatcattagtagctacatttgttgcagaactgcgttcccctgttgtctgctcgtccatgtgttcgtcatttccagcactctgtccatcttttgtctgttcagttgtgtagcccaaattttccttgttttcatcagagaaaacaagtttcttttccagagatttagaagaagcagatcgctcaatacgcaaaactgtagttataagtgcatcatctttagtggcattgatacaacttgtttgaatgccggtggaggatgtgtctgataccccacgatccttttcagtcccatatttcttctcgattcttttatctggaataggagacaagagatctctgtgacgtttcttcagtattgatggcgtgcatatgaagcttttggcagcactcttcagcaaaacgcccgtgctttcatcatgagtaggggagccccacaatctcattggcgtgcagacattcatggttgaatgcattaactgccgaatgccaaggggactaaactcttggagatcaccagaggttacaagatcgcaactgacaaatggaacatccaggcttggaaaacgaggaggttcgtagaagagggctcccttgtcctgttcatctggtgcagtcacactctgtgtaagcgatggttctttctctagactggcttcaggttcttccgcattagtaacctgttggtccccacattcaggtatgctttccatcgttgaagaaggaacatgtctgtcattgctacaaccagggttagcaaacatttcagcatcaccagaagaactggaagattgggtaaccacttctgcctgagaaagtggcatttccttccgccctggtctattatcgaaaggtgcatcatcagtcatagcatttgaacaaataagagatggaggtactgacatctgtggactctggtcatcagcaagccccatcacacttgaagaatttgatgtctgtggcatgtagggtggtgctaaaaaatgggtatctgcttcagaggaatatacatccgattggtgatttgatcttgaaattgaatcagcttcaactgcatcaggtccagaaagaaggccctgtaaggaaatatcctgccagagttcagatttcagacagttaggactgttgaagtcagcctcagacatgaaatgtagtttttgctcagctccagaatcacttgataacatagagagaggcacctccattgctacatcatatggctccagagatctttcatgattttctatactacaaacagtctggttgtctgcaaaactaggaacagttggcatttcatctatagtcatgtccaaattcagtccttgagcaaagtcctcttgcaagtgttgatctggatccaagttagaggaagaaacatggcaatgcacagcaggcaaagcagatgcaacagcctccgcagaagtatagcatgcttggggacccatggaagattgagaatcatgtgcttcattcttgtcaaaattcgcgtttacttgcaaatcacagcccaatggcacagtagtatcatgcacttgggagcaagaaaccttggcaagtgatgattgactacaccctgatgaattttcaacctctcggacagcaaaacaaccactatcttcactgttttgttgggtcatcgctggtgaggaattacaatttgcagaatattcatttagagggagacacgaaacttgggtaagtaaacctgatgacatgtatgaattgactttcttctttactgaactgttccagtgatttttaattgaattgtccgtcctgataggggaaacagaattttaaaaattcaatgacttcaatagtctaaaagaggtttttttaaaaaaattaacaagaagaattaattgcacaaaagtactagatcattgtgcattactccctccgtcccaaaaaaagtgaatctaggactggatgtgacacattctagtacaatgaatctggacaaatgtatgttcatattcattgtattaggatatgtcacatccggtactaggtttttttatgggacggagggagtaggtcataaacagctagagaaggcaagaatgctaaacttgaatagatgtgtcaaaatggccgtaaaacaaaaattttgcatgcatcatttcatggaaaagaacatagattaatttcaagcagctcttaggtaaggaagaaacattaccttcctggtaaaaattttgtcagctcggcccatttatttccatacattcgatgagcatgtatgagggtaatttcctcttcttgtgtccatgcctccttgtttatgccagggttaagatggttgtaccacctaaatgcagattagatgatacatctgtaaggcatccaatacattgtaatgatactcaaattaaaaataatgctaccatgcatattaagaaacaaagttaggatagtttacaaaatactgcattgttaaaataaattgtacagcatatatggattgtttaaatccaccacatggtttggcagccttcattgtacaacatatatggtctatggaagaactatgtcaaaagaaaacctgcattcatctgcagaacaaaggactagaagaaagcagtagttgctagcacaaagaagctaccctgttgagacccacaaaatatattgttctatctttttttttacttggtgcaagctaaatggaataagtaattttcatggcattaccgttctcgacattgctttcctatacgtccaggcaaagcttgagcaatggttgaccatttctttggtccaagtttgtttaccatctgaacaatgatttcatcttcctgaaaaaaggagcatgccattgtgagcgtaagatgagtaaccaatacagtattatttaagagatgaaaataaatcaaatagcatgcttacttctttggaccatggccctttgactaattcagggtttagaaccttttgccacctgtgcaagcattgtacatcggttctatccggaaagcattccgctggaaaattagaatgttctctgtcaaaacttggatttttaacaatatactggaaatctcatcaacagggtaagcatgtctagggtgtgagttaatgaaacagcagaatgctttcctgtacatgagttagcataacatcgaaaataaaatataaaatatgctgattggtttatgatatcctagtgcactaaagtacaaatataaacaatggttagaaaaaggaagccttgagaacaatatggtaaaaatgcattagatgttatgtataatattgtgaaatataaatattattcctgttagaacctgacatgaattgccatacaacagtatgtaatcataaaccaaatgcgcaaaaaaaaaataaaagaaaaaatccaagggagtctaacatatgcgtgataagctataaaatgcagtgttatgtagataccaaatggattttagaaggctattttattttgtttatatattccaacataaaaaaaaacaaccataaagaattcaagaaaaagaaaagtatgtcagctaaaagatacaatacaaatacaatgataaagagtaaggactaaggaaatagccaaagaatcattgcatgattttccatatcattgcagcaatcgaaagagcatacctatttttttccagttcttcccgttgtatgtctgaacagctctggacaatatggcatcctacatttgaatatcacatatgtgcaatgttaaaccatgtaagcaagaaaatttatgtataagacacatggaaattttaaatgttgcatgagaggctgataagatgggtccaggctcacatatcagtgaggcattaaaaggcatatacaaaatagaaccaaaatgctgctggttacaatttacaaagcatagaatcagaatataattgcacacatgagtatatgacaaaaacagaatagcaggaaaccccaaggtagaagagtgaagtttatgatttgcctcagagtacatgcaatccactcgttgacctaaagttgcccatggctcccttggattttagcaattagtaaattatcatattcaacttggtttgtaggaataaagcgccaaattaagcaactcaagcctccacacaagagtcgggatttaaattgaaatgttttttcatattaaaaaattataggtctttgccattaaacacattagatgtctacagtcaatcattctcaacaatacataaaataggattttcagtcaccatttaataattcgtacaggaaaaggactctttgtcaacagaaacacaagatgacattcatgtggtatacctcttcaggggtccaatttcctttggtggaacgccgtgtcggaccggtggtcctcctaaatttgcatggacaaagaaacaaaacaaaatttagtacaatatacattacgatagtcaaaagagcttttagccttttacccattgagaggtcgtcgcctttttggttcattgctgatttctccttcttgaggagccgacggaggtccagaaggctctccatccttatctggagcctttccgttatcgcttgtcatcatgagtgaagacaatcaatcctcactttgcagtagaaacctccaagggatataaaaatcattatactgtcaagcctcagtgaggccttcagggagttgctccaagggagaagcaatcataagctgcaaaagaattggacgaatgaagatattgtcacaagatgtaacaatagaagcattcagggatgcatagaggacaggacattgactaccctcataagaacatgaattctcatttcaaaggagttggggtagaattcatgtcattttcgttttattatagagatggattgtataatattttatctaaaaaaagagttggggtgataatgtgtctacaccccctcgttgtacatctttatgaaaactaaaaaatgcatcattcaccctgatgtatatgtagatggttgattgatatgcagtcaagtggataacttgcaaatggggaaaaactcctctttgcttccgtaaactattctgcaaatctacttattagctcattctaccctccgaagtccgaactactgaagtagctaatttcacatttagggggagtaaaccttaagctttctgcaatatataaaatagttttagggtagtaaaatgttttttctccttttagatttgaggattgtattttctgcaaaatgtgaattatctcctggtttatccataatctaaaaatatggacctcctctgtctgggtttcaggtttatttggtgctaaaagcgtctgactttcgctgtggaatttaccagacaaaaaatatataacacagatcttagtgatacgaattatctgggctcgtaagtcggtttatatcgtatagcatagcacctcctccatattcaaactcaaatcagcacaacacttcaacccaatcaccaacgaagcaacatcccaaagcaacaattaatcaagcagagagatggagagatatataccagatcaccaatcgccttgctgacgggcgagcctggacgcgagacgcctctgccgtgccgccgcctcgtccgccgggagcgcgtcccttccgcggcttctgctgctgccgctgcctgcctggatctgggtggcccgaaatccttaccagacgccctcaactcaaccaccgcggcggctgctgctgcggacgccgcccggcccgagcgatgacggcgcgatttgcggaggtgggagaacggagggaggcgcctgcggggaggtcgatggaagaaggcggcggcggcgcgcataggaggaggggggcttcgccggcggcggccgcgacgcgcatcggcggcgcgcggcggaatttcggaagagaggggaagatgagaagaggagtggatggctatttggcgatttttccagggtggtttctgcaaaaaggacggggacgcgagggggcgcgggggtgtgaaatggacggcggggagatggcccgcgtgggatccgcgcgatctgggccgtccgtttccacgtcggccgcctttgtgtcccgcttcggcaatttttgaatgccaacggctggattgcggctagtcgttggttgttgttttgttaccttttttttctttcccttttgtttcgatggtttttaatttgggaatggggtaaaacaaaattcgttttgaaaggatggggaaagcatttgttttgtgtgtgatgcaactggaacagaataattgtttgcgtgtgtggtgaaaatgtagaaacaattgagatttggttttcactgtttcttacgtttgaagaaaatttgaaattattggtggcaataaatgttccatacacgttgttatcatgttatggccaacaatagtcacatttcacccatggtatttttctctttcccgtgaataaatatttcatttgcaattacttcttgtgaaagtacatataaattatttcaaattctctagctagtattgctatttattggcatacactcataggatacaaacaggaattcgtaaaataaaagtaattcatagttatatttttcatgttgcaaggctttatactaccgggttaaactcaaaaccacattttgtagctaaaaaagctaataaattcgacgtgacctaggaaagcccaaggctcgagcctgagttttaagtcattgtcgagctcggctcattttatttggctttgatttgttgtagcctaatctgaccagggtttggagatctcactataccacaatacacatatcagggttatggataccacatacctaatagtagttgactaaatcttggcaagacccaccacataccatgtcctatacggaaacaacctgcggatataggggagttccggataaggaaagacaaccagagttctacatgaaaacgacaaggactactcggattgtatccatattggttccctagttctacttggacaaggggacacctatgggtataaatacaagtccccctaggaggagagggacagaatccacacacccaacacaatggacatggaagccacaacatagaagcctacatacgccaagacacgccgccggatatcgacttcagggataagcacggctagtaccctacggtgtctccggatactgtcaggagagacgaaagcgctatctctgatctcgccgggcacggattcgaggaggaaggctatcctgttgtcgactacgagtcagatcgtcagaccgtcatgtcgacaacagttagataggctaccccaaatattgtactggtgtgattatcatgaataagagcaataccggcttcggccaacaggatgtagggttattacctgacaattcaggggcccgaacctgtataaaaatcctcgtctccatctcttttacctcagtctcgcgtataccctagtaccaacgatccctatgccatgcaaataccgtaatcgagacatcaaacgtcgacaacacatgttccataagataagcggcttcatcttttcgcttatatttatgcttatcagccaaaatttgaattttcaaccttatttttgagctgattttgggttttctcattgaagtttacttttcagccattgtttttaaatcgctaaaaatacgtatataaaaattttattcaaaaattacttttcgtttgcaaatatattatttggcttatttcatgaataagtgaaacaatagggccggaaatcttccaagttggacatatccttgtttacacagcgggatagtcattgtctcattgagcaatgagcatatgatgcctattattagcatcctctttagcgacaccagtgattgcgtcaagtttaccgtgacttcacttataaaggttaaaatcatgatgctcataattaaataatcatgtccatctataattggtgcataacctaaaagttatttccactgtataacaattgtgcttcagtgcacctggtagtcgaccacaacatcacactcgttcccttaggcgtggcctgtcgttttgatcaagcagtactaaacctaattttattcaaggttgagatatatttaagcacgtggtcttccacaggcattaccgcttttgggaatttgctggaacctaattttattaatgttgggatatattcaagcatgtggtcttccacaggcattgccacttttggggtttgctcggagcgtagtgtagctccgcctcggcgcctcctccctctcgttgtttggagtaaccattttttcgcaatagttttcccttcttttactttttggttttttttctttcttcctcctggtataggcttgtctggcagattatgttgtataaaaaaactcttttacttctaatatattgacgtgcaatctttttgcgcgttcgaaaaaaaatatattcaagcctacatgtaaaacgaaatggttcattagcacattattaattgagaattagctataaaaactttaaaatgtattgatataaatttataaagcaacttttctatagaattattttttaaaaaaaattatcgtctagtagtttagaaagtgtgtccttaaaaaacaagtgtgtagaagttgaaaaatggtagtgtcgaacacaactttaatcatccgtctagcccattataatttactacaacatatagacacatgctacttttttttagaatattttttttcaagaattatagacatgctacttagtatatattcgtgctcggacacaacttggcaatggtaattgccgcacagcctcatattttttgtttatgcctaattgcatatacttattagctaaaattgaaattttcaaccttaaatttagagttgattttaggattttgtttttcaacgtagtttattttttagcctttatttttatatcatttaaaaacatatatatatataagctttatttataaattattttttatatactgtttcgctttttttttcttcaatatgccaaacgaaaaggatgctagactcgtggaggtgggttgtccgatctgggctcatgctcatccaagtcaacaaactcaaatatataaatatgcgaacgggcacgtttaagatttgccttgtcccaggatctcactggaaaccatttacactggtgtacctctgctcctcctcctctcccataataaggccatacccataatcaatactaccagtacggcagcactactccaccactaccgcaccaccattacacccaagaaattaatcccacaactcaaggccggatttagttatcaattttttctttaaacttttaatttttccatcacatcaaaacttttctatacacaaactttcaacttttctatcatatcattctaattttaacgtgaagtaaacacacttcgaatgtacaaaactccaagcacggcaccactactactactcagcgcaccgtgtcgcagcctgcgcgcatgtgctcccccctgcaaccgcacgtctgcgccgcgccgcacgccgcgcgtccgtccaccgcgtccgtccgcgcggcgcggcctccgtcctcctccgtcgcctgctgctgcaccgacgcacgacatgcggccaccgcccggaagctacctaccgctaggagcatgtgtaggcagaacctactccgctccaaaaataaatcaatctcctacgcgatctagatgtaacacatactaatactataaatctgagcatacgtatgttcatatttatagtactggaatgtgttatatctcgtaagagattgatttattttgagacgaagggagcgacttcatctcttttaaagctagaactcaaccaaacaatattagcttcaccttaaaaaaagaaagctaaaactcaaccaaataattttagcttcacctaagaaaatagaatagcgtaaatgctatcacaaaataaactaacgaggttgagttgagtttatactattttataatttcattgcagacctagtttttaagttaaatttaggaattgaaacgctgttaaacgggctagctctagtactagcaaatcctcgtagcagtatgtaacacatgcgctgtggcagtgtgacactgacacgatcacacggcaagggccaattttgaagaaagaaaagttggaatctaaacagacccttgcgattggttagttggggaattggagatctctccggtcaggggtgatgacagagctccgatccggactcggtgttgccggcacatgcgccatggcccatggggcctcttgcctgatcaccctctccccacagctgaaggactacgaggacacattctcactgaccggcaagattcaaaacttcagagagttgttgtattattcagatggtctgaactctgaagaaaaacgtggttcacgatggttgggcaccgccgctaatgatgtgtctctgtctgatttttcccctgctgctacgacaaactctcctctgatcatgctctggtccctagcaaaccttgttaggttgggattggtggccccttggatctcaaagtagtcccaaaatctgaagataagggatcttttcaatggaaggattttcttgggaattttacagaatttaaatcctataagaaaaaaaaattcctataaatacctttgaaacaagaaatgagagtctcatcggttcccatattccctaataagccaaaatggcttatcagagaataaaaattaatttatatttaaaacatttatatatttgttcgcatcgacttaaaagccaacgctaagatatcttaaattcaacttcaaaattaagttcaaacatttaaattttgacttttgctttaccttattaggccaatcaataggctctgagatgcgtaaattcctatgaattggcctcctactacctcctaatgtcctataccgtcaggaaaataaatataagctctaacatcatgtttttattctcctttgagaagtccaatgcattctttctccatctctctaccacatgtaaattcatttttacttcccgtgaaccatccaaagacggtgaaaaatatactatttctgtattttaggatcgtatgtgattctatataatactttttctctattcctacgtattttataatcatgtttttttaaaaaaataagccctaattcagtaacttgtgtaggactagtaatgtactacctactcggtagtattttgttctgctccctattgtaaaaacaatacttcacccccgggatcattattgttattgtcctgctacccgcatctacaattaaagattgtgtggtcactttatctgcccatgagcacggatgcttactcttaaaagtgtcatgataaattgcagcaccaggaaaccttggacaagaaaaccgggtaaaattaaatgcttactacgtcaaatctaaatactacctccgtcctaaaataagtgcagccgtggatatctgtgcccaacgtttgaccgtccgtcttatttaaaaaatttgtgaaaaatttaaagatatttagtcacacatagagtactattcatgttttatcatctaatagcaataaaaatttttcaaataaggcaaacggtcaaacattgaacatgaatagtgtaaaactgtatttattttggaacggagtgagtatcagacaaccaacttactcctacccaacggtccaagagaaatcctgagaaacaggcaacatgcaacatcctctccttttgctgtaacctgtactaccggactgttccttttagattattcactggtttattaaaacaacatactgttagtatttgctccacgctaaaaaaatattttttggggtaaaatacttcttatactatattattttaaacgcttattctaagtatttttaaagcttatttcttaaatatttaatttattcttataataatcaagcagataattcatgataataatgttcccttgataataattaaacaccttaggtggtatttgtttatactgtagaagataaagttaaagaaaaaagaaaagccagtagcatataattaattgagttttattttattgtaaatttgatttaatagtttaaaacaacttgtatatactccctctgtcccataacgtagcaacttaagatgagatgagacccattcgagacatgtccagatttgtagtcaacccatcctaggttactatattatgagacagagggagtagaaagcttttcatataaaatacaccgtttaacagtttaataagcattcaaacaaaaaaacgagataggatatgtatctcagcccaaaaagaacagaataaatcaaactgggcataaggttcagatttaagggggaaaaaaagcttcagaaatgggacctgcctgagtatgacacagtggccctactgcacagacacacataccctccctgaccctgagtgtgagtgacatcatcaaccatcatcagagaagagaagaagagagggcatggtcaaagtaaacgagcccaccaccggtggcaacctgtcccctaactccctttgctcatcaaaagacagagcttgagctctctcctcatggccaccaccactagcactgtgccgtggtagtggcagcagtaggaggtcactgcactagcccacatgccgctgcagtagctagtcgtcgtagcagcagcagtatactactagtagtagccttcttggccttcttcttcttcttcttgcacagatcttgggggcgcaatcagccagttgcaggcttgcagcagacgaacctcggagagagaggcctgcgttcttgcgaaagaggagctagaggtgggtgccatttattcccgtcttcgttcttggcttttgtttttggttgtaaactgacaatttgggggttggggattgagttgataatcggagatagtcatatagatggtttctgaaaaaaagcttctgtgagttcatttgcttggccactctggtttttttgattgtttacttgggggaggtaacaacaagaagaatgcaggggacttcttgtttattggtcatcttgtttagctagttaatttgggggttttttttttggcgctctacagtaaaatttggaggattccatgtctttggggagataaaataaactgtccagtgttgatacatgattcattacactgttgtaataggcagtctgggatttttggtttaggatttgcatgtttgattttacagtatgggagtcatgtacagagttaatgagagcgaatgacctctaactacaaactactaccttccagcttccatcaccttgattcactttccccctttcccttttcacctttctataagagaaaagtgtagtgtactgcttgtgagctatcagttctttattcttgacatgatccatatgaaattcgagcactggtgaatcgagagaagaggccaggtaggtagctggtcaatgcatggatattccgtgggcagatagagaaccctcgtagtagctttctttcttgtaaccacttcttccactgcttctccttgacattcaatttctctgcattatttcttgcaaaagataaaccttggtatatgatatcctaattttctatatttccctctgtaagagtagctttcttgtgatttgcagcttcaggataaagcagacaccaattcctcaaggaaacaagttcttaaattgacacctccttcataaactattttataaagattcaaagataatgtaacctttcctccctcctcagtctgacctgtgggataatttgttcacttgaatttgtttatcatctgttgctattttctgaccatttcggtttgtcaatttgcctttcttatgttgctccagagaatagagaaaatgcatcaagacagtttcaggtcggtggtttgcagatccctttcaaagagtctttcctccaaaaccaaagagagcagctaccctgaaatagctcaatgtgctgtcccttgtgttgtcacattgcaacctacggtttgtcgaggctgccaaggccgggattggagcccatcacaaagcaacagggaggatatgtccatgatgttgcagaaagattacctgatggcatcctcgctctcgaggcgcttcgcggaggacctcctaagaggagccatggacctccaggattcgctcacgatgctcgagaagttccaaactgcgtcgcggagcatgagagtgtcaaacaagaagagaaggccagagggttgtgagagatcaccggacacaagtggattccgtggagccctgtcggaagcgtcaaacgccaagaagatggtgggtagaagcgccagcagtggattggatggggaattaacgaattctactgatgagctgaaaagagtgatcaaggatagcttttacaggaagaacatcttgtcggtatatcccaatgatgaacaggcttccatgagccagtcattacattacatgccaaacaagaattcgttatccaagcctaatgagcagaagaaggcagcaccaagatcattgccatcttgtgcaccagggcagtctgagaagtccaaatccccaagcttggtagcaaagctcatgggccttgatggattgcctacacacaatagcaataccttcaaaaaagacgagtcaatgaagacagtaagttcaccaagggcactttttgatattgagatgcctaaggtccagcaaaatgatgctcatatgagttctccttattcccgaaaaagtaatgtttctctgtatgattctactgtggttaatgagattggctcaatgaaaacaattaggagggaaaaaggcatagagcaacctcaaacccgagcagccaaggatatcaaggttgtatctcacacaagtcgaaagcaacaaataaaagagaccactgaaatgggcaggagaagtagtgacaaacaaagacctcattcgacttataggaacagagaagggaggaaggataccaagtctaaaacaggatcagcatctcggtctagtgctaatacagtgaaaaggcctgataagaaatcaatgattgcatcaagtagcagctcttcaacatgtcgcacaaggaagccggtcgcacgtaaagcacctagtaattcgagggagaaggcagtgtccagtagaagtcgcaagaactcaactattgatgacattgtggtatgcatcttctattatagcatagcctggaaatattttattcatctgaaatattaaactattttggaacattgtaccctcagatttaaaaacaacatttatcttatttttccctttagaagtttcagttaaatcattcagaccttgaattggaacagttcgttgaaataatttatttcgcttaaatcacgggatctttttttgctcctaacgtaggcatatgagctgcacagagagttcatacaagttgatggtccatccactgaacatagcgcaacacctagtgatgaaagctgccaaagtgttgttgattgggacacagagcctagcattgatggtaaggaacgctgaatttcttttcattcttctaaacatgttttcatttttatttgtcactaatacaatttgaagcctgtgaagtaagaaaatttcaaatattgaacttcaatcgaatgttgaaatttggaataaaccatttagtgaggaatttgctgcttatttgcaagtggaatgtgacagttttggaattcacatgcagcgggtgtgacagttttgtcccgccaagccagcgagggtggcgtggccaaataacgctgccacgccagtcgccagctagaccagcgtgaccaaaaaacgttgccacaccagctagaccggcgtgacagtattgttttgccacgctagtttagctggcgtagccaaaagattcagatcatgtaaataagttttgatagggtttatttttaaaattaaaaattaaaaaaaaatcattccgctttaactattgtagacattaattccacttctatttacaggtttgtatctaataacagtccaagatgattaatttcaccacttaaaaacctaaatgttctctcttgcaatgaaaataggtgtttccacactaaacagaaatcttttcatgacaggcattcgggaagatttgagtgaatcctatgaagcttcagtgactaccagctctgcggaaagaaccgattcagctaacggagatccttttcacccatcgacacacttagtatcaaaaaatgaagttgaaataaaagacgagatgagtctgcttctcctaagtgatcaaccattccttacccgggcagcagaactcattggcatcggcgaaccggggcatctgatcaaccgatataaaggtatccgcaaggcccagatgggtaaccatgagcttttcgtggacaccgcaacagagcagctggagcggaagcatcgtcagcgaaacagcttgtgttacacaggaatttggagccagaaatgcagaacagcaccatacttctcactggaggcattgctgacagatattcgcgatgcgactcgaaagctgagcatctataccgaagacgacgatggctgcactacaaaagacacactatacatgaaactggagaaggatctgagatgcacagatgcgtcgatcaacagcgtgtgggatatgggctgggaagattggattttcatggaggaaacacaatgcttcataagagatgttggggagagcattttatcagggcttatcgaagaagctgctctggacatgtgggtacattgatctgggaaaatgaagcctaggtggttcttgcgttcttggagaatttctagctttgttctccacttggctggcacttctcatgatttccagtttccagtttgtatctatctttgttacatttcacctgtgtaaaaaatgaaaaatgtgcaatgatttagagagttgcctaaagaagtgatggagttgtcttcaccaagaaacaattgtaatttgtgcacaaggtatgaaggcatgatgaatagacaaagagcaatgtttcgtttcactttttcctttcgatgaatgaacaatgccgaggaatctcaaatagcaatgagcaaggacagttcttgttttcatttcttttttttttaaaaaaaaagctagttgtatgcccgtatgttataaagggtcacgctcatataattagggacggattagacgggtgattgatgatacaatattggatctggtggttactttttacaaacgagaacacacgtacattgagaggaggaaataaaaggagaagggccccatttttaaagtagtaactagcattgagagtaggaaataaaatgaggacagttgtgtttgctaggggaggatgggaacctgcacactacgcacggaaaacgatgtagtctattagcgcgtgattaattaagtattagttatttttttaaaaaaaaaatggatcaatatgattttttaaaaaactttcgtatagaaactttttgcaaaaaacgtaccgtttagcagtttgaaaaacgtgcgcgcgaaaaacgaggagagtgttggtttggtctaaaagagcgtatttttttaattaatcattttttatcttgagattttttttatacagtgcagtgggcgaggggaagatggacaataaacaggagagaaacgtaacaatattatgaaatctgtgaatcaaaaagagtaaagcacttactgatggagatagcttccaggcaagttgggtggcctccctccgtttctgccttcttcattgtcaacaaccatcgatgcctataaaatattactgaaaaacgctattaatcgttcgagctcgatggcgatgctagctctgccactgcaagcacttgtttttttcatttcttaaccagcacttgatggtgtggttggttcgatatttaagaccttttaatccaaagtgagcaactcatcaaatcccttttacaaacaaaaagtattacacccgtcccaacaagttttagagttagacacaattattaagaagatactatctctatttttaaaatatagttatttctagcacattgacttgttccaaatgaagctatttctccacctaccatctactctcaaccaatcacaactattctctttacctactttatcttttcgaccaatcacaatcctccttcaattatctctatctattttttaaatatccgtgcctacctaaaaaagtatttatgatttgtaggtagataagattatgatttgtcgagaagtgaaaataagtagaaaaattaaatggtgaagggttatgattgggaagagaatgccgacgaagaagttgctatattttgagataaatttcgaacactaaggtggtgtttgagaggggagggacatattttaatccatctcacaaaaacataaatcactcccctagagacttatacttatataagaggtactaaacacccaaacaccacctaaaaaatgttttatcttccgatgaggaattagttagctctcgaacagtagtacgagatttgtgcaagttgtggtcctgtcgtcatcctgtggagttgtggtgagtgtttgacgaattttttttttttttggcggctcgattgcaacccgcggcccgcaacaaatccgacgccaaatcggacacggccggcgactccggcgacccaccaccacacaccaatcctcctcctcctcatcgccgcctgcgacggcgaggcggcgagcgatggattccctgggcgtgctgctggtggcgccgatgaacgcctacctggagcaggagctggaccggcggtgccgcctcttccgcctctgggagtcccccgccgaccgccgcgacgactacctccgcgcccacgcctcctccatccgcgccgtcgtcccctacgccctccagggcgtcgacgccgccatgatcgacgccctcccctccctcgagatcgtctcctccttctccgtcggcatcgaccgcgtcgacctcgacgcgtgcctccgccgcggggtccgcgtcaccaacacccccgacgtcctcaccgacgacgtcgccgacctcgccgtggggctcgccatcgccgcgctccgcaagatcccccaggccgaccgctacgtccgcgccggcaagtggaagtccaagggcgacttcacgctcaccactcgggtcggtttcttttttccgaattccttagcttccgttctactagtattatccatttacgattttgcttaatctttctccaaaaataaaaagttcttaggtttgatccgtagtttatttacagtttggtttagtcgaagcaaatatagcacaaaaactgattgtacagcacgaactgtttggttgggtactattgggtacagtggaaaatacgattgaatggaaggaaaataagtcagaaagggagagctggaagtgagaaattgttggtcctgatcagatgtggctctagtttttgtttcacatcattagatatcttccttagatagtctaatcttaatttgatcattcaaacatcgttcttttataccatgtgaactatttaactaaggaaggaagcacgggaaatggtttcagagctctggtggatgcgtttttgtgagttggaaatgcatcttatttggctgaaatttaaacttgtttcgagcaggttgttgctgattgtagttgcagtgattttctatgggtctaaagagaatcatcgtgttcagaagttactcatctgataatgctgggtgctaattttgggttgcagatggttcttactgagtggcgcactgatagcagtcatatattaggatgttagtctatttaccggagtttatccatccattttattatgcatatgctgctgttattgtgcctggagaatttttcctttcaattaaaattgcattacagtaaactttatgttcagatgcagtatctgaaggacaatatagctagaagaaagattaatctgctaacgttcaattgattatgcataaattggtgtgttcgtggaaatgtaatgcttggtattcttatttttctgcagttcagtggtaaaagagttggtattctggggcttggcaggataggcttagccgtagcaaaaagagctgaggcatttgattgcccaatcagctatcattcaagatcagagaaaccatttccaaagtacaaattttatccaaatgttgttgacctggcagccaactgtgatgtgctagtcgtagcatgctcacttaatccagagacccgtcacattgtaaaccgtaaggtcattgatgcactaggaccagagggagtgctcataaacattgctcgtggagcacatgtggatgaacctgagcttatatccgcgcttcttgagaaacgcttgggaggagcaggccttgatgtgtttgaggatgaaccctttgctccagagcagctttttgagttagataatgttgtcttagtgcctcatgtggggagtgacacagaagaaacatgctgggcaatggctgatctagttctacaaaatttagaggcacatgcattgaatcagcctttactcactccagtcatctgattgtttctgttagaagtctgggatgattgtgccaccactactacattctgtaatcccaattagttttctatcttctgtttattagttcttcattttacccatcattagggacatatgccactcttttgtaagacatcattttatcggccttatggctgtcattcaatcaaccatgacaaataagatgatcagttccagaagttgaatcttcctgtctttggatgatatattcacatattctcagtttctccttcttacaattttccattctgtcagagcctattctacccttcccagttttgtcatcaccctattatctttctcatcatcttgtaacaaatatcatctttctttgttcaacatgatatgatcttctgatgagagttttttgtttatcctttttgcagttcagtggcaagagagtcggcatcatcggtttgggcaggatcgggctcgccgtcgcgaagcgagtggaggccttcgactgcccggtgaactactaccagaggacgaagcaggatcaccccggctacacctactacccgtcggtggtggagctggcggcgagcagcgacgtgctggtggtggcgtgcccgctgaacgagcacacccggcacatcgtgaaccgggaggtgatggaggcgctggggcccaggggcgtgctgatcaacatcggccgggggccgcacgtcgacgaggcggcgatggtggcggcgctggccgacggccggctcggcggcgccgggctggacgtgttcgaggacgagccgaacgtgcccgaggcgctgctcgggatggacaacgtcgtgctggtgccgcatgtgggcagcgcgacgcacgagacgcgcacggccatggccgacctggtgctcggcaacctggaggcgcatgtcgccggcaagccgctgctgacgcaggtggtgtgagctaattgagtgactggatgattctgatttgattgattccaaagcaggtgcaattcgacaaaatgtagtatgtactgtttcaggatgtgaaaaatctgttttccctttttgtaaacacggtcggtctgggacgatccagtaataacgatttaatatttgtcattggaaatgtgaaaagtgtgttgggttgaaacggaactgcattgccactgctatttcaggtagagtaatagagtattattttttttctgaaaggaaaacggcaagagtattgccgaatatattagagggaaatagaaattcagggattacagaggagcgattacattaagaagcggtaagcaactacttagagaccaaagcctctttgcgaagtgtctagcacagatgctactttcacgaatatcttgaatgatttggtgtgatgtccttcgcgtgtctggttcttctccccctaaaatttatgcgtttctttgaagccagatatgccactgcgtcttaaccggggcttcagctcttggcttccatcttgctttcattttgcacaatgcatgtcatccattcagcaatggagcaataagattggttattttttataccctgggcagcagtgacaaggccccacgtttccttgaagaactcacactgttgaaacaaataatcagtgtcttgaaaagccccctgcataggggcaaatccagtcgcactctagcgtcggattagcatcggattagcatgttttcggccgagtaatagagtattatataggagtactagtatatactccttccatccctaaaaaaactaatctacagtggtgttcttttgtggcgtagacgaagatgaaaataaagatttagtgttttacgcaaaataaggtgatatttacgtatgattaattgagttttaattattacaaacttgaaaatatatttatctgatattttagaacaatttacatataaaaagttttcgcatgaaagacactgtttagcagtttgaaaagtgtgtcacgaagatgaaaattttcatccaattcctataggagaaacggacgggaccatatataatgaatatgaatatgaacatattcacatccatattaattgtattatctctaatattataaaaatcaaagacgtttttgccggtattttgatacgtcatgcatctatgcgtcggtttttaagttcttttagaaatacatatccgtatctgagtcagtttttaagtttgttcgcttttaaaaatacagaagtagtcatataagaaatcactttagaaaaactcacatgttaacttgagacgatcggactcctaattgcagcttatgattttctaaagaaaatgtatatatccaagcaaattctcacagtgcatttcaccttaactaaaccgtataacaacaataaaattaaaatagcatcgcataggtttttttttatattctaatgctagtttgatttttttttgacggaaggactattaccgtccgaagagattaaccgacaggtgggggccacgcgttgcatggtcaaaaggtagggtccgggagacagccacacgagttcctctcccgtgtctctctcgctcactcggcttggctagctcctgtctgttcccctcgccgccgcttccgagtggtagggtttggctgctaccggcgctggtgaagaataagaagaagaagaagaggcaaaagcgtcgtcttcttccccggcctttcttcctctctggctctccgctcgtgttcctctcgcgcggcggagatcgagggggcacaaccgcacaaatcccattcgtttcgatccgtacgtttcggccttcccaaaatccccacttccatcatcacagcggtgcgggggggggggggggggggaggaaagtgatggtttctgcccgacaactcccaaatcttctcttcctcttccttctcaatccgattgttttctgaaactaggttggttatctttcttcttttgtcccttttgatttgatcaccgtattcaactcgatgtgctttattatgtgatcaggttgcgaatgcggatcaaactttttgtatttttgttcacccatttcccactaaattttcaactaggaaaaaaatgaaaaaaaaaaacgcgccctgtttcttctgtacaaacagaattgccggggaggaaggtccggtggtggtgacacttggcgagatctgctgcatcggtggtagcagtgccacctttttctgtccgctgttgagcttgtgctacacgtggcatggtcctcccttcgctttgcagacagcattttcaacgcaaaagttcacccttttttctgcttcctttttctgtttgcgaaattcgatgtagattagatttagattagtcctatgtgtctcttgccgggttcttcttctcgggactcatgcttgcattgcacctctttgttccagcgaaaatgtgagattttgaagagatctgccattgcaaggtggtactgtacgctccatagcttttccttccggttttggatttatttattcttgttctttttctcgaaaatttccaaacacaaaccttaggctacgttctccatgtgcctttcgtcttcatggacaaaaatgtgtatgcttgcagtttcttttcttatgggttttctctcttcctctaataaatctttctaggatgaactgctcttaggatagagatgtacagttggttcttttctttttttttttcagttgagtcttgtacacgactgtttcatacattcaaacaaaagtaggtttgatcgaaactgaatatggtctacagctcatgctgaagaagatattggctttttcttcttcagataggttcaacaggttgtcatcttcagatgcttctggtaaaattgcaggttcagtttcagcaagagctaaactcgatcggattcagaccgcgaagctaagctttgcgaaggaggatgaagccggcgacgtcggagtccgacatgacgagcctcgcgacgtcgtcgccgtcgcggtcgcccaaggcggcggcggcggcgtactacgtccagatcagcccgtcgcgcgactcccacgacgacgacggcgacaagtcgccgtcgacgcaggccacgccggtgtacaacaacagcccgctcgactcgccgtcgcaccactcctcctccttcggccgccactccagggtctcctccgccagccgcttctccggcaacctccggtcggcgtccgggaggagcaggcttggtggcggcggcggccggaggcggttgggcgccaaggggtggcgcgacgtcgacgccatcatcgacgaggaggaggaaggcgcgtacgacgagtttgacgacgacgacgatggcggctatgagccatccagatgctgcgtcctcgccttccgattctcgcttcttgctctagccttcaccctcgtctgcctcatcgtctggggaatcgctcgccattacaaacctggagttcttgtcaaggtatattatcactgaattcgtatccaaatcacacaggttcataatgagtttgtgatggttttttgaacttgttaaattattactgatcttttgtctgattctagtagcattgtactaagtgtttgtttttgtgtttcttcaagaacgcaaattcataatgagtttgtgatggtttttgaacttgttaaattattactgatcttttgtctgattctagtggcattgtact

SEQ ID NO: 76255 - DNA, 3798 bp, Oryza sativa
ggggcgtgggcgacgacgtcttctcttgctagttgctactgatccgtgctcgtaatcgtacgtactgcccgtttggtcgggtacatgtacatgtactagtacgtgacatcttgcaatccctaaaagacttttttttttggaagaaccaaaagatagtgaactgcatgagtggaatcctataggatagttaacttgaatctgcaaacatcttaccaccaatcgggagattcagagtttcattatatgcagatgttgttgccctttctgtcacccctacatacttaaatcttttcgcttctgtaagtgggatgcacatttatttgcaacactcaaaagtttctgtaatttgctgatggatataatatcactattataggacatcctttaaaattaataatttgcctgagaacattttcggttcgattggagagaaaaattctttaaaaagacaagaatgcccctatgaccaaaatcttttaacctatagtgctggagtgaagatgaaatatgatgcatattctaatctatttgaaaattttatctctctaacagatcgaaagtgtcctataacatattactatttgtttatgtcttttagccatcacacgtttttacaatattcactagtaaattacataatctttgagtgacctatagcaaaaattgtctttaaaaaaaagagagatatacccaatctcctgcaatgaactaaatgtagaggcacgctttacaaattttcctggaaaggtatcaacattgtcatgcaaatatctagtacattatcaaccactgactataaaggtatcaacattgtcattgcctctgactataaaaagctgaaaaaacgattatcaaccactttttgacaagtttggcttcaaattagctggatggttaggtcgcttcttcacatcgtctagcagaaagacgctagtaaaatcagttcttaatgtcccgcctctctgataccgggtccacttacatctggcagcttttataggttataaactgctctcacaaactaacacaaatcttttctgcacactttgtcctcactcgtgcgcacttgggaagaatttcctgatcggtcgcccatcccaaatctgctccaagctaagcatgcttaaccttagagttctttcgagatcggcttccggaaaagaagttgcaacttgttgatatgagtattctattaatcctattaatccctgggccgggatgtcacagcaagagaataggctggattagaggatcctttctttggagaagtgatgacccacaaaatgtcagtggaggccacttcttgattaattggttccaatggaaagatcccgaaaaaccatgagtttatgaatattccctgtgataaaatagacaaaactttttaatgcctgcaccttgatcaccgcaagagatggagagaaaattaaattatggaatgattactggctgcagaacaaaagaccaaatgaaatagctccatctcttttcaagatctcaaaaagaaaaaaacaggagacaaacaatgtttggctctccacactcacagtcacatccagcattgaggagataaaccaacttgtgactaggaggcctcctacaacaagttaccttggatccaaatattcaagatgacaaatgtggaaagggactaccaatggagaatattcagcaaagagttcttacaaaatgcaattccaagaattgattactcacaataattgcaatgcctttcggaggcaaaagctcaatccaagcacaagttctttagacggctcataatacatcaaagagacactcacgaccgataacttattaggaaggcattggccctgcgcatggatctgtcgcctttgcaacgaagctttttaatcgacggatcacttgctcaaagaatgtgaattcatggtaaatgtatggggggaaatgccaatgagcaatggtttgacacaacacataagcctcaatgagcaatggtttgctctaaccaaactcaagccatagaacatgagaaaggagtggttgggggtccaaattacaacttggtggttcatctagctagagaggaacataataactttcgaggacactagccaaagtgaagagcagattgcttttacaatcatgcatgaattaaacgctcacagtcaagcacatagaaacaactaattctagcacaacttttgtttatggcttctttttacgggacaccagggggagaattgctcacttgaatatattacgtcaaacggtcttacatatggcaaagcttttagctatgcaaacacaggagccctggaagataagagaaaatacacaaggaaaaacaaggaagcgaaacatgacaagaacacaaccaacccggagggcactacatgtaacagttatgtaaaactattaaacttattttccccttctacctataaaacggcaaaattcctacttttcacctcaaaaaaaatatttaacacgaatcagctcacttcttgtgaaaatagtaatttaaccttttccttgatgtgcaacagttttcccgtcacagtacaacttcaattcaaattggagatttttaatttgcggctatacacgcttcactgagttgctttttttcgtagatagtgttatctttttcgtaactactgtacttttcctcgacatgtgagttatttttccatatgtcattgtcacaggagtgataatatcatcaaaatggcaatcttgcgtacttgacaaatcatcaaatttctctaaatcaattcaaaggaggcatgtatgatttgcacctttttctcattgtgacattgcttcccaacactaggccattcacattgtgggtttgtgcgaggctcttcattttggagccacgacaacggctcaaccaaacccgtgctctcaggaggcttctcgtgtccaatagagagcacaattgcctcgtcaatgcaaggccacttgtgcttgatgccatggctcatgagccacattgggcgaggttgtgcccaccctcctacatacatgtggttacaagcggttgggaaaaggtaggagcttgtcgacaccttcaatccatgttgcacggagctcatcgaaggcaaatcccaataacatcgggtggtgtggggagagattgcggcgaccatagaaggggcagccaattaggagtccatagaggggttatagggagtagggatgtaaactaggaggaacataccaagagggtacaaaccaagactataatattgattgtgttgttggatcaacatagagcttgcacagtctgagttggcacctatccatctcatcacagagctcattggtccacactatctcgattttcgctgcttaaggattgctcaacccacgccaccgaggagcatttagcccacattgttgtttccgatcagtcgttgtcaacgctttaattagatcaaccactgagtctgttctcatcacccgatctacgctaccaccaagcccttgtctaatctataccactaccaattcatcatcgtcatctaagagggagaggcagtgacaatgaaggtcgtcaccaaagatgtgagaggtggcaggaatggccgaagaaggggacaagcggtggttaaagggaataagtaagggagtgaacaagtgaggagagtctaagtattatattaatttgtaaaaaaacaaaaaaaaagtgaggactagaatagaaatgtgaggagtcgatatgaaaaattgaagctatcacttaaagtcggcatcatgagagagaaatgttcagatgtgtagcctcatactacggagatattttaacta

SEQ ID NO: 76256 - DNA, 7627 bp, Oryza sativa
caaatgtataagatataaatcacacttgaagtactatgagtgataaaacaactcataacaaaataaattataattacgtaaattttttgaataagtcgaatggtcaaacatttgagaaaaagtcaacggcgtcatctattaaaaaacggaggtagtatatactttatgtatatacgtataattttctatacatatatacagagtttgtagagtttgtatgtatgtatataaagtatacatacgtgtgtgtatgtatgtatgtatatttttttaagtatgtatacatttttttatgtataaaaagtttaaatatataaactttgtatacatacatatacaactttatatatgtacatattaaaaaaatacaaaagaataacgtatacaaattttgtatacatatgtatgtaaaatttgtataatatattcaaaactttgcatacatatgtatacaaagtttgtatatgtatatattaaaaataaaaaatccagaaaaaaactgaaaaacaaaaaaaccgatagaaaaatacaaactaaaaaaccggtcacgcgtcgccacagggaggtccccccctctctctctccgcgcgctacgtgacgcgccacgcgggggacggtgtgcgatcatccgctttttttcgttaatgtcttaaaagtagcaaaaagttaaatacccccgctctttgaggtcatccctttttgaatattttaaaatgcgtttgtacatatatgcttcttttaactcattgctcgccatcgagagatgaagggagctctgtcatcacctacctcaaaagggacctgcgtggttcgagcttcaagcattgatgctgttgcaatctttatcttgtccctcccaaatttcaggagaacaatcgagtatcgacatgtatgcttaacaagacgaagtcaaccccctctatcacacaataaatacatgtacatgtaaacgaatgatactagaacactgatgttacgcggctagttaccaagtcaaggtgtttttattatctcctacactcgaagtttcgtagtacgaacttgcaatcaagtggaactacgcaatcttatccgctattcgcgatgtaaaagaacaaagtcagaagttaacaaagattagtactacaatttctaatgtaccatcccgtgtatgagctcctgaatcttcggaaatgttcaaaatgttaccgatcactgctcgatctgtactcgagtagctgcacgtacgctgggttaatttgacggcgaattcgtgaagaaaccacacaaaacgcgggcgagtgaatctcgataatcagaggaaataaaatgacaggaagaatatggtgagcacactgcgttatcatttcattttgacaaatcttaagatgtcaaccggcgcaaattccacggcgtgatggatatatacagcagcgtggcctccattgacaacggggcatttaaattttgatgtgagaccaccatgacctgtaataaggctagctgtaggagtaatataataatgcttcagacctataataaacataagaataaacaaaaaataaggctgtagttgttttctgatcagaggagatgccatgccgcacggcctctgttgacacaacgtctctgctggtacatgctggtgtaaacaagggtgtgtttagttcacgctaaaattataagtttggttaaaattagaacgatgtaacggaaaagttgaaagtttatgtgtgtaggaaagttttgatgcgatggaaaagttgaaagtttaaagaaaaagttgggaactaaacaagggccaagtagccttgtactggctgtactatctatatctatttatctgtctatgagaaatattcattaagaagtattaaataaggaaaaaacacgcatatttaaaagttctataaatttgtcgataccaaatctgaagtccaacataatttcatttaagagaaaaaaatcaatttcatatgaatagttccctcttactattcactataaatttatcattttgttgctcttaaataaagttgactttgaatttaagattttaagatttgatgaaaatatatttcaagcttatacatatctctagtaaagattttttttctccatctatctatttatctatccttcttccattttaaaatataaaaatttataggatttaaatcatgattcacaatataaggaattttagcactattcatattactacttgtctcatcaaccattttgcatttaattctttttccatgttacccctacccaccctcccatctccatccatttcatatttattaaggagcattaaagtcttctctctttaaacatggtactccctccattccaaattgatctacatctagtttttttttgaggttattcttaaatgatctacatatttgtgttcatttattagagtctattcgttatttgtgcattggagtaaatggacattgatgcatgcatccatgcacacaagtatttataacccacatgcaatatcttgatttgctattggctagaaaatattggggatggtgcatgcattgagtttgttgctagagtaaatatagtatgagagagttattagcttttcttggtcttggtgtagctatgaaatatgtagatcaatttggaatggagggagtatgtgctaaaaacccttatgcacgatcttagagcaggtataatagtaggctattagctagctgtaaacatattttaatgagataaaagataagagagaagagcagcaggctataaatctgtagccagctgcaacacggactccaagacgcaatgtgtgtatgacaggtgggaccatatattaatagtatagtaagcaactattatatgaattggctattagattggctatagataaattagagctaataatgggctatactattaaactttgtcttatgcgcgttcatgaaaaaacagtgcaacagatggattacctcatgcaaaagaaggctactttcatgcatgtttaacaaacagtcacgtggattcaaaagctttaacgcatgcacaatacaaatacactcaactcatcttggaaaaaaaagcaaatagtaaaatagtaaaagacttttggatggagaaagtataaaattgaaaacctgatcatgatcaaattcgatattttttttcaaaaaatactaagacaacgagattactatttaataaaattcaaataaatttacgtgtaaaataatttagataatttcgtattggtactccctccatctacttttgatagtcatatttttaaatctaaaaaaattatttttgataggcatatttcaatccaacaatctatcattttaatgattttcttaaatttaatgcgtgactctctatttctccacacaagattggctacatggtatcgagaaatgtaaatattaatgaatcgtttgtttacgaggaatgactattagcatgtttaaatggatgataaatggaattacttatctttgatctatgtgccaatataaaatatgactatcaaaagtaaatggagggataattagctgaggcaattatacgtgccaccttaccagttgtaataatttgtacgagccaccggtgttggttcttgggcgtcgtcgctcactcgctctcgtccgggacgggtactgaaccttcatctcgcggaatcagtttcgcgaccgagacatggcccccctctcgttgacccatttaaaggcatcgttaacttgcaaaaccgaccgaagacattgtggcccatgaatgcctagttgccaacatggcccctcacaacacagggatgccgagtcaaaacctgcgtcgtcgatcgagtccagttgagaccgggagagagatggattatgcctacctcttgcgttttgaatgttcgttaaatgtatgggaataaaatttgaaaatatactgttcattgatctttctttcagaaatatactggatgttgtttgattagcataaatataccatcgaaatcgcggttagaaaacgcgataccgaggttcgctacgggaaagcgcgatatcgccacggtatcgcattaccaatgcgcgagagcgtgacggtctcgtgcgttgaatgggcgaggagatttgagctggcggtgtcgcttgttggttatgcgatatcgacgcggtatcgcgtttccactgagcgagagcgccacgtcataccgatttgggagcaacagctggagtggtgctatcggtctcgcttattggcagcgcgagaatgggatcgctaccaggtttagacgcgcgagagcgcgggcccgcggtctcacacggccaaatcgcgagagcacaatcggtatcgctctttcagagcgcaatagcggctgtggagtgggtcccactggatttttttagttgggagatcgggcagccgcggtatcgcactgtgggagcgcgatatcgctcggagggggggcgcggtctcgcgcgttggttttgcgagaccgaagctgatgtgacactgacaccctcccgtcaagcatgcactcacgcattatcaatacgcacgcatgcaatcacactagcaaaataatggaacaagtcaatagtaaactgcatccgaaaaagtttttcaattaagcggtgtacgaagattatcatgaaataagctgtacaccccttaattactaattgctcacgcgtgattaatttatttttatacgaagttttctatgtaattaacttaaccttaacaccattaaggcaagtactatagtctcccatatgttacccctaagagtgccacattagattgagtgatgaggtggaggagagaagtgaggagagagaagataagctacctctaaattaagaggcaacatccacacaaatttcaagaaatatgtgagagtattagagaaattggtatttgtgtattagaggtgatacattgtatgagttgcctcttagttcatgagtaaataaaatagataaatttgaaggtggtagtcacatctaccatagcacttgcccttaggcgcgcagtggggctcacctgaccgctctcgcgttcctctagcgcgagaccgcgccatcgcagtcagggggcccaccgctctcgtgttcctgtagcgtgagaccacgtgggtcgcagtcgcaacatttgcgggggcccaccggctcgctctcgcacttttagagtgcgacaccgtgcgctctcgctattcggcaaagcgatatcatagcaccgcctaggccaccgcgtgcgctccgtcctcgctgactgaacgagcgatactgctctcgttctcgcgcctcaatcgtgtaagaccgcggtctcgctcaacgaaaccgcgacggcggtatatttttgcaaatcttcacgcgttcggtattttcttgcaaattctacagaaaatacgtatatttctaaatttttttcaaatgtatggagcattgaagacatgaatgtactcactccgtcccaaaaaaaatcaatctaatattagatgtgatgtgttctagtataatgaatcgtgatagaggatgtctgaattcattgtatcataaaatatttcatctaatacttaattcttttattttggaactgagagtgtacacatttaataccgttaattttcaataataagtaatgtagtcatcgacaccatagtgatttccttaaagttatgttggtcggatttttcatatgctcataaagataaagtgtgtatgtgtgtgttcgtccaaataaagtgtacatttctaaacatgaatacacatatctagtaccgcaatcttctctctgatattcttttttctgggagaagaagtctattgctatctcatgtgcgactggggcatgccatgcatacgcaggtaaacgcatcacaccggccggcagtatcattccctacaagcgatcatggtggcccatgtgggctttggggcgctgcagcatgggtgggtggggtgccatcccatgcgaggttacgcaggaagctaaaggcggtaggcacccactgctgcatccgtagtctgacgcggaccgacggatcaagtcgacggccaccaccacacgccgtagtttgataaactcagatcgcaagcgccgcgccgccgcggtgctttgaatgcgagagaatttgtcgtaccgcgcgcgtaaatgcggcgaccgctcgcacgtcgatcggccagaagccgtcaatgtccagattcataattatacgatgagtctgatagaaaacgataggtaaataaatgataaaaaataatagattaataatagaagacacgagatttaatatggaatatttttcttaagtaagagagaaaaaaccacgggcatcagccagcaaatatcttcattatatcaggtgagattacaacaccgaatgacagcttacgtgtgcgattgaatttgaatcacaaactcaacagagtcttaatccattttagattaaagtaatacgtattttagaatggagagagtacttggacacccaacgtgcagtgctgcatcctccggggctgcgccggggggcgggggggggggggggtggcggctgccctatccatcgccggccggccgggagaggcagcgagggaacacggggggtttcgccgtgttccgcgggggcgtgcagggtggtgtacccggccgcgcgcgcgtatactctggacaggctcaggtgacgggttcccctactccctgcacgtccttgtgtatgctttgtcttgcgcccccgcgccgcgcacgtcgcgatttagggctgttattagtactactacgagcaatcgagctcgatgagaattcgttcttctcctggtgcgtaatgcgtgattttgctgtttctctgtcgccgtcgcgtgattttctcttgcggcgatactatggtagagaaaatgaagtgaaggccccggcccatgggtgctatgggcctatggggccacgacagttcgattcattcctgaggtgtaaagcccagtagccccagcttgtttcgatttagcagttttcagttctagagagacaagttgcacacgtagcacgcacatagacccatcgcggtatttacatactacatttgtcccaaaatatatcaatttttatctatatataaatatagacacatagttctccagatttataaccaaaaatgtttatattttaagacggagggagtatgttgcaattttcggttaatgagatttatttgtttatttttttaatcaaaccctaactttcattactcattagcttgggaaaatatacagtggaaacctgaaaacgattgttagataaaaaatagacgcatgataaaaaaattactacatgagtatatctgcgagtaaaatttttagtcgggataacgtggaagaatctcagacgtccatttttcgatccgacggtagttttcaggtttccactgcatatgttgtttccatcgcatattttccccattagccgagatatcctcaacaatccattagccgaggtgtcctccacaaccaagtatgtaatacatgatggtatagagacgagcactgttcagaatctgccaagcacaaggaccccaactcagcgagtctatggactatcatatttccttctattggcttatactccctcgatcccccgtctctaaaaataaaggattttggtgaga

SEQ ID NO: 76257 - DNA, 9564 bp, Oryza sativa
tttttcctgggatttaaaattgcccttaagtgatttttaattggttaaaattatttccaaggctctaaaatttccactaaaaatcctgttaatgcattggagcatggggaactcaagaaaaattccaccacactatttccgattattaagtgcatttattaactagggatttagctctaggttaattaagataatttcttcaagcaatttatttaaccaatttttaaagcaagcaaaagggggaaaacttcagggtgtgacaacaacccttgtccacaagccttgccttgtacttttcaattgtaccatcaggcataagctttttcttgaaaactcatttgcatcctacaggcttgcaccgatatgaatgctcgatgacttcccaagtaccattagacataattgagtccatctcacttcataccgcttccttccaatagtcagtgtcaggagatgaatatgcctcttcaatggttcttggagtatcatccacaagatatacaacgtagtcatctccaaaagactttgcagtcctttgtctcttactcttttgagttgctacaatgttatcctcctcagaattttcctcaagcatttgatcaatgtgttctatcggcacaaagtgctcaggggataaaataggttcttgactagaagtgctaggtgcatttttcataggaaattcattctcaaaaaatgtggcatctctggactcagtaattataccaacacgcatgtcgggtactccagaatttactgttaagaacctatatcccacactatggatagcataaccaaggaacacacaatctacggtctttggtccaagtttacgctttttggctatagatacatttaccttggccaaacagccccatgtgcgcaggtgagggagatttaatttcttcctttcccattcctcgaatggtgttagttctttatgcatagtaggaattctattcaggacatgacacgcagtcaatattgcctcaccccaccattccttggaaagtcttgcagtgtctaacatggcattcaccattcagttagagtgcggttcttcttttcggctaccccgtttgactggggtgaatagggaggcgtcctctcatgaataattccatactcttcgcataaagaagtaaactcattggaaaaatactctccacccctaccagacctcaaccgtttgattttcctttctagttggttttctacctcagccttatagatcttaaagtaatgtaatgcttcgtcctttgttttcaataggtacacatagcagaatctagtgcaatcatatatcagtgtcatgaaatatttctttcccccttagtcaacacgttgttcatttcgcacagatcggaatgaacaagttctagtggtaccaaattcctcacctcagatgccttgtgaggcttgcgaggttgtttcgattgaacacaagtatggcacttagagcctttgactaaagtgaattttggaattaaactcatgttggctaagcgtgtcatacaaccaaagttcacatgacaaagtcgcgaatgccacacattggactcatcatcatcatcgcttacatggttcacaactttattacacatatcatccaagataaagcggaacaagcctccgctgtcataaccttttccaataaacgtgccatatttagatacgacacatttattggattcaaacacaagtctaaaaccatctctacacagtagagagccgctaactagattcttctttattgaagggacatgctgcacgttcttcagctgcacgatctttcccgaagtaaacttcagatcgatcgtacctacaccatgaacaaccgcaaacgatccgtttcccatcaacaaggaggaacctctcccgacctgataagaagaaaacagggaaatgtcagcacacacatgaatattagcaccagtatcaacccaccaatcaggggagtgacagacagagagaactgtagataaaatttaccataccccgatgttcctccgccctcactaataaccatgtttgcagacttcttgtccatgcactcaggacagtccttggcccaatgcctaggcttgccacacacaaagcaatctccttttgcctttcccttgtctttattcttaaaattgattgtagccttgggtttgacgtcaggtttgactttcttgttcttgttgtgggatgcgtgagggttcttcttctgtaccaaattagcgctagaacctccctcgatctttttgtcccggttgtcctttgccctcgtcttctcctcaacacccaaagagccaatgagatcagtaacgctgaactcttgcctcttgtgttttagagaagtaccaaagtctgaccaagaaggtggcaatttggcaataatgccacccgccacaaacttgtccggcaactcgcagttgttgttctcaagttcctttgccagcatctgaatttcatgagcatgttccactacagaacggtcatcgaccatgttgtagtcatagaactgctccatgacatacagctcgctgtcggcgtcggaaaccccgaacttggcctcaagagaatcccacatgtccttccctgaaggcatgtgcatataaacgtccacaatactgtcggcgtgcacactgatcaatgctccacggaacaagcaatccgcagcctcgaacttagcctcctcctcagggagagaggcggttcactcggtttgcctcgtgaagcaaagaaacattgcatcgccgtcaaccacaaaagtgcacgtgctttccatcttttataatttgaaccatcgaaagcatgtggttttagtgatgcagcaaagccaactaccgaaaaagacctatcaagtttttggattgttggaaatttggtcataattcgacatattttaatccaaaatattaagacaataaacatgacatttgcaatatgagtagatctagtgacagtgctagatgtatacaacttgagtgtgcttaatatagaataagcatcaacatagacaagagaacgcaataatattgcgaccgacagttgtaggaaacgaagaacgaacggtaagagtgaaacgttataccccgaaaatggccctccgctggagtttgagacagtattgcctccgttggtgttgacgggaggctcctccttgtctctagtgttgttgttgtcgccggttgtcgacatgttggtgaagatgatgcagagtagtcgcgcttgaagcgctactcaaaaacttgatcgcccgcctacccgtgcaggttctcaagcggacggagtttcggaggcacctgctcgttccaatcacccatgtgcgcgggatgaacagaaccggggaaacagagagacagcgcaggaacagaaggagagtatcgccaaggaacaatgcaggaggaagacacacactttgagagcctctgccttgcgttatatatacgtaaaatctaaactgagaggcttctcgctttagtcgtatcacgcgacgcatctcatagccgatcgatcgcgcctatcgtccatccacgtggccgcgctgtaatggcacaatgagaaggattgacacagtgtgtgccttgtttctcaatagacatgtatatctttttcctattcaaataaagttttctcttaaattacttatccgatctataatccgattacaccattgtgttcgttacaattaaatcttcacaacaagatcttacatgattatattacgatgaaaaaatatttatatttataaattacttttattatatatgtaagttacttttatcatatatatataagttacttttagatatgactaaattatttcttagtcatataaaagtaaattcaataaggtctaaaagtaatttacatatattataaaagtaacttaaaacaaaatggaagtaactttgtcacgacattagaagtaatatgtgatctaaaagatataagcttttttttgaaatgaatactaccagacatttgcccacagtgtaccttttttaaaagatataagttattaaagagattaaaaaaggatacatactattgcatttttcaagttcaaaggagagactagatggagtacaaaccagctaccactagctgtgtagtcacgtccaatgaaaaaagacatacattaaagttacactcttttttgttataagttacttctataatatatgcaaattaattttaggttttattgaatttatttttatatgtctaagaagtaatttagtgaaatttaaaagtaatttagatatactataaaagtaatttatgttttttcatcaaaatataatcatgtgagatcttgttataaagatttaattgttacgaacacaacggtgtaatcggatcgtagatcggataagtagtttaagataaatttttatttgaagcataggtggatagggtctcagctggtttagacaatacagctaccactagctgtgtagtcacatccttatatatatagagagagagatctccattaccacacaaataaatctcatttgttgtggatgttacaacacaatgaatctctcatttgttgtggaggttacaacacaatgaatctctcatttgttgtggaggctacaacacaatgaatttcatttgttaatggtgactttattctcatctgttacaaaaccgaaaagcagcaggcaggctcggctcggtcggccgcctcgcctcgctacgcctacggccgaggccgactcggcgcgcgcgcatgtgtgtggcagtccaaccatcacctcaaccggtcaacagggaatctccaatatcaccatatttaagttgaggttctttcacctaatttttcaaggtagtattattctctctaacattacttgtgggttcttgagattttaattgaattaaattgggcttagcccatttattccaacaggtggtataccaaaatgaactatcattttagacaaagagaccaacaggcacatgaatcatgcatgtagattacctcgtagtgtggaatcctatgtactcctcactcctaccagccatgagcaacggattcggccaagactccccttgatactctcacattagctggttccataaaagcatgagatattcccctgtagttgttcgtctacaagcagtcgaagacaatatggaaaatgtaaagttttaatggaaaaagagccatagtttaagaatgttcgaagaatccaaattccatccaaccaaatctaaaactgcatggataagcctccaacttctagaattttagcatctaaaatggctagttcaaccatacttaacaacgataaggtaagctacacagaaactatgtaaataaagtagtaacaaaagcaaaattggaaatttcagaatcaagacctcctaataccatggtgaatcatgatgatttgtgttttcaccaaagacagggattaaatcgtcttcgaagttcaaaccccactgttgccttgggcttggcctgtgatgccggtttcatcaacatatgtttggatccttgaacagcaaagcgagaaaaaagaatggtcaattccgtcaatagcacaatagcagccaagcacccaaatgcttgattggggcataagttttttttgtgtatgtatcctgagttagcagcagctcgatcttctacagacaatccaacaaatcaaataaaaatagaatcaattacctggaggatgacagggatgatggaagtcgacagcatgcctgctgaggttgccgttgccaccgcctatgcgctcttctcttccctccccttccgatcttaggttctcttccctcccttcggatcttagggtttgagcagtgacagcggtagggagagatgaagtaggaataggatatggggatggaagaggcggtgcaccggacggaggagaaagccgtagggttggaggaggagaggggctatgaggcaatggagtaggcgccggggttcacgacggaggtggcagcagcgcggcggatgaggcgccggggttcacgaccgaggtggcggcagtgcggcggaggagctgccggggtcgcgactgatgtggcggcagcgcggcggaggagccgccgagggcgcgacggcggcgctgggaaagcggcgaaggcggtacgaaggaggagtgacgggggcgtgcgatggagggggcagtgtgaggacagtgcgatacgaaggtgggggtggtgcgggacagcaggaggttatttgatcccttcgatctgtgggaggatcctgcgaggaatatcggcccttggattatacaggactcaccaacaccaccacgtattttttaagtagtaaagatactatgatctatgagacatgatcatcaattaatatatgtgctgatcatttaaccatatttgttccatatatgatgtttgatcagggatcttttagaaatagtaacaaacaacataaagagtctcatgaaagaatcacatattcattaactaataatgagttatctatttcaaggaacaaagttggataaatatgtaaacatagtatgtaatacaatcatctctatgattgcccctagggcatatcactaacacaacccttgcgcctgattgcatgcagtgaattttggtgaaggcgttctggaaatgatgtagtgttgcaagcgcctgagaaaaaaaaacaaaccacctcagagttcagagcgagctgacggctgcaccaccaccagtccatgcacccatcaatacaaagttcttgcttaacccaaaaagagattaaattgacctattaggacgtttgtgcccataaatcgagcctctctatgtatatataattgtagaaaatattttaattttgctcttagtatataaaccaataattcctgtgcataaaacaggacaagcttgtccacatcggcataacaagcaaatatggcaacccctcattctaaaaataaaatgacacatttttcagagaaacaacaggttcagggtcaaaaccagcccagcagaagggagtcaggcagctccatctcatgaaccaactgaagtttctcatgtcactggtactgcaaaagaatcccctccataattttctgttaaagtgtcagtggcaaatcaccataattttctcttaatcacaagagactaatcacaaaatgtgtacatcttcaaacttaatagctgatttgcaagcaacataatagaagagcctgacagccgcaccaccaccagtccatgcacccattaatacaaagcaagacaaatcatctggtaggggaggaggatttttgtaccttctatcggtggcggaggggatcggcttggtgaggacgagcccggcgactccggccgacggtgatatgggggcgtggaggcgggcgccctggcgtacatcgggggcggcgagggcaaactggcctggcagcgcggatcggtgcgatgggcggaggggcggtgcggacgagatcgtcatcggtggcggcacggataggtgcaatgggtggagggacggcggggatcgatgcgatgggcagaggctcgggggtggcgactgcgactccggtgcggatcagtgtgatgggcggaggggcacgagcagcaggatggcgaggcaaagggaatgctattggaaaggaaggggtggcgacggcggcgtgatttgtggggcgatgcgttggggggatgcggcagttgtagaagggagagggaggtgcgcgagagagggagggatctgggagggagggcgcgatctgggagacgttggatgtaactcagatgattttaggctgttggatgtgtgacatgatgaatgtgtaatgagtaaaaccatttgttcaactatagggtagatgttaaactatagcttagcttcgtgtcactgtgcccgtatattaaacttaacccctgcttagactttgataaatacaagtaatatatgtataaagagtattagcatagtctactcatattatcttcccttgggatcaaaaatacgataccttggaatatttttgggtgaaatactacaatggtatatcggtgcgcttgtggataacatctgtaaccagaaaatataccaggaccatttctgcgtcattgctaggaatgaatatttctagtaatgtcgttaagaaataccaataataccaaagggcaaaatgaactttatgataggaatttaatggtcaactaacaaaaggggtatagaagggattcaaactgaaatttaggggtatgaaagagaatgagcaaatctcagaggcatagaagggattgggcgaactttcaggggtacacagggaattttctgtgcaaaataagttaacacacctacattaacttattttagcatggagggagtacacggataaatcttatgtgacagtatcccttcttcacccctaacccgtcggccttcattaggtctccaacactatcctcatttaattagctagtaacagaaaaagtgttaaaacaacaagaaacaaaaaccgagctgattgccaaacactgatctacaccttccatcctataaaaaaaaacttaatcctaactaccgacctagatacgcatgcattcggattgatagataggattaatatttttcttggacggagaaagtaatacccaaaagataacccgagcttactgcgtgcaggcgaacaccgaaaagaatcactactagagaactgattgttgacggtcgttatcgaccaatttcgaccatcaatattactcaattaataaagactagctatgcttgcaatgcataatttgcaaataaaatatcaacttccactatatactatactactaacatagatgtaggagaagcacatataaatggagaagaatcgacagaaagtaaatggtcaatcaatcatacgctgtcgagatccagacttatggatgaatgcgcaaagaacacagaattcacacgatccactaggccttctggactgacgagacaacagggagacggcctgccgaaaattgggctgtttgggccagcctccccatctccgccgttgatcccaggttttggggtgtggatgtccaggatgcctccctcaacgacagttggagggcagaatgaacattttgcatcacctaaccgtcataactgccctatgtaaggacctcacatcctcactctctgcacacactcaagaagaagagctctctccctctctcaagtttagtagtatcctagtgctagtggagtagaaattataaaagtattcttagtcctcgggtcttcaggagaattttggtatgtctctagtagctttcctctcttcttttgtaagacttatggaattaatagaatattcttctttatacatcttcggtattttattccatttatattatctgagtgccggcttcattttatacttgtatcaatatagttgtgtagctagcctaccagagaggtgcaatggtgtgggtttagtgtccgattactcagttgatctatgtcatctcgggggatatatagtagtatttaataatgtagatgtggtgtctaaattattaagtatcactatctgggcatatatgctgcgggacagtagaggtgggccgctgatggtgaca

SEQ ID NO: 76258 - DNA, 7426 bp, Oryza sativa
ccaaaatcccttaattttagagacgaatagagtaactattaactataactataactatagtattacgaatctggacatacctctgtttagattcattgtattagaatatgtcacatccagttctagattcgttttttgggggacggagggagtatgcttcaattcccatatcacgctgctgctgttggagagatcataattagatgataaaatagccacactgaagtatggaataagaaactggatggatagaatgaacagataaaacgacccatatatgttaaaatgggcctccaagatgataatgcatcaccgcagtccatggcccattaaataggcggctgcattgtatttggattcacgtttgagctgcagtgaaacttgggaagttaagtgataaaatagttaagcatgtgtttgtttgaaaagatatttttagatgggaacaaggttagatgagagagccagagaaggaatattccaaaaaaaaaaaggctggatgagttcatccacaaaattagccggatgaagcatctcctttgctagtcttaatcattagtaattagtttgtgatgattaatatattttgttactcattagtttatggttgtttcttgttgtggcctagcctattttcaattacacaatgtctactgtccaccttaaagaccttaaggaggttacttttttgcaacattgtggttgcccttcaacttgttaagattagtgttgatagagaaaattagtccattttattgttaatttgtgtattatagacatattaataataattaatattttgtattataatttaaaatttttattgttttctatccattttcattcatccaaccaaataagaagaaactggatcgtccgatctactcaatcaaacaaaaatttaaaccactatctaaagaaaatgtggacatatcgtgagatatcttgacgataaacaaaagcaccctaacattccagtgagagtcaaatgaagtgataaaatagttacgttgtgacaaagaatgtggaagcaaatgctatagcttgcctaagtagctaataggtccttcatcgagaatttatatttcactattatttacaaaaggacggttaattttaagtggggacagatatattattggagtttgcaaaaacataaggaatggctaaaagcaagtactataaacctttaatcacttacctcaaaattccacataagcccatatgataaaatggagaaaagaagaaatgagaggcggtagaagacaccccttatgtaacgggcagtttccacatatgtaacgggcagtttccacatagacttcaagtaagaaaaaaaatgatttgacaaacaaaattattagaattagtgtactagagttagtgtgcatgtgatatattgagtacatactacctcttagtttgtatgaataaaattagaagtagcaactatctcttctataaaacttgatctaaggatttaattaagcactagtcccaatatcatatgatgagtaggaggatagaagagaggggaaaaagacacccctcataaaaaatgtaatatctatacaaacattaagacaaaaggagggagaggaaccgcagtacattggaaaaataaatattagaactagtgtattagacttatggatataatatattaaatatgctatgtctaaatttataagtatgcgatatggaaaaaaaatataggtaataacaaccatcttactaatccctttgttccataatataaaggattttggaagaattagacacatattgtccatattcgtagtactagaatatgtcacatctctccaaaatctcttatattttgggacggatggaattctatataaaacttgctttaaggcaccgtttgaatgtgaggttgggttgagttgtggcacggaaaacgtaatggaccattagcacgtgataattaaaattaaccagtccctccatcacacaaagccttcattttttgccttcttcatttatccgataatttgagccaatcaatgtatttgagtttgagaaatttgagaacggatgcaatggagttttcttaaaagaaggggtcaaatgtgttgaggtttaataaagtaggagttaaatacatcggagtttgaaaaagtgaagaacattttagccttttgactttatattaatatgcgtgagataggaaaaataaaatattttagacagagatagtgttataagtatgaagaatatatttatttgttttttttaaacaaataaacttctgtctactaccttcttcaataaaaatcatttttatatttttcccgttccaaaatataagcatttatagctatgaatctgaacatctgcccgtctagattcatatataaaagttgttatattttcatatagaggtagtacatgaatatggataggtactcttgtatgaatctagataaatggttgtccagattcatttataaatgttaacattttgctaacatagttgaaaatatttgcatgaaacacaacatttaacagcttgagaaacatgctcatgaaaaattaaaaaagaagcataagttgataaaatgatgacataaaaatagagcctctttggatggagggagtaaaagtgtaagacaattaacatgacgattttggtgggattatatgtttctggcacacgagtaagagtatcgtttaacagtttgagaaacatgctcatgaaaacaaataaaaaaaagtagagtaagctgataagaacgatgactagaaataaagtctttttagatgaatagagtaagacaattgacatgacggctgttgtggggctacgcttctagatacgactgatagagttgtgtgcatgtctagattcatgtataaaagtaaattatttttatacgaagatgatataaagtatttgcatgaaacatgccatttaacagtttaataagcgtactcacgtaaaataaaacaaagtagcataagttgataagaatgatgataaaaaataatgttttttggcggtagggagtaagacaattgacatgatgttttctgtgagactagatgcttctggagacgtctcatagagccgtatagctattcagatttatatatataagtgaattattttttaacgaagacaatagaaagtatttataagaaagactatttaacggtttgagaaacctgcttacaaaaataaaaaaatagcttaaactgataagaaagatgacaaaaaaataaagtacttctgtcgtatgaagtaagacaattaacatgatgattttgatggtgctagatgtttctagacatgaccgaaagagttgtatacattcatgtctaaaagtgaactatttttcttttacaaaaaaataatagaaagtatttgcacaaaccgttgaaccatttaagaagcgtgctcgctcacgaaaaataaaataaaaagtagcgtaagctgataagaacaacgataggaaaataaagggtttttagacagagagtaagacaattgacatgatggtttcagtcctactagatgcttctggacatgacggatagagctgaatacctgtccaaattcatatataataatttaaaatttttgctcaaaacataacatttaaccagttgaaaagcgtgttaaaacataacatttaacctgttaaaaagtgtgttcacgagaaataaaaaaaagtagcgtaacctgataagaacgatgacgtaatttttttttcgaccgatacagttggtatagtaatggtttgggtccgactagatgcttctagacacgacgccgtatcctctaggaggattgccgtcctcgaaaacccgtgctgagggtgtagcgcgcgtaggcctcgagcccatctcactatcaaaacgatctatcggatttcccaagtagaaacacacgtctcctgaaccaaccaggtgcacgatgcacctccccgcggtgccacacaccctctacgcctggatggtcaccaccaacaacgggggccccatctgccatgtctgcagtagaagcgaaaccccacgagaattcgaaaccatttcaaacctcccccgccagcgcaacgccgaaaacgcgaaaataagacagttcccacgtaaaaacttttcacgctatcatattaaatattaaatatgtaatattaaatatagaaaaaaagcaattacatagattttgtgtaaattacaagacaaatcttttaagcctaattacgccacgatttaacaatacagtgctacagtaaacatttgctaatagattaattagacttgataaattcgtctcacagtttacagacggaatatgtaatttattttgttattagactacgtttaatattttaaacatgtgttcgtatattcaatgtgacacgcaagatcaatatttttttttttgccaactaaacagggcctaaaccccgtttcccgctgatttcgcctcgttttgcccccaaactcgattcgaaaccatttcaaacctccccgcggcgcaacgcctaaaacgcgaaaaataaaccccgtttcccgctgatttcgcctcgttttgccccccaaactcgcgtccaccacccgccccgcccaaaaatcgcccaaaacgaaccgacgctacgcgagccaagccacccctcgcgcggcaggtcgcgaaaagttggggcaaatacacggaaagaaaccctccatagtacgcgcgcgaggggaagccgaaaaggcaaaccaaatcaccaacaaaaatagtaggccgcccccgtttctccctcgcgccgcctcgccgcggccgaaatctcaaacgcacccccccccccccgcccccccaaaattttcgctgccgcgccttctcgcctcccttaagaacgcgcctccccgagttctcctttgtctctccccgcgccattgccaatctccgacgcgttgtggaggtagttgttgtcggtggtccggctatgccgtcggccgtggtcgtccgccgcgcgcgcgtgcgcgcccggtcgcagtcgccgccgggggagttcgattcggcgcggcgcacgcggccgcggatggagggggaggaggagatgcgcggtcgcggcgggaaggcatcggcgcgggcccggtctcagtcgccgccaggtgggtccggttccgcggcgcgggtggaggtggaggggatgggggcgtcggcagtgcccgacgacatgctgctcgaggtgttcaagaggctgtcgccgctggcggacatcgtccgcgccgcggcggtgtgccgccgttggcggctgctcgtctccggcgccggcgggctccccgcgccgcctccgtacttcgggttcttccgcaactacgcgccgtccgcgcttccccctttcgtccctgcagccggcgtcggcctcggcctcgaccacggggcgctctcggtgtcgcccgcgtgcggcgccctcctcgtcgactgccgtggccggcgcctcctgctccgcgagctcggcgccgggtcggcgagagagctcaagctcctcgtctgcgacccgctgaggaagacgtccgtgtccctcccctcccgcttcgtcgccggacacaaggtcgcctgctgcgcgctcctacctggcgccggcgcggcgttccgcgtcgccgtcgtcctcttcggcgctgctgcccacttcgacattctagtgtactcttccgccgcctccgcatgggaggcggccaccggagcgctcaagaagtccatgaacccacaccaaggcccgacggtcgtcatcggcgacgtggtctacaagctccagagcgaagaagacaaatacgtaatggcagtcgacgcgaccaagatgacgctctcggcggtgccattgccgaacaccgggatgctcctgtacgccgggaaccactggatcggcaagacacacgacggccgtctctgcttcttcgcgctgcgggagcagctcgttcttgcgaagtgggttctcgagtcgccggggaaatgggtggagcagccggcggtggacctgcgcgcgctgatgaacccggccaccgtcggtgacctctcccgaatcaagctctcggcgaaaatctcggaccagctgcgcggctgcaagctcgtgagcttcggtggattctgcgagggcaccggcgcgctgttcttcgtcatggccgactgggtcgtatccctcgacctcgcgacgtggaggtttgagaggatgtggcgcaacaccgatgagtcgaggccgctcggcgacatcttccccgtcgagatgatggtttggccaccggtgcgccgcggcgatcttggcgagaaggaatgaggtgcaaggtgttcgacaaatggcaggctacttgaattgaaggtgtttttttgctgtaggcctgtagcgatgaaaagaataacaaattaagaatgcagtttgcgaatttgtcgtcaatttccattgttactcaaaaatgtgattaacaatgtgatacaattcactgaatcatactggaatggtgaaactttttcttttttttttttgcgggggaatggtgaaacttttgggtggttttatctttgtgatatctctttcatgaacatatacttagtaagagcattcccttgcatgttgccgttactcataacgaatcgcttcgaatgtcactttgacctttgaaaggattggttcattatgttgagtaaatcttgtgaatgctaggagtaaagccgaccgtttctgccatttttttttcatttaccaggacgcattatttgactgcattcatcactgatagccataatgtaaaactcgaatattaaaaaaagaatgacgaaaattgcccccttttttcattcaaaagaacattgtctttgttgctaaaagttacttccctgttatagaataactttatttgttatccatttcataatactaatattgacggagcgtggggctcctcaccgggagaccgcgcaggcccccctttgccagttcggccgggggccctgtgtgaggttctaagctcttggtctgtggaaagttcgcgagaatggaaacacacaagacacgggcgatgtatacaggttcgggccgctgagaagcgtaataccctactcctgtgttttggtggatctgtgtatgaagaagctacaaagtccgagccagcccccctctcgttctaggatcgttctcctcttttttccccctttttctaagtgggcaaggtcctccttttatatctcaaggggataccacatgcaccatctctccctctctttcttacttgacttctcttcattaatggacggagatttgtatggctgccgtccgaatgaccttctgatgggacggcccatacctacctccacttccgccggaagcagacgcgacgtgggaacatggctgtctgctgacatgaccattgtcagaccgatcacaaatcggtcattcttgtccaccacgtgtcagtttaa

SEQ ID NO: 76259 - DNA, 4476 bp, Oryza sativa
tcccttgggattaaacaaatatgatacttggaatactccggggtgaaatgctaaaatggtatatccgtgcgcttacggatcatatttgtgaccataaatataccatgaatatttcttcgtcattgctgggaattatatttctagtaatgccgtttaagaaatatcaacactaatctttgcttggacggcaaaaatcacagttgcccaagttcgaataggatccgagactaaagaatatctttagccacgacaaaaatcacagttatcccggttcgaacactaactgggatttaagatcatttttagccacggttcaataattgtcaggccgtgtcaggcccccaacaaggactaaagatcatcactttagtcccagttgctgttaccaacccagactaaaataggaggatctttcatcctggctggtaacaccaatccggactaaacattgatcattagtcccggttcataaaccaacccagactaaagatatttttagctccacttggtgttaccaacccggagtaaagatgcctccagggttagtttaaaaataaagcatctctatccaagtcagatgtgtatactagagatgaaaacggtcggaaacggtatcattattttattatttttcgaaaacgaacggaaacggtcgaaaaatttccatatttatgaattcatctatttagaccctgtttgattcagcttaggattattataatctagattattaggagtaagctgaaacaaacaagtagattattatgctagattattataatctataagccggattactataatccattaatctcctctagagaagcttttttcagattattgagtggctaaagacctactacccttagatgcctctaataatccagagaaataaacaactcgtagcttattttatgtcattattataattcagcttagagtaatctaatttaataatctagattacaataatctttaagctgaaacaaacaaggccttagtgtcaacttcaatgccatgctgacagaaattaaaaaaaactaaattttgaaaacggtaaccatcggtaaaaatagtattattatattagttttgtggaaacggtatcaataccgtcgggaaattttcataccgttttcgtaacacgcgtgagggttgaggtgagagatcttgagtttgaatcccacatccgacgcgtttttttgacgtggtatgcatctttagtcccgcttatttcaactaggactacgaagggttggcaaccgggagtaaagctcccttccccaggagtgaatgcttgtttggttctatggctgatttttggggaaatttgtgcccaacccctactcgtcacgtgtgaaggaatcaggccgcatgtatggtgtggggccactctcttttggattgagacgacggttatgcaactttttaccaaccatggatggaggtttaaaaatagacttgaataattgtgtattccttatcttggtctggtcacttttataatgtttaggtgtgtttaattctatttgaactacactcttgttcgagtgttagattgtaataattggctgcagctctgtttagcaaaggccgggatgttatctattccattatctaaaaaataagtgaaggaatcatgccgcgtgcatggtctggggccactctcttttggattgagatcctcttccttaagtcagatgacattaaattctttgacatgtggacccatagaactagaaaaaaaacgggtaatttagaaccatgccattataattttgcaaagtttgagatatgccatcggtatctcaataacatgtaggacccacatgagtcaatgacatgtgggtcaggatggcatatctcaaattttgcaaaattataatggcatagttccaattttcccaaaaaaaaaaggatcccatagtaggcagaggctttggccatagccttgtgggctgtggtgcaaattctgtggaggcggccggtcaaaggcgaccttgtctacctgcgtgtggagtcgtggagctagacgacgtcacctcgcctcgtggtttggagtcaaacatcgaccggggtggatggtgcgcgccgcaaatagaagaggtggtgtggagtttacaaactctggaggaggctactccgccgcagcgcagctaacaagcaaccaagacgacatcaagcttcgccgctacaacaggcaatcgcggctacaccgctgcaacaattgaggaaaagaaagcagagcagcgctggtatccttttgtcgagaaacctagaaaccttttaagttgggcgggagcttatcgggcagcatttgcctggtggacgccgttttgctacgtctatacccagacgctgctcgtaacagtgaccacacctggacgatcttccaaatagcgtccttactattttgctaaataatgccaatgaattactaatgatttaatttcatggttattaattattatatataggaaacaatttcatggttatctatatacctaattaaaaaatacggaaggcttcctccctccgctttagtccgtccccccaccccccctgcccccacgccgccagccctcccatgcatctccgcttccgcctctctcccttccttccgacgcccccatctcttcgttgctgcacgctcccccaccctcgcggccctcttctcccttgcgcctctcctctcccgcctccctctctccctcatggcactgatgaaccctgagttccactcgacactcaagactgttgttggcccaatctttcgatgagtttagataactacgatttagaagaaacgttgatgacccgactacaaccgtacaagacgttacgttgtaccttagcgaccaatacacatctccatctttcattctttccgcgagttcaaggaaaacagaatcctctcgttcaggaatgtgttttgacgcacttatccggtcgtgttcgccaccagagctcgtcattatcgtttctccctctaccaagaccatgacattgcttgcccaattcctgctgttttggttttcttcattgccgaccaccaccatctatggacgagtcacatcgtgagacacatcctaccatcttcctcgccactgtttggtcataggagcaccgacacccatttcccctcctcttttgtttctcgtcttcagctagggaaggcaatgaacaatgtttttttttgacacaattccttcttggtctagcccaaagatgctcatggaacactcacagaccataggactatgaatagaacaataaaattctaatttatgtcaatgaaacatgcaccgttttagaattaatgtattggatttttcatttgtgggctaaaataagttttttcaatttctaactaatttaagttgttttttcacagtattagttttagcactatttgatccattaaaaattatcataatttatatttttctttgtattgaattctttataggtaaatgaaaaaatagggattaagttatgtaattttcatgatattgaattatcgttccggacaaaagttatttgtatgtttgtatttccttcgtcgtttatcccaactataatatatgattttggattttaatttatgtcaataaatattatttagaaaccgttgcaacccacaggcattatgctagttaattactcctcgtcccaaaatataacaatttttagcacttagagcaattttaatagtatagcccaccgttagctcaaaatcatctatagccaatgtaacagccaattcatacaatagttgcttactatactattaatacctggtcccacctgtcatacacacattatgtcttgtagtccgtgctgcagctggctacagatctgtagcccgctacttttctctctcttcctttatctctttaaaatatgtttatagttgacttatagcctgctattgtacatgctcttaggatttgtcccaaaatataacttcttcatcagcatttccttcctaaccaatcacaacccttcacttttcccacctacctccactgctcaaccaatcacaatctctttctatttaatgctatctatttttttaataaccgtgtccaactctaaaactgtctatattctgtgacggagggactattatatataaaaaaattcagcaacccctctcgggtcatttggttgggggagtttttaggagagattgagagtttagagggatgatgctattaattattctgtttggttgtgttaacaaccaaatttggtaatatcacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatcggttcgaatgctgtcaggacctgtcaggcccccccgggatctttagt

SEQ ID NO: 76260 - DNA, 16195 bp, Oryza sativa
ccgcctgtcgccacctaacccacgatctgaccggtctgtgaccggtcacagcacgaataaacgagcgcgctgcactgcgttacatgcggcgtgacgcgctcgtccaaaccgtaataaatgtggttaggtgagccccgctatgctcacctaccccatatacgcggcgcaaaacccacaaggggtcggggcgcctcggccctcggggccgaggcggtagcggtccgacccctcggggagacaaagagaagggcggccgtatcaccctcgggcccgacccccccgagggggttaggccacgtgggcgatcgtgtctgcctcaagtctctaagtcatgatactcctggtcccatgtcaccgacagtagcccccggcgttatgccagggcgatcgccctcctcgagggaagcggtcgggcgtgacgccacttcctaaggcctggtgacaggtggggccggtctaaaaatcgggacaagccggttcgtttttcctggagatatgatgatggcgcttcggtcggcgagcgtaattaacgcgcgcacgagatgttccatctagactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcactattattccccttgtcttcgccgcttgcgccctaactccttgtttcctgtgccctaccttcgccacacgcgctcgctctcaaacatctcttcttccggcgtcatggcacggggctccgctccgcttgatggtagcgtgctgccgccttcccgcatcgtgagcgagagacaggccgagctgccgcgccgcttcatgccggaatctgccaccggccgggagatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgtttcggtggttcttcactgtacagccggtgtcgccgccgtcggtggttggtggttgctacttccagccgcgggggccggtgctgaaccactacattccctgcgtcctccgcaagaagtgggatgactggaagagcgactggttctatacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccagggggtcagatgggactgggctcctgaggacttcaagatagtggtccaacgggtgctgaatctcagctccgtggaggcatccctcatttctcaaggagtcctccccctctgcagcgatccagaccgtgcctccatcctgaccatcatgcaggcggtcagggcgtcggaggagcgggctcctcgaggccacgatggcgcgggcgggagccgcaggggggaacgatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgcccggagggggccacgccgacgtcgcagcccgaggggagcggaagaagaaacggccccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtctttcttctgtttcagcgagatcccgtcgcgtccctcccgccattccaagtccggccagtctgaggccgaggacccggcgaccacaaaggctcggaggcgggaatctgaccggcgagaagccgcggatcgcctacggtaagccgaggaggccgcccaggtggccgtccgagctcgccaagctgaagaagccgctcgggaggaggccagacttcgccaggccgaggcgacgacatcctccgaggcgacccgtgaaactgaccggcaagaggccgcggatcgccttcgagaagccgaggaagctgctcaggtggccgtccgagctcgccaagctgaagaagccgctcgggaggaggccagacttcgccaggccgaggcgacgacatcctccgaggcgacccgtgaaactgaccggcaagaggccgcggattgccttcgagaagccgaggaagctgctcaggtggccgtccgagctcgccaagctgaagaagccgctcgggaggaggccagacttcgccaggccgaggcgacgacgacttccgaagcagctcgcgacgaggccgcgggcgcatcgcttgggcccactcactcgtgcgacgctcaggacaaaccaggtccgggggacatccccgagtccggcacgtccatcggcgggccaagccgcgcggcatcctcttcgaggcggctcttccccacgccttccgttgctccactgagcgcagaacctcttctgcaggccttggccgtcgctaacaccacggtgttggacgggttaagtgcccagatggaggccttgcaagcagagcgggtggagctcgacgccgcatgggcacgtgtcaaagaggggcgtcgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccactgtgatgaacgaggcgcaggacaccctccgccttcaatacgggagctgggaggcggagctagggaaaaagctcgacgccgcccggggggtccttgatgctgccactgcccgagaacggcgggcggcggagaccgaggcggcgtctcggcggcgcgaagaggccctcgaggctcgtgccatggcgctggaagagcgcgccggcgtcgtggagagggacctggtggaccgcgaggccgccgttgccatccgggaggcaacgctggcggcgcacgaggccgcctgcgccgaagaggagtccgcgctccgcctccgcgaggacgcgctcaccgagcgggagcgagctctcgaggaggccgaggccgcggcgcaacgtctggcggacagcctgtccctccgtgaggcagtgcgggaggagcaggcgcgccgtaatctggaaggtgcccgcgccgagagggccgcgctgaaccagcgggccgctgagctcgaggcgcgggagaaggagctggacgcgagggcgcgcagcggcggggcggccgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgcttcgggacgccgtctcccgtctagtccgcgccgggcggcaggcgggtctctggggcgggcggactgtgaagtacgccgccaaccaggggggcctcgcccagcgcttctcggagatggccgggactctccagcggctccccgaggagctcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgacacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcactacgccccggggcacggctcggttctgggccccgtttggcgattttagccgacccgagcccccgagggcaggattgaacacgagtgacttatttcaagtcaagatccttcaaaaggaaacaacagcacagatacagcctttaggaaattgaaaatgtttttattgaaatacagatacaagagatataagaatatgcatatgtggtagcccccggccaaccctgcacgcccgaggggggtgcggggttggcctgagcccgaaacctgacacccgatccccctttaggggtagaagcgatgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgtggctcggagggccgcgcgccgccttcgctcttccaagtagtcgaggtcatctctgcgaagctgatcttgatcagcctcgcagtacatggtggcccgaggggaccttagggtgagctcggatgggagaaccgcttccgcgccgtagacgaggaagaaaggcgtttccccggttgctcggcttggcgtggttcggttcgaccagagcaccgttggcaactcctcgatccacgaatcgccgtgcttctttaggatgttgaaggtcttggttttaaggcctctgaggatttccgcattggcgcgctccacttggccgttgcttctggggtgggcaggtgaggcgaagcagagcttgatgcccatgtcttcgaagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcctgcctaaacggtcccaggatatcgagcccccagacagcaaatggccatgaaagtggtatgatctgcagggcctgggccggctgatggatttgcttggcgtggaattgacacgccctgcatcgccggaccaggtcgaccgcatcattgagagctgtcggccaatagaaaccttgtcgaaaggcggagtgggatccgcattcgccttcatggatatcggcaagaaactcgacgccttgttcccgaggaatgcacttcaggaggattccgttagccgcgcgccgatagagggtcccttctaccagcacgtagcgtttggagatgcgctggacgcgttcactcccttcgcggtactcgggtagagtcttatctgtgaggtatgcttggatctcaacgatccaagcaatcaatctaagggagctgggagcgctcccctcgggtcccgaggcctggactccgacaggcctcgggggcctgtcaggcgcgtccgtctcccctgaggggtcgggtcgcgccgaaggctgggcaagcctttcttcaaaggcgcccggtggggtctgggctcgcgaggaagcgagccgtgagagctcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccccagtccagctgccaccctgagtcccgcaaggagtccttcgtactctgccatattattggtggcccgaaagtcaaggcgaaccaaatatctgaggacgtctccgctcggcgaggtcaacgtgacccccgcaccggcgccctgaagagacagggaaccgtcgaactgcatcacccagtgggcggtgtgaggcagctgcgaggggcccgagctggcctcggggactgagacgggctcgggggctggggtccactctgccacaaaatcggcgagggcctggctcttgatagcgtggcgtagttcaaagtgcaaatcaaactcagaaagttcgattgcccatttcaccacccgtccagtaccctctcgattatgcaagatttggccgagggggtaagacgtaaccaccgtgacccgatgcgcctggaaataatgacgcagtttgctcgaagccatcagaatagcgtaaagcatcttctgggcctgagggtatcgggtcttggcgtcccggagggcctcactaacaaagtagacgggccgctgcacctttcggtggggccgatcctcttcgctaggggccacgtccctggggcgctctttgtccaagcggcctcgcggggtgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccgagccaagccagcacagggtgggggtgcgcggaatgaggactgtcctcatcgcgctccacaaccaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctggggggcgcatctgctctatagctcgtatcttctcggggttggcctcgatgcctcgggcagagactaaaaacccgaggagcttgcccgcaggtacaccgaacacgcatttatcggggttcagtcttatgcgggcggagcggagactctcaaaagtttccgctagatccgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaacccgagtatgcatctagaaaacacaaaaggtcgcaccccgctgtggagtcgacaatctgatctatgcgaggcagggggtaagtgtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccagaccggccttgcgcccgaccgcacggcgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcacatgtgactatccgctgcctcggggcggcgggggcggaggtgccaagcctctcgtcgccaccctcgggcttggacgcggcggcgaggtggtccgcgcgctgctccatacaagcaagcgcgactttgaggtcgccatggacagagatggggccaccggggcccggcatcttcatctggaggtaggcgtagtggactgccgccatgaacttcaccaacgcgggcctccctaggaccgcgttgtagggcagactgaggtccgccacatcaaagttcacccgctccgtgcggaagttggcggatccaccgaaggtgaccgggaggtcgatatgacctagcggccaagtgtgacccggcgtcacaccgataatcggctgggacggccggagcaccatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgtttggcctcacttcgccgattgccggaaggaaccgccggggacttgccctctcggcgctcctgcctcctctcctcctcccacttcctcgtccgcttagccaaacttttgactgcgcggcagtccgcgaggtcgtgaagggaagtgttgtggacgatgcaccacttgccggttgggcgctccctgctgggagcgccggcctccttctttttgtcgcccgcaggcctcccttttcgggtggcccgcgaagcgccctcgacggcgaggacatgaccctcgtcgtcggtatgggctgacctcttcttcctcctcctgtcacgccgccctgtctgagcagcggatccgggggcggccgaagctgccacaccggaaccggaggggttccaggtccatgcctcctccttacgagccactcagtccgcaagctgaaaaagctccgcggtagtctggggctctttggaggcgatcttttcgagcatgcggttgtgccgcacacccccccctgaacgcgtagatcaccgcgtgtgcagggatgcatggtatggtgttatggacttgacagaaccgctgaatgtacgagcgaagtgactcatcatccattcgctgtactgcatgtaagtccgcttcttcacctgggcacggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatatttcggcgatgttggcccgaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatatcgatgtgggcatccggccccccacgcagatcttcctgggtcggaggcgctgacgaaggagtggcggccgaatggcgagcaacagccgccgctcgccgcgccctccgccttgacgatacggagccggtggtagcagcgccagaggtcttggtggcggaggaccgcccaccagcacctaggcgctgccgtgccgtcatgaccaagttggccacgtcgtccagccaacgttgggctggagactccgggtcaaggacaatgggcgggtgacgtaggagtgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggagggggcggtggagtacgagctcgacggcgtgggtttggctccccatcgtcgccgctaacgctcggagagaggttgtgcgcctttgcttgttcggccattgggctgaacaggaaaagcttggcgcacacgaaagagtgcgagagcttagaagaacacacgcagaaccccctacttggcgcgccagatgacggagcgtggggctcctcaccgggagaccgcgcaggcccccctttgccagttcggccgggggccctgtgtgaggttctaagctcttggtctgtggaaagttcgcgagaatggaaacacacaagacacgggcgatgtatacaggttcgggccgctgagaagcgtaataccctactcctgtgttttggtggatctgtgtatgaagaagctacaaagtccgagccagcccccctctcgttctaggatcgttctcctcttttttccccctttttctaagtgggcaaggtcctccttttatatctcaaggggataccacatgcaccatctctccctctctttcttacttgacttctcttcattaatggacggagatttgtatggctgccgtccgaatgaccttctgatgggacggcccatacctacctccacttccgccggaagcaggcgcgacgtgggaacatggctgtctgctgacgacatgaccattgtcagaccgatcacaaatcggtcattcttgtccaccacgtgtcagtttaacaatctgcatgttcacccttcttcatacaatatcttgcctgtaatggttaggataaagcctggcatatatctgaccggaaccaacgtgccatctccaggagctaacacgccggttccggctagggacgagtgcttggaggctctcgtcctgacgggatggggcgaggcgtgcgtcagaccgcctatcgccacctaacccacgatctgaccggtctgtgaccggtcacagaccggataaacgagcgcgttgcactgcgttccatgcggcgtgacgcgctcgtccaaaccgcaataaatgtggttaggtgagccccgctatgctcacctaccccatatacgcggcgcaaaacccacaaggggtcggggcgcctcggccctcagggccgaggcggtagcggtccgacccctcggggagacaaagagaagggcggccgtatcaccctcgggcccgacccccccgagggggttaggccacgtgggcgatcgtgtctgcctcaagtctctaagtcatgatactcccggtcccatgtcactgacaaatataaaagaaaaataaattatcccaatatcctatactttatcaaattctaatacaattactcttaattttatctagtcctaataaatttatcccctatttctgaaagttctaatataaatatctcttaaaagttgaagtagtaatatctactattctgtaaaaaaaaaacgaattcctagctacgaatgtaggtaggattggcctttttttttttggcacaaagggagtatttatgtaaattttggatcagaaaccactcttttttacaatagaaggaatcaaaattttcagttaggaaaggtaatgtgatggtaaaggagaagttgctagtataaggcttcgtttgataggagagattgctgtgagattgagtagaaaacacctcgttttctgcgcgcacgcttcccaaactactaaatgatatttattttgcaaaaaaaattatatagaaaagttgctttaaaaacatattaatctatttttgaaatttaaaatagttaatactcaactaatcataagataatagctcaccgcgttttgcgtatcttctcaatctcctcttttcctatcatctcaaacttagccttagtagcatcgcagtccgaacaaccaggtgcactcattacatccagcagggaagtaatgaagttattcacttaggctgtgtttaaattccaaaaaattttagccaaaaacgtcacatcaaatgtttggagacatgcatggagcattaaatgtggatgaaaaaaaactaattgcccagtttgcatgtaaattgcgagacaaatcttttgagcctaattgcgtcatgatatagacaatgtggtgctacagtaaaaaattgctaatgacggattaattagacttaataaattcatctcgcagtttacaggcagaatctgtaatttgttttgttattactctatgtttaatactttaaatatgtgtccgtatacgtcaaaaaaaaatttggccaactaactaaacacagccttattctacaaagtacaacgaaagcttttatgttgggtgtacttgtttgtttaaatgttaccacctctgtcgcaaatcacttctgaagttattaaaaaaataaaaggagagtaaaaattaaattaaagatgatcgttattgattgagaaaagaaagtatgtgaaaaaaataaatgaaagatggttatgattggcacaaaaaacacttcattaattaagtatgatgtggggagatgatggccgacacgtcgacgacttaccagagttccgcgtgtgggccattgatcatctcaatggtcgaccggtattggagcattggtacgatggccacacgtcgaaggtgttcggatggtggcaaccgtcacatatgactggggcacgacagcatgcgagggaaggatgtttttgggcgacatcctggtctgcttccaggttgacagcggcgatgcttttccatttccattttctaccaatctcttatgcagacgatttgtcctcttgcggcgacgcttctgaccgccacaaaatgaccatgttggtgggttcatgtgagggagaatggatccatttctctatcgccctctccctctacaacaaaaggacgtggatggcgttgagtgtagataaaacacgacgcttttgtttgtttccttagaggggttcgctttgttgtaggcgtgtgatatggcttgttgttttatttttcctgattatagtcatgatctcccatagctatgatcttgtaacttttttatcctatatcaatatgaacctcacactatcttgtgtgatttgattgaaaaagtaaaccattgtaaatttgaaaatggatttattcatcttttcaataaacttttatactatatccgtcccaaaatacttgtcgatttgagttgttgtctgtaacgtttgaccattcgtcttattcaaaaaattatgaaattattatttattttgtttgtaacttgctttattatcaaaagtactttaagtataacttatccttttttttatatttgcactaatttattaaataagacaaatggtcaaacgtagcaagcaaaaagtcaaaaggatcactaatttgggatgaaggtggtatataaagttttttttaataaaatcaaatgatgccattaattttggaagcaggaacatacatgtgtttggtagggagtacgtgtttgtccatgggttggtgcatttaagaatgtttaagtcaatgcacaaaatatgtgcttctctattttttttatatacgacgccgttattttttttacacacattcgactatttatcttatttaaaaaattttatgtaaatgcataagatataaatcatacttaaaatatgccccaaaaaaatttttagtgacaacaacttacagcagaataaataataattatgtaaattttttaataaaataaatgttaaatatgtgttaacaatcaaagtcatcatctatttaaaaaactgaggtagaattaggaccagcagagttcaaatgtggtatgtgctgactacgtggagtgaaaatacgtaaggtgaatctttagcatatggttaattgagtattaattattttgaactagaaaagatgatttgtataattttttaacgcaacttttatataatttgttttataaaaccgtttagtagttcgggaagcatgcgcgtggaaaatgaggcaaatcttctctcaatgttcttttttttaatcaatctctcactgttcttcaaaagtacattggggagttatgattgcatattactcaatccaacaagatcatattctatttactaatactccctccattccaaaatactccctccatctacttttgatagtcatattttcaaatctgaaaaatctatttttgataggcatatttcaatccaacaacctatcatcttaatgactttctcagatttaatgcatgattctccattcttccacacaagatttgttgcatggacatcgagaaatgtaaatattaatgaatcgcttgtttacgaggaatgactagtagcatgtttaaatggatgataagtagaatcacttatcattggtctgtgtgtcaagatgaaatatgactatcaaaagtagatggagggagtataaggcacaaccacccttaacccaaagaataagaaataattattatcacttatagtttgaattaccctaataaatagaatgcatacacccaataaaattagagatcttgatggtggaagctttaaataataatatttgagtggaaaatatgtgctagttaatgacatgcatgcatgcacgccttatattatgaaacaactttaaaaagtagttgtgacttatattattgaatggaggaagtatcatgtactgataatatattgaaccaaacaaatcctaaatttgtcaacttaagcctcctctgaaatactccctccgtttaacaatgtaagtcattctggcatttcccatattcatattaatgttaatggatctatatatatatatatatatatatatatatatatatatatatatatatatgacactcatatggggcaccatggtgcccgggcaccatgatatcaaatacacaaaatcactcaaatttttcaaaattttcaaattgtgagtatatacctagttataataactcgattcatacctatacctatcaacaaaacaactcagatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatatatatatatatatatatatatatatatatatatatatatatatatatatatatatatatat

SEQ ID NO: 76261 - DNA, 4703 bp, Oryza sativa
ctcatttgtgtggtatggtaaccattcaatctgcaaaagttgaagagatgtcgttggttagtatctcaattaaagaagtaaatgtctaactagaagtgatattggaagtacttacatgttgagactgtaagcagtccatctcattgacataatgcttgtatgccacatcccggtgagcatgtgcagtggcagtactctcaaaaaggtaggccactgtcttctccatgtctggctcattgtagggccaaggagtgaagctttgcctccacttaggccttccaaccggtagtcttaaccacatccacagctgaatcaatagcacacaaccactcatgttggatgatggtgcctgacgacaacaggcctcacagagctgtctatatgtccacgccaacactgctgagccccaactgaaacggcctagatcaccaaggttggcgaccaaaggaatccatatcgccgaagcaatgtcatccccagcatcaggaaacagaacccctcccaacaagtgcaagatgtatgcacgggcataacactcaacacgccatggctcagcgtcgtcgtcaagatgtgagaagttctgactcagccaagacaggggtattccattctgcttcttcttccccccttgcccctgctcaatgttcagtggaatgccaaacagctgctccacttgtgcacgccatccaggagtctctgtcctgcccgtcacggcatgcccccgtaatgggagggccaagatcatagccacatcctgtagagtgatggtcatctcaccattagggaggtggaagctgtgtgtctcaggcctccatctgtccacaagtgctgtcaacgcaggagcgttgaacactggcattcctctgctcacgaccaaggccaccccgagcaacccggccgcccttaggtacgggatgtacctatcgtcgaacagtgggggggcatgagctctgactcggagcggttgaagtacctgcattagcaattgtaaatcaattagttaatataatgtcaaatacacgctacagatacttatgcacaagtgaatcaatgccgattcataccctccccgcctcgatcgcagccccgcgatgatgggcctcgtagtacgcctccaaggctgggtaagtcggcggttgtctctcctcggccatactacatgaaaaagtaataaattcaccgttagttaccaatgtgacatatattaacagaaaatgaatgcgagaacatgagtaggaaaacaaattatttacctccctaacacatatattttttttggacttcttcttttttggacgcttaagacacttagttttcttgtgactctcctggtgacacaacgagcatctattttgcaccggcgcagcatcaagttgaacgcatgaaggtggtttccttccaaaaccacccagacccgaggtcatttcgttcttgaatcgtttcgatctcctcttccctcttgtttaaatcttcaactttcggtcagcaacaaattcttcaccatcgtacggtggccactgtgtggggtcgaggtatggctcaaagcgacttgcccatgtgttcacaacggctcttgaagagaattgatacggcattcggttggaagatttctcatcaattgcatgaatcagataaacgtgtataagatgtgagcaaggcatatggtagagcaatggcctttggcaagaacatgagttcccctcaccttcaactttgaaggctcttgcgccgaatctaacaccaccacgcgttatactacccctctctgtgacctcgtatgtctttttctgcttatcgaaacaccttgcagtgtgtttgttcgccttacttttttgcaccttcatcttactatcaaccttggtggaccaacgctgccctaactggactcgcttcaaagcttcatcacgtctgttcacaaagtagtcattgcacttcatgaacgtaaatgatactatggccgtcactgaaagcttacgaacaccaactagcacgctattgaactgttcggccatgttggttgtcatgtaaccccaccggcggccatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctggtgcttgtccgcaccgcccttgtggaaattagcattgaagtgcctcatgcaccatcggtggtgaaccggtggcaatcctggaacaggagtcgtcatggcattcattataccagcatgtcgatctaagataatacaaacctccctatgcggcccaaccacaacccgtcagacaagatcgataaccagcaccagtctcgtgaattctctttctccaccaaggcaaaagctaaaggtacaagttggtcctccgcatcagctgataatgcagtcatcaaggcaccaccgtatttctcagttagaaaggttgcatctatagctagtactggcctacaatgcttaaaagcctcaatggaaggaccaaagcaccagaatgcacgcataaaaattttcttggtcactccatcaacgttgacaaccctatcagaatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacgcagaagcagagagtgtacgttgcagttttatggcattgcataaactatttactatgaactttgatgtcagctgccggtggctccctgaaccttcggtagtagcacaactatgttccttacctacccgtgatatcctccacgttccactagactttttagttgcatggaccttccatttgcaccgtgggttttcacatttaacagtgtacctcctatttgcggcagaattgacaactcggtatggacgatggtgcacgatgacgtaatcctgaacccatagcttcaatgcgaccatgtatggaacttttaaaccctttttaagaccatccacttaaaatggttctgacaactgatctaggttgatgcggccatctagtagtgccccatgggcatgtgttaggtccctaaactcagaaatgtccggcttcctcacaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccactactcaattcgacatcaaagtaatcatctggattcacatattggcctgctacttctgtcgggtattcagggttgactccgtacgatgaccaatgaacactcgccgacaaatgttcacttagatcaagcccctcttgtactaactcccttttcatctccctcgctgcatccacatcatgactaccacaatgtctctttgatggtcctgcctcccataaatcatttccaagcaaaggtctcttcttctctccttccccctccaagtcttctcgtaccaactcagtcttacttgcaccccctccacgacgagaataatatgtcacaaaattcttctcaacgcaatgataagaaggagatttgtttagatccaaattttctacggtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacattatcctcggtccatccaagaacttctttcactcgtgaccttagttcatctagagttgggtgggtgggaaacaaaatggtcttcaataacatatcctcaaactcaacatgtgtaccaacataaggttccaccactctaccaccgtagtaaacacgaacaagtcaatccatctacaccaaaaaatcaaatgtaactttgcaacaaaaattaaatcttcattcctaaacgtagtccaaaccgacatattataaccaatgcataacttaaattatcccaaagctactactccaaaaaaatatttaattcacctacaactatcaacaagtttactagtgcattacacatcgaaatattaaaaatactccgtcatacaacccaacctagttctagttaactataatcaatttatataatgcaaccaaaattttctcaccttcatataattaatggttaaaagtttaacctatagactatagcatcaagtccatcaaattaaaattactttcatgcctcaaccataatttttatatccatccatccaatcaaaccatttaaaaattaacattaccacatatatggttaaaaaaatcgtgacaccaatgagttcattgcaaacatatagcactacaacaagccaatcctaagaacaaatgctaaaaatcacacatttgggtaaaaaaggggttctagggttgcccaccgatctacaaattcaccactaaaaacgaaaaaaaagaggggtgaatg

SEQ ID NO: 76262 - DNA, 7172 bp, Oryza sativa
ccgacaaagctggtgacaatgaactgctctctgcagataaatgttcacaacccttccacgatgttcggcattcatgtctcttcgacatcgattcagatcttgttctcgcaaatcgcgatcgccaacggtcaggtagcagctagcaccttcagcaccagaatttctgtactgcaatttcctcttccatattgaactacaaccacattcttaagctcaattcatcctgctgctctgcagttggagaagttctaccagccaaggtcaagccatcatgtcgcctcggcgatcgttcatggcgagaagatccctctctatggagctggagaaacattcgccttgtcgaatgctggaggtgctgtgccactgactctagacttggtggtaagagctagagggtatgtgattggtaagcttgtgagggtgacacacacaaagcgtgtgaaatgcccggtggttatcgattccggtagctccaagccgattaggtttatccagagtgcttgtagttacacctgatgcagtgccttggccttctataatctcaataagggctgtgatcatgtactccctccgtatcataatataagggattttaagtttttgcttgtaacgtttgaccactcgtcttattcaaatttttttgaaattattaattattttatttgtgacttactttattatctaaaatactttaagcataacttttcattttttatatttgcaaaaaaaatttgaataagactagtgatcaaacgttacatgtaaaaaatcaaaataccttatattgtgggacagagggagtagatatttaggtccttcatgacatgagcaaacaagaaaataagcagtagttttatcttccaattttgccatgttgatatctcttgctaacatattgtgatgtcgttttatcagtgttacatgtcattgcgctttgcgacaagtttttatacactaatttagaagttggttttaaacaatatcctctgttagtttcatagatcgatgaaatggttcagaaagaaattgaaggtggaaaaaaagaagttatctcctgaacagagtttcattctaattctacatcttcaaatttttcacagaatcattcaacaatttgagttctcttcctgtcctcagcaatgacaacctgattcattgaactagacataccatatatcatcagtgttttggaaaacaagctgtccatgatcaacatacatttgctatcttacataaacatatttcccagtcttccttccaaaatttttgagacatctgaagcgagttcttggcacagcagaaatcatccaatgtgtgttgagaaatagtaagaattgtaattgacaggttcttgccagtgtacatttttcttttttactgagcaacaacacaagatggcctcctctaactgaggaacaccatcttcagtgagctgatgctctggccatacactccacactgcatctgaagctgcttcctgcaaagccacgtggatctcaccggaagccggcacgatcgccggagcagcgacagcgacggcgacgacgacctcgccgtcttcaagctcatggaagctcttgtcacctgcatggatcgtgacgcgtcactcttggcatggccattggttctctcgaagctctgcagcttgtcgtcgccatggttgtccgggaagtagggctcctcgtcgtcgtcggcgtcgaggaggtcgccggaggaggaggaggagccgagcgcgcggttggcgttctcgacgaggccgacggccttccacgcgtcggcgacgaggcagtaggtggtctgcttggggcggacgccggcgtcctgcatcatctggagcacctcctcggccttccatggctgcttcagctcgctgtagccccagatgagggtctcgaacgtcctgaggttcgggcgcacgccggcgtcgcgcatggcggcgtagaccctcacggcgttgcccatgtcggcgacgctgcaccacccgctgatgacggtggtgaaggtgacgacgttggggcggacgccgaggcggcccatctggcgcaggagctcctccgccttctccggctgctgcgcgcgcacgtagcccttggcgaggatgctgtacacctgcgggtccggctcgatcccggcctcgatcattttgtcgaacaccttcatgcacttggccatgtgccccatggagctcagcgcgttcagctggtggctgtaggtcacgatgtccggcttgatcccgaactgctccatcagcccaagaacctgcaagaacacaagatcgcagatgaaaactcgatttcgtttagtgttcttggttattgttttgtgatgatagctcacgtcgtcgacggcggccatgtcgttggcgtcgaggaagcccttgagcagggtgttgaagacgatgacgttggggagcacgccggagtccttcatctggcggacgcagcggagcgcctcgccgaggcggccctcgcggcagtagccgccgacgatgatgccccaggtgcgctcgctggtgcggagccctgcctgctgcgccatctccacgacgagctcctcggcgcgccacgtctcgtcgttcttggcgtacgcgctggcgagggtgttgtacgtgacgacgtccgggtcggcgcccgacgcgcgcatcctcgccaccacccgccacgcctcctccagcctcccggcgtcgcaccacgccttgacgaggatgttgtacgtcgtcaggttcggcctgaccgccgcctcgccgccggcgccgccggaggccatcatgtcgaacacccgctgcgactcctcggggcggccggctatgccgtagcccttgatcagcgtgttgaacgtgctcgccgtggggcggcagccggagtggcccatcctgaggaaggtgttcgtcgcctcgcccatccgccgggcctcgacgagggcgttgatgagcgcgttgaagaagatggagtccgggcggaggccggcgtcctccacctcggcgagcagccacgggatggtgtcgaacgcccgctggctcgtcagcgccgcgagcagcgtggtgtacgtcaccagcgacgggcggtggccgtcgtcgacgaggtggcggaacgccgagtgcgcctggtgcggcctcctcgcgtcgatcatggcgcgcatctgccgcgtccgggcgatcaccgcctggcacgtgtgccccttgccgcacgtcgtgcagagcagcttctgcttctgcttctgcggcggcgacggcggctgctttgcttgcccgtttgatgggtgcagggcgccattgctgccagcttcgtgcttctcctgaacacacacaaagacagaaatcaatcgaggtgttcttcgttttctcaggtagacagtcacaaagatgaaacaaacgaggtgcaattataagataaaagaatactttgaggtgtgatccgtttagcacttctccattgattcttatcttgccattggtcttgacagtggaggtcaatgtgagctgcacaccgttctctaccatggtactatgcttctgtcagccagctccttaacctgaaccataatttcagaatttcagaactgtgctcattttcatcaagtccccaacatatgtactgcactaatgcagtcagtgggcaagaaacacatgcacacattcggagtgtatagatgaaattgatgttcctactcttgtctgtttttaaaaccaaaagaattgcatattcctgggaagctgttaagagcaaaatgtgatatttctctgatccatttccacagtgaaggacgcatttcataggggcatcctggattcctaacaatgaaaacatcatttacagaattttagtggtcatgataatcaacatcatcttcagatttcatggaacacgtgttgtattaacaaatccaatgaccaaagcagttgatggacaaactaccagaattaaagaaaaaaaaacaaaacagaaacaaaatcaactcaggatctgaaatacaaaaccggccttatcctgaagcctagaccaattcaaatgtagaaattccattattttcacatattatatcagcagaattattttatacaagcagaaaaacaagcagttgcagagcgtcggtcgacaagaaactgcctacgagagagacaagagaagctaattcaggacgaatcccggtagaacacgagcgagcgagagggcgcgttcacctgagaatcaacgagctactggcagcaacgagcgttcattggccaaggagagcgagctgcgctgcagctgcagctggtggccagcgtgtgcctccgtcccccccgcgctctacgcacgcacacgccgcgcgtggccagccgtcgctgtggctcgcaagcaaggcgggcggagcggcggagcgacgtggaggaacacgaggcgcaggcggcgtccgcttttttttttttttttttttgcccccggtggagctttttttgggtttcgaagtgggggggagcgctttatccgcggtgaggagcgaaacgggtggcgggggaagcgcggccgctttggcggttgccggggtgaactggaccggacgccgagggagcgtcgcgtcgcgtcgccggttgggtgaggctccggagcggccgcgtggcgcggtttgcagggaggcgtccgatcccgcgaggccccggacgtgggcgttggatcgggacgggacaccgtgtggtcgctctcctgacgcagcgttggatctgatcgagccaaagctaatactctccccgttttaaaatgtcggacatcgttgtttttttcaagtatgtgtttgatcattcgtcttatttaaaaaatttaaataattattttttttcatataatttgattcattcttaaacatactttcaagtacgcaatttttttaataaaacgaacgttcagacatgcgctaaaaaatcaacggtgtcaaatatttttttttgaaacggagggagcagctcttttcacttcaacgtgcaggcgggcgcggtataaaaacgacgcaaagctaacaaaaaatcacatggtagtgtagtaaccaatcttgtcattgtacttgtcaattggaattttattgtattacatgacatgcacgcgcgtacatacccaacaccacacttatacatccacaaatacaactcctaacatacttgtgaagtgctataaattttgactaccatttgttttaacttgcgggctcctttggattgatggtttttcaaagtacttatggaggattgaaaatctcaagaaagttttcatacgaggctctttgtaccaaaggaatatgaatgtcaaatttcctatggattgacttcttttcttctatctaaaataaaataatacctccattcaaatcgaaaataaacatgagtcatacctcatgttttattttggattaatttaattcatgccattacacacatgttatttcaaataagtatcattacaattcatctatttatatccatgtcacataaatttttaaaaattagaatcgttctgtcgtcatattttccatcttcttcctcatttatttgcaatcgcatggatcgaatacccttttattttcctctaagaagtataatgcaccctctttctttctctctagcacaaagaatttactctaatattcctatttttgtttctgtgaaccatccaaacacctactctgttagaacatggatcctatttctacatttttactggtactgtgcttttagatctcgcgtcccaaaagagttttgatcaacatatcagcctaccagtcatagccaaaatttaaattaataaacaaatttttagagttgattttatttttttttcatcgtagtttgtttttttatattgtcttttatgtcgctaaacacacacgcaaacgcttgagcgcgcacacactgtgcgcgtgcgtgcgcgcacgtgtgttttaaagtcagtaataagcgttagagtttatgaattatagttagagtgacataccatgtgtgtagtttcagagctttgagttagctggtagtattttctcttgaaggtttaaaattggagttaaaaagttactacgaagatcatagctttctttccaactaggtgaaaccctgcgcattgctgcgggaatttagtatgataataataataataataataaataacgtgtaaaatagctagataacatcagattaagtaaattaatgtggtttatgataatttaaatttaaatagtatgtagaatggtgattcaaacgtaaaaagtagggagatagtttggaccgtagattaatcatctaaaggctaaaaacaatttatgtgatatgacttaattagaggaaaaaaaagagaaagataatttggaccatagattaatcatttaagcactaactaagtgaggatgaactatataagtatataggatatcataaaacataataaagatatacattgaaacattatgtgaattatgttggatgataatttaacatgtttgtatttgaaaagctcttaaattataaaaactataaagatataacatgtttgcatgatgtttaaatgtgatgattgttagtggatgatgatgtgacatcttattaattagtgaataatgatgtgacatctttgcattttaagcttaaggagttagtgggagataactttatagtaagataggatatgagagtattggatcgtatacacttatagcttataattaaggcaatagtcataatttttggtcaagtatttttttctcttactataaaggggttcattattattttacgactgccaatcatatatatagtttatacttattcaaaacaaccgttaaaaacttttatatgctatcgcagatttacgagtacttataggactctttgactaaactttttaagatatgatggtgactattggattgcttgctgcatctcacattctataatttcctgataacatgtcctaatcaagttttgtgaaagctcagggtttttactactttagatatgatttccatatttttaagtgataaggaaaactacatcacccaaaattattggaggtacactaaattaattttcatatagaatcttgaaatgttcaatattccatccacatgtgcattaaaactgtattctttgacctgaactcttgcactcctatctcggaaaccccctaatatgactgacttgacgcacctaaaaa

SEQ ID NO: 76263 - DNA, 9984 bp, Oryza sativa
gagcttggaggtggaggataacctagcaaaggtgggattatagggcgtaggggttgtctaatcgattgatggtgtgtaggtgaatcgaaatagtatctcaaaaacttatgcaagttatcaactcctgtatgttgggaatggccggatttgtgctttgttctctggccggtgagcttccctgtaaaggactgggaatattttgggtggagaacggccgtgataacgatggtttggtgacataaatggtgcaattttgggctgatgttctcctgcttggagccctaggatctactttgcggaaccgtggtgtcgtcggggtggtttgagaacaatcgagtcgtctgctggtagggagacatgattttttttctgttgctaaaaatggcctggtatgtttggtttgtcttaggtaacagtgtcatactcaaatcctgtagctttagatgtattttctatttcagcatcgagatcagataggcggtgagcttgatttggtcactgcctctactacataggaagttcagtggttaatccctaaatagctgaccggttaatattttgatttcagtgaatgaaatattcttttggtaatcgttaaaccactgtttagatgggatcatgtatcaaagccaaccacggttctatcctatggtagcagggtcagaagtacttttctggttaccttttttggtaaacggaattgatgtggtggcagctaaagagttggttatgttgctatgaacaggaaaagttagttgaaacaagatatttattgctgttcatggtgcctttgttcagctaagagattgggaaatctaaggaattcggacatggattttgtttgaactatgggacaccttacaagtggtccaggggcactttcaaccttatattatttcttaccatcccttccaagaggtttcctcattctacaatttgaatatttgtcacttttcaggataaagataaagagttcaaaattgattggaagagggtgggcatcacaagctcatttggatttgcttttgttggaccagttggacattactggttagttccatccttttcatattgagcatgaacagatggtgttagggtcaattttgtttgtggattcctttcttatggtcataaattggcaagaagtttttggaggttttacccattaacaactgaaaatctgctagcagactttatctctcccagtcccaaccagcaacatggtgtagattaaggaaaagagaaaaataggtgacatggaagacataatctccatcctgcactgagcttttccatttaggttgtcatatctagagaatgatatgaatgttgctttatcgtattagtatcaatgggttccaactatgaaaaactgaagatagttaaatatcagatgctttgcttgaatatatctaggtccttttagttcttttaagtttcgatattcactgtggtgggtatcgaatggtgggttagattggatgcagtgggtgctatctttatagaactgctgtgcttttttttagatgaactgatgcatctttttctaacataatataagaaagccatcacactatagtcatccattatgagtgcgctgtgtgctaccagtggcttcttttactgaatcttgtgtcacgcaaggggcatacattatcttttggagttaagtagatattgatgcactctgcagctgcgcttcatgtttatgttcatttgtgtgcttaccaatccacttcaacatagacttgtttttcaccatgtcacaatttcttgccttttcatgcttaccattcattacgtatgtgtagttaaactgtaaaatattcttctcttgagagcatttcgtgattgatctgctccgctttgtggttagtgttctacattttaattgaccacaaggttttcaactgggaagattttggtatttgagaccacttaacagtgcatttctttctatagtacgccatactatacaaaacttcaaattaataacatgatcatatgcatccttttttgtgaaataagctaataattgaatataaataatacttgttgatggacttctactgccctgccctacatttttgtgtttgtttttgttatgaatggtgattctatggtttcctctcacttatttgttgcagtctactcatatgcaaaacctgggatattgtgaaatccatgcttccaacaaatatgcttttgcttaaaaatgagaatcctgttctgaagcaattttatacaacaggctggcatataacttgcgcttgtttctgtcacctaggtatgaatacttggatcgcttcatcctgaggagataccagcctaagaccttcaaatttgttgcgtcaaaagttgctgcggatggtctcctatttggaccagtagatcttctcttgttcttctcatatgttggtcttgcatcaggaaggagtgtagagcaggtgaaggatgatgtgaagagggacttcattcctgctctagttctagggggaaccatctggccagccgtgcaaatcgcaaatttccgcttcattcctgtgcgatatcagctcctttacgtgaacctgttctgcctcttagacagttgcttcttgtcgtggatcgatcaacaaggagatgcaccttggaagcaatggttcacatcattccagaaaatcgaaggccagaagggcaaggtttgatgtggatcaggcacggtccttttgacatggtcctggatccagtaacatcacccggcaaaacaccgggcatcccagaaaatttgtcttctgtcatttggatcaacctttgtatgctttggctgatccatgaaaaaaacactggaaaagagaaacacttgctgctatggtagcaattgttttaagcgcaattgcagtaccaagcagagctgagcatcaatatctgtgtagagatttgtttcatgtttaatgccaaggaaaatattgctcaagttgttctacttgtgtctgtatctctgaatgtttgtacaagcgattctgtaacttcatgtggttgaaatatgtgcttccaaagcagctgaacgcactgaattcaacaactaacatgcataaaaagtcgatgagatttaaagaagagtaggcaaaaatgctgtataaatcctctgccgctgacgctattcttctatagcataagcaaacaaaaccataatatcaataacaccaaccaatcattggctacaactctgcacggcagctaatctaatgtcaatttttttcttcataatcctttctaatcttcttcagtgtcaccacaacaccggccattgacatcctctggtcaggcaagtcacttgagcagagcaagccaacctcaaatattggcaaaagaaggtgattcaggtcttggatagaagactcatctagctgtagcttgtcgtccagaacatgaacaagcttcgccggaaatgcttgattgacccactgcctaatggtcacttctccaacgaacaaacgatccgtgggtcgctttccagtaaagacttcaaggagcatgattccgaagctgaacacgtcgctattgcgcgacgcctttccgagtgatccgtactctgctcaggaaattcagaaacaaaattttttaagaatgattgataatctaactaaagtaatctccatgatgatatattccggtcagtcaatgggtttatggaaattaaaatttactccctccatattttaatgcatgacgctgttaacttttttttatcaacgtttgatccgtcgtcgtattaaaaaaatgtaattatcacttattttattgtgacttgatttatcatcaaatgttctttaagcatgacacaagtatttttatatttgcataaaaattttgaataagacgaatgatcatacatttgttaaaaaagttaatgtcatcatacattaaaatacggatggagtattatattagtacctggtgccatgtacccaaatgttccaggcatgcttgccgtgatctttgacgtgtcatcacccagtagcaactttgcgatgccgaagtccgccacatgcgccgtcatttcctcatcaaataacacattgctaggcttcaggtcacagtgtaggacaacctcataatgctcatggtgaagatattccatcgccatcgacacatctagcatgatgtccaacctcttcaacaaccccaaagaacttgtgccttgagagtgcaggagcatgtctaagctgccattgggcatgtagtgaagcaccagtgctctgaactccatgttggagcaggtgttcagtacctttatcaggttccggtgccgagccatgcgaagcacacggcattcggcatcgaagcttctaatggccacttcttccaggtgcatatctagaacttttatcgcaaccaccaaaccgctgctcagttggcccttgaaaacttttccgaagctcccactccccaataagttgtcatcgctaaatttatcggtggcacgagcgagctcatggtaggtgactatcaaatgattcatgtcatcgcctggagtgtgacttgaatcctctttcttgttcttacttttccttctgatcattaggaaaatgcaaataaccatacagccaaatgctacggtgacaactggaagtagaaatcttaggaagtgtctactgtttgagtgagacttctgaagacatggtgaaaatcctagacgtggagcaccgcataatgcagcattcccgatcaaggactgtagcgtaatgtttgagaaaacaccaccatctggtatctggccttctagcctattgaaggacagattcaaggctgtcaagtatgtgaaatttgcaaggaattttggtatggtaccagagaggttgttggaggagaggtccaatgttgccaagttagcaagctcttgaaatgagtacggtattgagtctccaaatgagttgtgcgatagatttaggtaggtcagcatcctgatttgtccaaatgattctgggatacttccaagcaaagaattggacgataaatcaattgtatcaccttgttttagcctgctaagatcatttggtagtgcaccagtgaaggagttgtgagaaagatttagtcgcaccagtttgccaaggttgaagaagcttgcaggtattgttgagttcagttggttatgggacaacatgatgtgttctaattcactcaggttgccgatgctatctggtatggagccaaataatctgtttctctggagatccaatctctgtaagctgctgagcatgccaatctgagtcgggatagggcctgagatatcattgctagacacatctagccttacgagatttggcatcatggtgatggattctgggattggcccagtgagctggtttccaggaagttgtagctgttcaagactgctcaaatttgacagtgacgatgggagcccacctgttagcttattttcgctcgcggaaaatatactcaattgcgcagacaggttgccggtatgatcgggaagatccccggtgaaagaatttgaatccaaggtaatgatccaaatttgtcggcaattagaaagggaagacaagaagccaaggttcccctctagattattcagtgacagagtgagccagttgagagctgggatattgcctagtgttgctggcactgccccagtcaattgattcatctgcaaatctaggaaagataattgcgataaattcccaagagaagttgggattggacctgtcagctggttgtatgtgagacgcagagttgagagacttctcataaggcctaactctgaaggaatttcaccggtcaggttgcagaaggagaggtccagcgaggtaacaccggtgaggttgccgagaccaggagggatagagccagtgagctgatttccacccaagaaaagctcagtgaggtatggcagctgagccaaccatgccggcacgacatccacgaagctattcgacgaaatggacagggtttgcaggtatcggcatgccgcgagccctgccggaatccggccggcgaagccgttggagctgatggagaacgtgcgcagcatcggcaggtgaaagctcccgttgctcgtcgtcgggatccaccctgtcaggttgttgtgcgagagcaccaaccctcgcagcctcgacatgttgtagacggccggcggcaccgcgccggcgaggcggttgccgcgcaggttgaggtactcgagcatcggcagcgacgacggcgacgacgccacgccgtgcggtacgccgcccgtcaggctgttgttcccgaggttgacgaacgtcagcgagggcgtgccgttgaacagaagcggcggcaggtctccggtcagctggttcatgtgcagagcgatcctcgagaggcggcgcatgccgtgcagcaggtcgggcgggatctccccggagaggttgttgttgcccaggtgaaggagctcgagcatcgtgaggttggctatggcgggtgggatggcagccgatagcaggttgtcgccgaggaggagactccgtagccggcgtagcctgccgaggtcggcggggacggggccgacgaggctggtgttggtgaggtcgagggtgtagaggaatgagaggttaccgaggtgggcggtgagctcccctccgagcggcgcgtccggcagcgacaggccggtgacgcgctccggccggcggcggcggctgcaggagacgccgacccagttgcagaaggagacgttggtcgtccagctgccggcgaggacgccgagaggatcggcgagctgggccttgaaagccagcagcgccgcgaggtcggctgcggcgccgccgccgctgctgctgttgatggatggagatggagaagaagaggcacctgctgcaagggctgtcactgtcagcgagatgatcaacaactccgccgtgtgcaggactgctggtaaacagccttcattggctgtatcaaaccaacgcggtccatcaacgccaaccaatgattgcctacaactctgcacggcagctaatctaatgtcaatttcttttttcataatcctttctaatcttcttcagtgtcaccacaacatcggccattgacaatttgacatcctctaatataatgccaatttttttcataatcctttctaatcttcttcggtgtcaccaccacatcggccattgacatcctctggtcaggcgagtcacttgagcagagcaaaccaacctcaaatattggcaaaagaaggtgattcaggtcttcgatagaggactcatctagctgtagcttgtcgtccagaacatgaacaagcttcgccgaaaatgcttgattgacccactgcctaatggtcacttctccaacgaacaaacgatcgatccgtaggtcgctttccagtgaagacttcaaggagcatgattccgaagctgaacacgtcgctcttgcacgacgcctttccgagtgatccgtactttgctcaggagattcagaaacaaaatttttcgggtaattgtgtacttacccctactttgtattctaattatgattttactccttttttagggtgtatttttgcccttacttttctcaaacgaagcttcagtttacccctattctgttatcatcagttaacagtgtcaattcactcgtaaaaagacatgtatacccttgaacatttgtccaattcttttagaattttgatagcatttccacacaattcgcacggttgcagaactttagcacaaagattcatcacaaattcgtcgcaagtgatgagatggggaaaaaaataaaaggaaaatcaagcagcaaacgacatggcattgtttgtctttgtggacgagctgctcgccgtgcgtcgctattgccggcttgccgcaccatgctgctcgctgctcgcttgcccgtgcgttgtacaggagctgcctcgccgcagccttcgccgccgccttcccgtggcgctgcgccagattcgccgccttcccatacgctgcgccatcctgccgccaagcttccctgctcgctgcttgctggctcgctggctcactggccgacggagccgccgctcctctccgccgcgcgctggccgcggggccgccggccaccgcgcctccctacgcatgcacccgcggggccgccgcgcgctggcccgcaccgccgcttgtcgcgtgcgccgccgccgccgcttgcaacccagctagggttttggattggaaatcggaaatactacgtcccataatagttgtcactttgacttttttctttcgatgtttcaccattcgtcttatttaaaaaattagtgcaaatataaaaaatgataagtcatacttaaagtaatattgataataaagcaagtcaaaaaaataaataataattccataatattttgaataagacgaatgatcaaactttacaaacaaaaacttaaagcaacaagtattctagaacgggacggaggtagtagtaagggattgggggatttggctcttcattgaaccaagggtagcatagtcattcacaaattataataacattttctttttttgtttaattcgaaaattccggcccaccagacttctgtcaaacctagtagcagaaggctgtttcatttaaaaaaataggtgtaaaaatcacaaaccctaaaatacatgataaaatcacaattgaatcgtaaagcaagggcagaaacacaattaccccaaattttttatgcatgattgataatctaacaaaagtaatatccatgatgatatattccagtcagtcaatttgtttatggaaattaaaatgtattatgttagtacctggtgggcatgcttgccgtgattggtgatcttggaggtgtcatcacccagcagcagctttgcgatgccaaagtccgccacatgcaccgtcgtttcctcgtcaaatagcacattactaggcttctggtcacagtgctggacaatctcataatgctcatggtgaagatactccatcgccatcgacacatctagcatgatgtctgacctttataagagcaggtttaatagtatagccggcaaccggctataaaagatctaactcagcaaaaattatatccaatactaacaaatagttagctagtactaaattattatacacgggtttctaaaaattatttatactccttagagcacccgcaatggtaaagtaaggtgctatctataaaacatgtacatctcagcaataaatagtaaaccatctcaatagtatgtctacatgggtatctatagctctctaatatattgcctcatttttctctatagactatctccaggttagtagatagctttgctctctcttctttaatctctttcaagtagaaaaatatgctgacatggatcttttatagagagcctatagataaccattgtgggtaccttacagtacttcccacctctcacaatatctattctctgtctcatcgaggcaattgggaagcgtgcaaatggtgggaaaagcttacagttgcagcatgcatggatgacgattggtcatgctgctttttactatcgctgtagccgggtgatagattaagtgctggttactctctctcctattttcttactcttccatctaggatttatcttagatgaatagtactaccgcccgctgattatatctactatatttgctctaacaaccccaaataacttgtgccttgagagtgtaggagcttgtctaagctgccattgagcatgtactggagcaccaatgctctgaactatatgttggaacaagtgtttagtacctttatcaggttccggtgtttagtatctattttccgtttagatgtagagaccgatttaatctattaaaaagaattgcgaggaatcatggcacggctcgccgggaaaaaaaacccttctatatgacaggggtagctttttcatcccaagggagattccactggtggagaaatgctttttagtcccggttcgtaacccccttgtagtcccggttttccaaccgggactacgaatccgggactaaagatcgttatctttagtcccggttaaa

SEQ ID NO: 76264 - DNA, 602 bp, Oryza sativa
tcacagtacagacagggaaacaaagaaagcaactagcacgttaaaagagtcatgctatgaattcagaaagtcgaacattgactcttaaaactctttgggccatcagataggccttttagatagatctatttggtctatatttttcctttactaaaaaggccacctgattttcattccgcgagctttgctgaaaaattcttcgattgcgctcaagccgaacgttccactaacttgatggttcccgaggatcttcttcttcatggtccctgacgaaatgtggcaatcccaatagggaacttagttgatggccttctgggtgatgacgaacctaagaagcctaggagatgaaataactcaattttatagatgtttcgtaattaaaaaaatcaacgtaaaatggtgagggaagaacctacacgaggtgaccatcgtacaaagatccaatgttgacggtgaccagttacatgtactctctcccaaaaatctcatatatcattctttggtttttccaaaaatctaagtcctatttgtagtcactttgtgctaaataaaattgttaatcggaaaccaagaagtcattctaatacttattggttgcatgt

SEQ ID NO: 76265 - DNA, 4160 bp, Oryza sativa
gtttttgcacaagtatgaataggtcggatgagtgaaggctaccaatcactaccaactctagttctctcattgtctgcttttgggctatcaatggcaaataaaatttaacttttgaagcttaattggagttgattttgaggttttcaacggaagaaaaaattatgcaagagatcacatggatgcaaaagtctggactacagcgtgaaaacaggcttccaacagcaaagttttacctggtggagcagactgattactgaatctctttaaaagcacaatctccttcacgatgcgaataggccaaatacaagcacaagaattagtcatgccgaattaaaggctgtcgagtaatgcattgggttaaacttctatcctgagaattttcaagctaccgatgattgctttgaatatcatacatacacgacagctttattacttccgcatcatccaactaaactctccagcaaactgactgagtataaacacctgtaatgtactaatgtaaggagaaagtcctcttcgggacgtactagtagaacgattttcacgaggatcacttcaattcctgtaggcataaacaaaaattccagcattccaaactgcgccaactttctgcaaaaacttttttctcgaatttgccaaccaagtcatcgggcattgccttgatgggacgactcaggtggcaattttcgggcctgaaatgtcaggcacatggagcgagaagatacaagcagccgatgtgcctcgaaccactccttggctctttgccacatgaatcaaatgctgaaaatattagtatgcgaatttcatatagcagtagaacataaaagaaatatgacaaaatacattgaaaactaaaaaaattaactgtgctgagggaggcaaaactaaatgtcatttaatgtaaaccatcgttagggttgtactatacacagctttagtttcaggaggtaactgtttttactgtggcaaagggctctatagctatatgcagaacatatgtaaactttagcaaggactctgggtcaatgcatgtgactttaatcttcactggtccacgtagtagttcataacagaattaagaaaatcgatatttttttagtacaccacagtttttttcccctcatatctctgcctcatactaatccacaagttaaataaaacctggttatgctatgcctgaaggcttcccccccatagtcaagactcaaaaccacaaaccttatttactggtggattgtagaaggccaaagattatgtagaactaacatctaaacatttcttaatctgtttaacctgaactataaagaagacatcatgcaaagttgcatattcattgcatataaagccagaaatgggtggacatatttagaaaaaaggcaataacatacctactgttctgcggccttttcaccaaccacagaagaagatgggctccattttctatcaaaaggcccatagcttctctccacaatagtttgccgctcggttagtttcttatctattagctccagtaactcttgcaatcctgtccctgtcactgcagaagttttcacatgacaagtggacattggttgtgttgaactgcagctatctgtactaatagtttctggaccacaaagctctccaaaacaatcttttgatgatgatgatactgagttcattgctctcatctcactaggctcaagtgaggatgatatttcaccattgttgccttccaaattttcctctgataaatattcggagtctgttccatcatccaaggactcaaatgatgattcttctgcaggcacatcgttttcagaaaataattcttcctccttatcctcctcaccttcggtcaggaaaatctcatcttcaatatcatcagttacatcattatcattgttgtccacaatatcaatctgaagaaacaccataaaaaagtcaagttacatgaaaacccatgctaccaacaattcaccatgcaagtgtgacagtcacagccaaattaaatttcactactaaccttattccaaacttcgatcatactgttgattttatcctgtgaaacaccaatctgttgcaatacttgcagaacagtagaacgatgttcctcgatattaggagcactagaatctaatacatgctgcaccaatgcaaataaagagacatacaatcaactctatttctcttttttttattaagtaatttatcttaaaacaatttctgaaaagaaaatgtacatggctgaagaactatttgttattaaactagcaatggaaagattttagaagctgtcggagatatgggccgggggtatgcaaagtgaggggaagttaccttcccatccagccacgtggctctacagtctggccctaccccgcacctcgcgagtcgcagaagcggccggggcgcctcggggcgccacgtcatgcccctcgggctctcgcgttgccttgccccgaggccctcccccggctgccatgtggcgggggagcgagaggggaggaaacccaggctgaacagccatcaatgcgcggcgccccaactgtccctcactgcgtttaatgtggtaaggacggacgtgcggtgccgcaccactgacccacgtcaatcgggtctgaccagtctgtgatcggcctgtcgccggtcacgttcgactgaatgggcggccgtgcccccacgtcgcctctgtatccggcggagtggaggtaggtatgtcccgtcccatcgaaaagtcattcggagttccctccgtgagaggaggaccgccacaagtcttcactcatttatgagggaatgacagggctgtcccccgtgtcaggctggggggggacgttgggtcccgctcaaggacggactgctgcttagcttccgggcgaaggtacgggtcgcagtccggtcaaggtagtgggtccccctcccgtagaagagtaggcagaggcggtgcatgcggtatccccttaaactatacaaggatgaccttgcccaccgagaaaagggacgactctcagtaagcctgaactctaggagaagagaagtgggagcgctctccggagtttaggaacccttgtaacactccataatctcacacacaggagtagggtattacgctccatagcggcccgaacctatataatcttagtgcccacacgcgttttagtagcattgagggcggattcacgatctccccacgcgagccttttcccccggccgaactcactaaagggggatctcacgatctcccgctagagaggatcactcctcgacagctggcgcgccaggtagaaggaattcgcgcgcttcaaagggaagtcgtttccttccgccccaagttctcctctaccttcgacgatcatggtcgaggtcttggaggaagaggtggtggtgcacacccccattccctccgggagtgaggatgctagcgggagtcgcggcccccgtcaccgtcgccgcaactggcgaactccgccccgtcgcgaccccccgcggagggaggatcccacccggtcgggtggctcggccctctccccgcctcccggcggggggaggccacggcgcgtcggagcacgtcgccgcctgacatacggcgacggtgactcgccccgaggcgcgcttcaggcggcgggagcccttctacggcatcctccggtgaacgcggagcatcctcaggttggtgacgtcgccaacctggtcaccactgcccagcgacagctgaccgcgggtggccgttccaccgccactggtacgtcacgtacccccaccaccctctcctcatcagcaaggaggagggcccgtcggtcggccacggccttgaggcgatccacggccccaacgtcgtcgggggcctcgggaagtcggaggcatcacgatgacctctacgaggagcaggacgctcgaatcaacatcgagcaacaccgggacgagcgccgcgctgcccgcatgggagaaggcgcctcctcgtctggagtgccgcgttcctcctcgcgaggcggcccgccccccacgttcacccctggagggactgcttgtagggccttcgttgtgagtctccggaatgtccggtgacccccgaagttttgccccaacctcacggagaagtatgatggcagcatcaatccctccgagttcctccagatctataccacgatcatcgtggcggcggggggggggggggggag

SEQ ID NO: 76266 - DNA, 9267 bp, Oryza sativa
acacatcatctggatcatattgaatcccagtttataaaattatgtggattaaaataatggcattatcgcttaatttaaattcccgcgttatcactgttttatttagccatgcctatttacctttgttatgaccatattattattgttattgttattattattaccttgttcaccctagacaaacaaaacctcaactagtgggcactctactcatagtaccactaggataattttaggtagatgcttcgcaatttaattaggtaacattaggtggttttacaactatagactttgggaaatattcatatcacctggatactttggaatggttggctattgtggaattggtttcacaccgctccttcctttcaaaacccctaaaatggttttgggctgggctaggggtgcatggttttgatggtagcacctcggccgtataaggaccggtcttcgggcctctgttgcaaagcactaccgtactttcacatgtctagtgggtaaggcttagtttgtggctcagtctagtcataaacaaaagtacacggattggagatggatgaagtcgggggtcgatggacattctccagggcaaatgaaggctacacgagctgcgggcccgtagtcaagatgtcattgcagagggttggtgccctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagttagtgttttaatccttaaaacctgcttatcaactaaaatgtggaatggttggcctgggttggcttgggacgagctgggacccagggtcgggttgccagttcggtctgaatcatcataggccttgggttaaggcaggttcgtgtgggttcacggccttgattaataacattgtatagttctaggatcgcgtttgcaaaatagctttgtgcaactaaattttctttaaatgctgattactgcaaccctaaccctttatagtataattcccttgtactcccttgcatttattctgcatttgtgggtgtgtcttgttgagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttcccgtttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaactcccgttgggttatttccggtcgtggcaaggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctatcacggcctctttccgatatgtcgtggtggcatgtcggcgcacggaaacgtgttgtgcggctgtgtcttgtgggtacagttgtacacctctgatcagagtaaaactattcgaatagccgtgcccgcggttatgggcggtcaaccagattcaccgtgattagtctcaccttagtgtaatcttttaatttggatagtttaggtggatggttgggcctgtcgcaacgtgggttagcgttggacagtggatgtttaatattaattaattgttacaacggtttaatctttcaatctctgtttataaatgctcgctttatgcaaatgaaccactttagctcttctttgataactccctgcatcatacccctattccggtatgacttgctgagtacagtgggtagtactcagccttgctctatttccccccgatcccagagctcgagtatgtgtccgatggcgggttctccgaggagtaggcttcgtccgtgccgtcgaggatgcctgtggagtggtgttcccgctgcagttcaagtcaaggcttagctccagttttcttttgttttccgctgcatttctgtaagacttttatgatgtttgtaagacgtggatctgaatgtcaacatagtcgtttgtgtaccccggccggtcctggacgggggttttaatgcacattctgcttggaatcctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaggggaaaaatcttggtcgctcgtttaaagtgagatttttcaaaacgagtcagtctagggttttagtaaagctattgggattcattcgttagtcagttgggatttgatgggtgaaatgcattaggtcctagctcaggaatttgggttgcaaggtatttatgctttatttgttattattagtatgtatctaatttctcattattttatcgttatgtgagtctgtcttatttattcgctctcatgcaaaatgatctatgcataaaatttcgctcttattcgattcccttatttgagtcttttattgctttatttacatttggatttgagcatgcattgatcctactcctttgtattctctagatggccggtcacccacccaaccaccgtggagaaggcatgattgacttcgtggcagagttggcacgcatgacactggtggtgggctaccccaatgcgccagaatacacgacgattcccccgctcagtggcgaacttcctcaccgtgtccgcttggaggtccacggctacgtggggacttgcctcgctaatatggcggttgaggcgtcaggaggcacagcggatcacgcttgtcaggaggcagcctacttgatgatggccagactgcgggagcgccacaactacatcttccacgacacggcgtaccgcttccaccctcgtcgagcccacggtgacgacgtcagttccttccgtccgacagctggcgagaacgacaccacctttggtcacatgtgtactgtgatgaggggattggacaggatgcactcggacctgcacaaggcgaccaaggccttgaatgatgggaagctcatgaggatcgtcgctctgaaggatgagatagcgcgcctgaagaaggagaatgctcagttgaagggtcttccagcaccaggaggagtccggatccgcactacgcctcgtaagaggacgactgcacccgtgcgcatccagctcgcgcccaggaacccagttccgaccgcagctcctgcagcacctccagttccgcccgcagctccggcagttcctgcagctccagctccagctcccgcgttcgatctctccttcgccctagcatcagccgccaggggtccagccagtggtaccggaggttggttgtctgctactcccagtggcagccgcgaccgcagcagcagcagctccaggggctgagagtcgggcagcggcgagacttatctgccaggctccaggagtcgttcagagggacctggtgatgagcaggaggacgccttcgactccaccgaccgcaggagccgttccgagcattaggctcgttttccattagtttaccgactgtctagcttctgcttgttagtttgtgtgtttaggttgcttgtttggggtcagtcgacggtcgatatcatgtgcctatgatatggctgtcttaataaggatttttgtttgctcttttaagtgttttaattcagatcagaacaattgcagttttaattcctttgtaataaagcttagttcctgagcatctgtttttcttcttttccccgtctgcttttccctccagatggtctacaccaggactggcaaccgcacgacaggcgagggcagcaacggcgaagaacgcgttgatggtgtgcaccccaacagcgattccggcaatggtccgccaccacttcccgagaatccgacccttgcccaagttatggcacatcagactcagatgatggcagccatgatgcagcagatgcagcagcagcaccagcagatgcaccaaaggatgatgcagcacgccgaacagcagcaccagcagtttggtccccctccccctcagtccaagttgccagagtttctacgcgtcaggccacccaccttctccagcaccaccaaccctatggaggcgaacgactggctccatgcaatagagaagaagctgaatctcctgtagtgcaatgatcaggagaaggtcgcttttgccacacaccagcttcagggtcccgcgtcagcttggtgggacaaccacatggccacccgcccaccgggtactgaagtcacatgggcagagttctgccgtagcttcaggaaggcacaggtgccagatggggtcgtggcacaaaagaagagggaatttcgtgcactccaccagggcaacaggactgtgacagagtacctccacgagttcaatcgcctcgcgcgatatgcaccagaggatgtccgcaccgatgccgagaagcaggagaagttcatggcgggtctggatgatgagctgaccaaccaactgatatccggggattacgctgactttgagaggctggttgacaaggcaattcgtcaggaggaccaacgcaacaagatggacaggaagaggaaggccgcacagttcagggcacctcagggaagtcaccagaggccgcgcttcactcccggacagcagggtggacctaccaccatgatcgtccgtcagcaccgcccgttcaactccagcaactttcaccagggctctagtggcagtcagaaccaccatggaggtcagcccaaccgcggtgcagctccacgcccaccaatggcaccggcacagtcaggcccgcccgcgcaagccaagaaggagactggagcaaaaccagggtcctgcttcaactgtggcgagcttggccacttcgccgacaaatgcccgaagcccaggcgtgccgggccaaggtttatccaggctcgtgtcaaccacgcatctgcagaggaggcacaaacagcaccggaggtcgtactgggtacgttccctgttaactcaatccctgcaacagtactttttgattctggtgcaacgcattctttcatttcaaagaaatttgtggggaggtatgggttaaggaaagaagagcttagcacaccaatgagagttcataccccgagaaatagttcaacctcagtcagttttagcccttcagtgctaatagaaatccaaagatcaccatttctagccaacctcattcttctcgaatccaaagacctagatgtcattcttgggatggattggctgaccaagtttaagggggtcattgattgtgcgaatcgcacagtcaccttgaccaacgagaagggagaaaccgtggtgtacaaatcaccagactcaccaaagcaaggagtctccttgaatcagattgaagcggaaatcccagtggacaccgtggagaagaacttgagaaaattggaagatatacccatagtctgcgagtatccggaagtgttccccgaagacctcactaccatgccacccaagagagagattgaattccggattgacttggcaccgggaactgctccaatctataagagaccgtacagaatggcggccaacgaattagcagaggtcaagaagcaagttgatgagcagctgcagaaagggtacattcgaccaagcacttcaccttggggcgctccggtcatttttgtggagaaaaaggataagacgaagaggatgtgcgtcgattatcgcgcacttaacgaggtcacaatcaagaataaatatcctttaccgcggatcgatgatttgtttgatcaactgaaaggagctagagtgttttctaagatagacctgcgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttattgtggtgttcatcgacgacattcttatctattcaaagtctgaagaagaacatgaacaacatctccgtctagtactcgagaagttgaaggagcaccagctatacgccaagttcagcaagtgtgacttctggttgacggaagtcaaatttctgggccatgtcattacagctcagggtgtggcagttgatccatcgaacgtggagtcagttaccaaatggaccccaccgaagaccgtgtcgcagattcggagttttcttggacttgcgggttattaccgtcgattcatcgaaaatttctccagaatcgcccgacccatgactcagttgcttaagaaagatgagaagtttaaatggacagccgagtgcgataagagcttcgaggagctcaagaagaaattagtatccgcaccagttttgattctgcccgacccgacgaaagacttccaagtctattgtgatgcatcccgtcacggacttggatgcgtcctaatgcaagagggcagagtggttgcgtatgcctcgcggcagttgcgtccacacgaagggaattatccaactcatgacttggaattggcagcagtggttcatgctttgaagatctggaggcactatctgattggcaaccgctgcgaagtatatacggaccataagagtctgaaatacattttcacccaaccggatctaaatcttcgacaacgaagatggttgtaactaatcaaagactatgacatgagcattcactaccacccgggaaaggccaatgtagtggcagacgcattaagccggaaaagttactgcactgccctatgcaccgagggcatgtgtgaggaattgcggcaggagtttgagcatctcaacgtgggtattgttgaacacgggttcgtagccgctctggaagcacggcctacgctcgtggatcaagtcagagcagctcaagtaaatgattctgaaatagtagagctgaaaaagaatatgagagtcggaaaagcccgggatttccacgaggatgaacacggcacaatcaggatgggagaaagattgtgtgtacccgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcgtcgcactctgcgatgtttgccagcgagtgaaggcagagcaccaaagaccagcaggtttactccaacctcttcaaatcccggaatggaaatgggaggagattggaatggactttataacgggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtatccaaccgaggtagtcagttcacctcaaagttttggcagatactgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttaccatatgcggaattctcgtacaacaacagctaccaggccagtctacagatggcaccgtttgaagctttatacggccggaagtgccgcacacctctcttctgggatcagacaggcgaacgtcaactgttcggaatagaagtattagcggaagcagaacagaaagtcagaatcatcagggaaagattgaggattgctcagtctcgacagaagagctacgcggataaccgtcgaagggagctcacttttgaggcaggagattacgtgtatcttcgtgtcactccgctccgaggagtacaccgttttcagacgaaaggcaagctggcaccacgcttcgtgggaccatacaaaattttggaacgaaggggagaagttgcttatcagctagaacttccatccaacatgatcggcatccatgacgtgttccatgtgtcccaattaaagaaatgcttaagggtacctgaagaacaggctgattcggaacacattgatatccaagaggacctaacatatgtggagaagccggttcgtatacttgataccagtgaaaggagaaccagaaacaaggtcaccaggttttgctgagtgcagtggagtcaccattcagaagaggaagcaacctgggaaagggaagatgatttgaaagccgcccatccgcacctcttcaccagctcctccgaatctcagggccgagcttccgtttaaggggggtaggtttgtcacaccccgaagttttccccccaagccaaaattgtaatttataaatgaccccaagaaaatgcaggtgaaatcaggagaaaaccctaagaaagtaatgcaaataataatcggatttgacatgtggaatttttcttgagttctatatgtcgaaattcattaacaggatttttagtagaattttcagagctctagaaataattttaaccaattaaaattgagcaagcaatatttttaattccagggaaaatcctttttctttttctttttctttttcctctctttttcctttttttttcgaatgggccgccggcccattccctcctttctttctccccctccctgctgggccggccgcaggccgaggcccagccaggccgccccgctgcgtcctctctcggggtcgccgacaggtggggcccaccagtcgggcccgtctccctcctccagccctggttaatattgcgcaataaatgatttaaggttttttcttttatagtaataaacacagtgaatcttctaaaaatcataactaattcatccgagctccgtttaatcccattcatgtctcagtaaatcaagaaaaatgtgtagaatccattaaaaatggttttgtt

SEQ ID NO: 76267 - DNA, 21591 bp, Oryza sativa
cgtttatacgtttcggaacggcgtgcggcacaatcgcatgctagagaagatcgcctccaaggagcccaagaccaccgccgagctcttcaagctggcggacaaggtggctcggaaggaggaggcgtgggcctggaactcccctagcaccggcgcggcagctgcggctgcccccgaatccgttacccgctctaagcggcgagatacgaggggcaaaaggaagccagcccgctccgacgacgagggccacgtccttgcggccgatgggccctcacgggccccgcgcaaggaaaaagccaccggcgataagccgagctccaccgctccctccggagagggtcggtcggcagacaagtggtgctcggtgcacaacacttatcagcacagcctcgccgactgccgctcggtcaagaacttggtcgagcggtttcggaaagccgatgagaagcggcagaatcgacgggagggcaaagcccccgcgacccccgccaatgactggcgaggggaggccaagaagaaggcccccgccgatgacggcgatgatagcgaggatctggaattccagatacctcagggaaccgtcgccactctcgacagggaggcttgcgctcacacctcccgccgcggtttcaaggtcacgaggtgtgagcttctggccgccgtcccaactcacaaggcggcacggaaggcgcgctggtcggaggtgaagctcaccttcgaccagagcgaccatccaacaatgctcgctcggggagggaagttggccctcgtggtctccccaaccatccacaacgtcaagatgaagcgtgtcctggttgacggggaggctagcctgagcatcatctccccggctgcttttgacgcgctcaaagccccggggatgaagctccagccgtcactgccgatcatcggcgtgacctcgggacacgtggcctctgggtcacgtttagctcccggtgaccttcggcgactccaccaacttctgtaccgagcggattgacttcgatgtggcggacctcaatctgccctacaacgtggtcctgggcaggcccgcgttggtgaagttcatggccgccacccactacgcctacctccagatgaagatgccgggccccagcggccccatcaccgtctttggcgatgtcaaggtcgccctcgcctgcgcagagtagcgtgccgacaacctggcggcagccacggagccgcaggtcccgaaggcctccacgtcccgcgcctccaagaagcgcctcgcctcggccgacgaggtgcccgtcaaggagattccccttggcgatgatccatccaagaccgccaagattaacggtaccttggacgccaaataggaaagcgcgctcgtctccttcctgcgggcgaactccgacgtctttgcgtggaagccgtcggatatgcccggggtccctagggaggtgatcgagcaccgcctcgccgtgcggccggatgcgcgacccatccggcagaaagtacggcgccaagccccggagcggcaagccttcatccgagaggaggtgacgtggctcctggaggccggcttcatccgagaagtcatccacccagagtggttggcaaatccagtggtcgtcccgaaggccaacggcaagctccggatgtgcatcgactgcacggacctcaacaaggcatgccctaaggatcccttccctttaccgcgcatagatcagatagtcgactccactgcggggtgcgaccttttgtcgttcttagatgcctactccgggtatcaccagatccgcatggctagggaagatgaggaaaaaactgctttcaatactcctgtagaaacctttattatacaactatgccttttggtctcaagaacgcaggtcctacttttcagcgcatgactcgcattactttgagtaatcaaatagggcgcaataggcgcaatgtagaggcgtatgtcgatgacctggtggtaaagacacgccaccaggacacgttgttgcaggatggctgagactttcgacagtcttaggtccacgcgcatgaaactgaaccccgaaaagtgtgttcagtgtgccggcgggcaaactcggttttctagtctcctcccgaggcataacccccgcacatccttcggcttgtgcaggcttggccgagggctaccactgttaattatgttgtatcttttcccttccccagcaataaatttttccgctcaagcggaggctattgcgcgccctttcttactccttcctatggctcgtcctgcttcaaaggatgattcgcgcttatcccggaccctaagtggcgttgggcgacctgaaaaccgccgaaagggagcctaaacgcgggccgcgccccgggctgcggcgaaccctgggggctcggaagggcctacacacggccatccccgacccccggtcgtcgtagcctcggtctggccagacctgctaggcagctccctcggggcgacggcattgcccctcgccacctaggtgccacgggccgagcgtgagtttcccttttcaccggaacaagcccgaggagggacataaagagggtaagaacggcaacttaatcataagaaagtcaattgaatacgttcgctttggtttcttcttctttctttgccgcagacattcaaaggagaaagcaagaatgtaaaggcgcgaaggagaagctttgtttacaaacagtatggcacgatgacctaaagtttgaagcgttcaccgcgagcacataacaaaataaaagaagaaaagcggggatagtcacggagtgcccgggaccccgagtccggcgccgctgaccacctcgtcccagtcctcgccgccgtcatcgccaccactgtcctcgctcccctcccctcgtctgaagcaagcgcaaggttgaaccgaggggccgacccctcgaagctggagacgatcgcgtcggccgcctcctggacttgctcccgagccctcgcctcggtccccggggggaagtcctcgagcgcgcgccacaggacgaagtcggggtcgcgagcttgatgacttgcgaggaccagttccaccgcagcccgcgccaaagaagccgacaacgacttcacgacctcgccgacctcctcctccagcctctccaaatccgcagccatcccgtccagccggagcgcgagtgccggctgtgtgggcgggagcttcctgtcccgacgcacggagatgcctacccggcgccccgcgcactccagccgttcgacggcgtcggagagttggccaggtccgatctcgttggtgaggcggagggccgcaatctctccagcttggtcctgcaccaggagccgcaggtcggcgagggtgctttgaaccgcggtgagttggctcatcaactccgcgccgccgggctgcccgcctgccgccagctccttctcccaggcctccagctcggaagccctcgccgccatcgccgcgcgctcagcgcgggcaccttctaaatgccgggcctcgcgcccggcaacggcctcctcgcgtttcgcgagttgctcgcccagccgacgcgccgccacctcgcggcgattcacctcggcctcgcgtgcggcaagcgcggtgtcccgttctcggcacgcctcctcccgaagccgcaaccccttcgcgcgatgagccaccgaagcctctgcggcaagggtggtctggttgcgctcggctgcggcctcctggcggaggcgaagggaggactccgcctcggccgccgttctctcgggcggccaaagtggtctcgcgctggtctagcatgcgcgcccgctcctccagcacccgagcatgctcctccagctcccgggctcactgcgcctgttcccgactgcgcccgtcctgttcgcactggttacggtcgaggacctcaatccgtcgatggatcgtggcctcgaactcctgcgcggagcgggcgcactcgtctaaggccttgcgattggcctcgagcgccgccaaccgagcccgcagcgaggcgtcgacctccgacgcccgccgctcttaggcagcagccgcgtcgaggactccgcgggcgtcttcgaccctcttcgccagatcctcggcgtgggcctcgtactgcaagcgaatgtcgcccagcgcctcatccagtacgctcgaagagataagcaccgcctgccgctcctcctccgtctcccgcataaccgagtccagcgtctcttcgcgcgcctagttctccgccagttgggcttggcgcattttgcgccccacctccaccatgtcgtccacggcgcggcgcccctcatcgactcgcgcgcggtccgccgcgagctgcgcccactccacctccagggccgcctgctcgtccgctagggcttgaacttgggcattgagcccctccaggacggtggagtcggcagcggcgagcacctgcaggagtggctccatgctcacgggagtcggagaagaaaaagacggtccgcccccgagatgacggagtgctgctggaccccccgcgagactgggggctgctctcggcccctcttccgcgcggccagccccgaggacgccccaaatgcagaggggaacggttgcccccgtcaccccccgcctcggcccctcgggcagactcggcctcggcctcgagttcgggcccgcccccggcctcagcctccaggccgtgccccgcctcggcccccggagcgtgttccacctcggactccgagccacgacctgctttggcctccgcccccgagtggcgctcctcgtaggtcgcgccctcgggatcgcccccggggggacgccgtcgccgttgctatcacccgcggatggttgcacctcggctgtggcgggctcggaaccagacccggcgtgtggcccgggggccccaccagggtactgcgaaggccccgtgacaccgggttggccgggtcccggtcgatcccaccgctcggattttgacccctacaagggatcggacgccgagaccccctgggaaggaatcccgctacaggagaaccccaatcacgttaaaaaaaaaagaagaggaaggaacaggaggccgagatggatagagagcaccgagtcggatgctggcgatcattcctgcgaggagggcgtttgaaggtccacttccggggctcgatgaagctcccccggcacggctccgtttgccctatcttccggagccgcttcttccgtccagcctcggacgcggcggggcgtttgtggcccgccggtggtcggtccgccgttcgctcggcgccccctccacgcgggggagaaggcagccgagattcgaacgccttccgcttccctttcgggtcgccggccgagtcccccccgggtccatggctcggaccgggcgcccaggagccgacgcccccgccggagccgccggcccggctgccgcctacggtcgcgccgctgctacccgcgccgtcgccgccaccaccggcgccgctccggcgggaccgacccctgccagcaccgactgccgacatcacagccaggatactctcccggtcgcggtcgctgcagagggggaggatcccgtccggaatcagcgtttgcttgatagtgtccaggcccagcactcgccggatcaccgtcttcgcgtcctcctcgccccagtcccagcgctcacccacgtgggtgcgcatgggatcgttgtgcccagtatactcccacgcgccgcgggaccgctcctggagaggcgcgatgcgacggcggtagtcgccgaacaccatcgcccccgttaagccttagcttcgcaggcccctgaggcgatcccgcacggcgtcgtactcctcgcccagttccgaaactgccaaccacgcggcggatcgttcaggagggccgacggggagccgaagtcgcggatgatccggtagcgcggtgtagaaccaatccttcttccaatcctcccacttcttgcagaggtggctctcgatgtactaccccgccattcccggccggggctggaggtagcatcctcccaccgccgcgccttgctgcagctgcgggatgaagaaggactggaacagccgcatcgtcggccgcaccccgacaaacatctcgcacaagtgcgcgaagatgaccagcgtcatcacggcgttgggtgcgagatgcaaggcttgaatctcgtagaaatccaaaacctcatggaagaacctggaaaatggcgggatcaaccccaccatggcgaaggacaggaggtgcacggatcgctctggataccacggccgcggccgtgactcccccaccctcacggcggcgtcctccggcatgatcttgcggacgaggctaagatgcatctctgccgtgatgcgcgacgccgggagcacagcgtcaccagcgtcatgggccatggtgaccggcggggaaacgacgaggagcttggtgtacagaatggcgtggagcgagagaagcgatggggcttgaagaacgagtgagcgggcgagcagtcggcgagaagaaggggacgaactcgcccccttatccttttatccccgcctcgcccgcgctcgtctcctcgtttcacgcccccgcggttgtctcctcgattcatgcgcctcatcgtttctcgcgtccactcatcacgtcgcccactgaatccgcgccccgcgttcagtgaacctgtcagcggcacactcagcgcggggcgtgcgatgttcgtgggcgcggattaggcgggcccgccgtcggtcccgtcgcgtgcctggcaggcgagggagtcgaggcggcgtggctgacgattctgggcgtggtctggtcgaccccccgattttcgcgccttaggcgcccccatcatcagcgcggttaatggcggtcaaatcgccattatggctaatgcgccagcctggccgcgcggcggcaaccgtcaggattccccgtcgggcccacaacctcggcacgggaagacgtgaggcgccacgtcagactgccctcacaaggccgatgtccgacgtggtgccgggggctactgtcggagatatgggcccgggggtatgcaaagtgaggggaagttaccttcccatccagccacatggctctacagcctggccctacccccgcacctcgtgagtcgcaggtcgcagaagcggctggggggcctcggggtgccacgtcatgcccctcgagctctcgcgttgccttgccccgaggccctcccccagctgctatgtggcggggggagcgaggggaggaagcccaggctgaacagccatcaatgcgcggcaccccaactatccctcaccgcgtttaatgcggtaaggacggacgtgcggtgccgcaccactgatccacgtcaatcgggtctgactagtctgtgaccggcctgtcgccggtcacgttcgactgaacgggcggcagtgcccccacgtcgcctctgtatccggcgaagtggaggtaggtatgtcccgtcccatcgaaacgtcattcggagttccctccgtgagaggaggatcgccacaagtcttcacccatttatgagggaatgacagggctgtcccccgtgtcaggcggggggggtgcgttgggtcccgctcaaggacggactgctgcttagcttccgggcgaaggcacaggtcgcagtccggtcaaggtagagtgggtccccctctcgtagaagagtaggtagaggcggtgcatgcggtatccccttgaactatagaaggaggaccttgcccaccgagaaaaggagcgactctcagtaagcctgaactctaggagaagagaagtgggagcgctctccggagtttaggaacccttgtaacactcagccataatctcacacacaggagtagggtatcgcgctccatagcagcccgaacctgtataatcttagtgcccacacgcgttttagtagcattgagggcggattcgcgatctccccacgcgagccttttcccccggccgaactcactaaaggggatctcacgatctcccgctagagaggatcactcctcgacagaagccatcttcaacctatgaatgccaataaaaaatgaattggagataagttaattatacataccactaacatatctgcttcaacaacttcttccaaagtagcatgaaatgcttccactagctgcacaagaaaggttactatattattactgtcaccacagtagttgaaaaaggctttcatgcatcattaaggttcccctggaggcctagaccaaagtggcatgatagtgctgtgattggcagcaacaccacaagggcagggagagatagagtaaggaatttcaggtcactcttgcttagcacttcatgagctaagacctcatgttaaaaagagcattcctaagataattcaatctaagagataagataatagagaaactaggaagtaatgaatatgtgaacttcaaaccacatacttgcaactaacttgcagtgccagctcttttctctcttttactatcaactctgcacagttctaacctagtagcacaatgtaatacaagcctctctgcagcattttcttaaaaaaatgtattaaccaaatctttatagtaaggtgaatgttggggtttagcagaggtcggcataacagatggtttcgctttaaatcgtgccagcagtgctgttggcagagtacaaaactatgcaaaataaactaataacttgtatgcaaaatggtagacgctaaatccacgattgtgtcaaaacaatctgcaaggtcaaaattaaatcaagaaagctacctgcacaggcaagtctgagatgaagccaacagtatcgctaagaagtgcttttctcctgaatagcatttgacaaaaaaaaaagattatatactgaacatgcactaatcacaaatcaaatctactgacatacaatagatgaatgaaaaatctattaaggtaccctgatgggaggatcacactgcgtaagcggggatccactgtagcaaatagcctgcatggaaacagtaaaatgatttggctacacagtgcacatttaaaatagtaagctatacagggaaaagttctcatcatacctgtcatcactgtatagatcagtttcagaaagtgcactcactagagtggattttccctgtaaaagatagcatcaaaggaaggagtttgtagaaagctcagatatatttcgctgtatttctggaagagcatagaaaatggttgtccaatattaagggagagaactgcaatggcagatcaacgtactgcattagtgtagccaacaacagcaacagttacaagctcttgaccaaatgagttgccatgccgttttcgatttgagcgttgtatcgctctagttcgacgtacatcttcaatttgagctaacaatctgacacggcattcctggattctacacgagatgcagtaaaaggaaaaacgatgagaaatttctgataaaaatcaggttcaaacaagattctatcaatcaactgttaggcacctcctccgctgtagttgaagttctgtttcaccagcaccacttatgaagccacgtcccccacttcctctcctaaaagccacaacagtgaattagtcaagatcaggacactagacacaataagaaataagatttcaacaaaaatgtgtttaagatggccacaaattcttagcaactacaacatcagcacagtgatgacaaaaggaaatgtatgtcaacttccttttttatactagcttcaattatttccatgcacatttaaaactgtgtatagtaaatacaaacaaaacaagtaataacaatgaagattgacaagtggatctatgcccattttgaatttgaatacttcatgttatcaaatgcataacaaatttacgtattcaactagcaaatcacacgaggcacataccaaaatgaacatgcaacagccacataataatgtttctctgaaggacctgtgcagctatgttagaactataccagcaagtacatcgtacttgaactaattgataaggaaacaatggcagcaccacttttacattagcatgctaaatctatgccctaatgtatccacaacataaagaaaaaaaaagacataacactctagttcttgcaccaaaaatagttaaaaaccagtgtgaccatagtgatcattttcttatagtgggaatttcatcttctgcagttacaaccgtaccaggaatatgcatgattatccagttgtgcatgataaaaatgagttcataattctaaacgatataaacaaagagcaatgttgatgtcactacataagtgtataagtacaatttaaatgttgaaatcttgcaggttgaaatcaactacaagaacatgcaagtttaccatgtttcaaaatgtggaccagcacaggttaaagttcatccttgacattacaatatcattgtaccaaagatggcatccacattaaattttgctcatcattcatcaaacaatattttaccaccgctgactatgattaagagcagacataccctcgagcacttacaacttcagcttcaccactcgaaccaaaagttaatcgtccacctggaccacggacacggacaagtctagtcttcatgtacatgagagctgctaactctgactgtgccaagcaaaacaatagagcaattaaacaaatatccaaatgtcacagcatatttccatgaatattatgcatcaaagagaaccatatacatgcactcaaaagatctgacaagagtgacattttggtcagatatcaaaatggaatggacctgtaattttgcttcttttgtttcagcgtgagcattaaatatctcaattataagcccaacacgatctaaaaccggcttaccccaggcaacctgcaaaataagatatcatcatgaacaaaaaggacaggaggctcagaaattcagaatgcggcacaataattgaaacttcgacaaaatctaacaaaaaataagcaggagcacttgcctccaagttcctttgttggattccagtgagaattgcattaacaaaaactgcatctactccttcctgttagattcaaaggaataccagataaatggcgcttaaggcatactggaatattttccttcatatatcatacatgtcggaattgaccgtgcaatagaaaagaaagcataagcaagtgcgatcacaacacaaatggaatatataatggatcatccggggtgtaaaactacaaatgaagttacaccgtagtcatgtttatgtacaagaaacaaataaagagtgcacctctgattccgatgtcctcaggtagcacttaacattatccacagttccaggtccaaaaaatttatctgtatgacaagttgtcacataaggttaaatcctataatccaagaaaagccgacgaaagactctcctaggtgaacagaagtatagaactatacaaatgctggcaaaaagttctaacaaataaagttacttgatagcacagctggaagtgtcaaccagtgaagctcaagacttcacctatttgcttattgatcgaactctagaaaattcagtctgggttatgaagttcaaacattgcaaacaaaaaactacgcatatttagcaagaaagtggttagcacctcaggagaaaataattttgacattttgaaaggattaaagactcaaaggtacaaatcaacttcaccactaagaaaatgtactacaaccacatcttcagagcaacatagaaatgccaatgagggtcttccaaagaaacatgacttattttataccatttccagtaaaaataactggcagatctatagaatgtattgcatcactaagcataccctaaccttaacagatgcaattagaaataacctcaagccaatctagccagccttatttcccgttttctcaagacagaagaataggtagagtaatgcgcctatatgagtactcatgagcaaatctcacccaactctgtatgcacagccctctagtatgtgccatccaaaaagctcagtctataagtaaaattcaaacaatcagattaaagccttacaattcgctcttcattcatacaatgctaaaagtgctaacctaataatcttataagtaaaattcaaacaatcagattcaagccttacaattcgcccttcattcataaaatgctaaaagtgctaatctaataatcttataagtaaaattcaaacaatcagattcaagccttacaattcgcccttcattcatacaatgctaaaagtgctcgtctaataatcttatcacaacaaaccccaggtgtgccagaatttaaataaaaatcgctgcatatcgcatgccggcatgcagaaaagacctaaaccttcgaaatacaattacgattaaatacactcccgcttgagttaaccgctggaaatgaacaaaagattgccacataccgacatgggagcggccgcgggatgaggggttctgggcgacgaggtggggcggggcgcccttggcggcgagaccttccttgtagaagccgtcgcgcggctcctcgagggagttggcgaggttgagggcctcggcgagcttggagtcgaggagcgagcccgggcggaggcgcggctgcaccaccagcagccgcggcgggcgctcagggtcgcgggggagcagggagaggccgcgcggggagccctcgtcgtcggagtcggcgggcggcgacgcggtcggggaggagcgcttgccccagcgggtggagagggagcggagcggagcgggcgtcacggagggtaggccgtggtggtggtgggcgtgagggtgggggtggaggtgcgcgcgcaggcgggagacggcggcgcggagcatcgcgaatggcggcgcggcggcggcggccggtggtgtggcgttgggtcccaccggtctagcactcgggcactgatggaggagagcggttggatcgagtccacgagggatcgtgggacgaaccgcgacggtgcgactgcgcgaccgtgcgacacgagtcggtatggcgagagcggcagcaaaaggtggaggatagaattgctatcttgccatctttcaacaagggtttcctcatagttgtgccgtctattgttatatatcgttaaattatcattttaaacattgtctatacgaatactattataaacaaaagttcacttgaacatcacttctcctttcctttaaacacgtcaatgtgtttgtcggcagcaccaccgaatgccatgaccaccatcactctcaccgacgatgcactgcgctccacttcatcagctcaacccacatcacttcctagttgtgccgcctaatcaaagccatctccataatacatctgtcgtcatcctgcgaactccccgcacatgtctctctttggcactccgtgcgtcatggcggccttcacgtcgtgctgatagaaaagccggactgcacagcttggcggtgcacaattaaacgatggggtgccagcggtgggctggctaggtgtagtgtactcgtccatgtcccttttcagcagcacgtgacgatgacggttcaagccagtgtagcaaggccatcggagttgaaagagaaacagagaacgaggacatttcagtctatttatatggcaaatggcactctaacgtgcaatgtctatttgaaattggtaatttagcaaaatcaaaatgcaagacaacattccggtgaaacccatatttgaagatggcacactaacaattttctccatgtagagaggccaacggtagaaatattttaggaatgatcttttatgcagaggtgttcacgtacaacctgggtatcccaatgaaccaaaccgcttgactagctagtttttacgcgctggattgggttaggctataaacccatctaaatcatttgtatatatgtaagcacaattttttttccgtccccaatttcatctcgtctgtccgtaaggaataagcagcaagttagaaaaaagcatcattttttcgttattgttgccgccgccattgtcattctccttgtcgtccttgttgatcgaaacaaagagcatcatgtcaggccaggtgccacaaccaccatcgtcatcgtccttctcattgtgcttgtcgcacgagaaatggagcgctatagtgataatcgatggtaattgtgaatgtattcgacgtttttttttacttgtgagcaatatgatacattagaggagtagaagacggatgcaacaaggaagggctcaccatttgcttcatgttttacctgcttgtcatttgtcagtcacaacgttctccttgtttttttcgatgaatccgaacgagaaagacgacagcttaaactgactaaaacaaatcatataaaatagttattagtggttgggttatagagtgaactcatcgtaaacccaataagattctactttccaaacaaaatatattgtgaagagaaattcttgtgtttgaaagtaccgtttaacttggacggccataaattaatagagctaggaagtttctaaaagctatcaaatggtgaatatggtctatttaaaatcatgttttcttgaagtacagtgatgtcaggatatatatttacttatgatatctaaaaattaatataatcatctaaaaccaggtgggctttcttaagtagaagatctggaagatcttactcaaaatacaatgattacaaaaaagtttttattgctgtccctctactactccctccgctccaaaatataaacatttgtttatcgatatggtttttttatgctactttgactaacagtatctacaaatctacaaaagtaagatgttttaaataaaaagagttatatattatgatggttcgtttaatgatacatgattaatctttttaaattttttgctattagtactccctccgtccgtttcacaatataagactttctagcattgcccaaatttatttagatgttaatgctaaaaagttttatattgtgaaatggatgaagtagttaaaatttagaaagtttgacttgacactattctaaaaatacttatattttgaaacagacaaagtaagatttagttacatctagagcttatctacgaatagtacttgcgtttccatattgtataagtgatgaggtagaattcatacacgcgaccttcgagcacattttgaatagaaactagtttcgcttacggcttcgctatcacgacacatatccgtccgatctctatgctacagtctacagaatagatatcccgacgtcgtcaccgtgccgccgatcgaaccttaccgaagaaacgccacgattttttcaccccgtgccacgccacggccacggccacggtcggccactcggttggcgcctccccgacgcacgacgacccgcggttccctcccgtccccggccgcctcctgcctccacgcgcggctccacctccacctcccctcccctcctcgccgcgccgcgccgcccagcaatccaactccgaatcatcctcctcaccccgcgcggcgccgctccgaccgaccaaccaaccaaccgcagcggacgccacgcgaggggaatcgaagcggagacgtaggggcggggggaattcggccgaggggaagcatgagcttggcctcccacgcgcctagccgtcgagctcgaatcgcgtgagataaggggccgcgagcaccgtggtgggagagggagatggcctcgcgggaggacgaccgcgccggccgcggtggcggcggagggcggacggagcaggagcggcggccgtccaaggcgtgggggatcctcatcttcggcctcatcggcgccaccaccgccaccttcgcggtgagcagagcatcccctcttctctgttagtctgttacttttgtgttgattgatagtcgatgacctggttgattgattcaatacgaatacagtcctgtttcaagtgcccagcttactagctttcttgtttagtttcacgccttccgtgatgacatgactgtttccatttagttgttgctttgatgaaatttgctcctgtatctgcaattcggcgtcaaatgctccaattaggctgtttgcatcgtttcatgcccaaggtagtggcaccttcagtgcttctttttaaagataatgcaagtttttattgaacccggtcaattatatcaaggtgatacaactgcactgagaacattcctagcctctgcaaggatttagtggttcttatgcagctccttgtggcaacgaagcatgtggctctttaaacctgttattagtagtaatgctcttggcttcatatgtctctttgctgaccaaagccccaaggtcctaaatgctatcttaagattgcacgagcactgcagatgggtaaaccttgtgctaggcaggtacttactcccatcctcatgtttgcgaggtgggttgctaaggattgttgctattattggaaatcctttcgcatctccgttcaactgtgatatacggttattgtttttgctggaaacaaacccttgttgtaagctattgttacgacttacaagttgcaaagatcacctgtgcttgacctttctgtttcttcttaccatgtaattttcaggttgctcaagttcgcagaagtgttgattgggtctacagtcaggtatccaagttagcatctatctgtttgttgattggtcaaatgcaaactgttgcttttctttgaactaataatatgtccatgcggacattgattcattggcccatatgattggcaatgggtttggattgtggctgcgttacgcgcgtggagggggtgggggggggggtatgtatggggcacgctcctctcggtgggggtgcggaggggaggagatgggcatctccactttttaagtagtagagaaatgtagacatcccaaactaaatgtcctgttccagctccttatctaatcaggattgttctattcaagcagaatgaattgaagcgaagcccccaaaactttatggtttgagccttgtacagtatagagacatgatctgtgttgtggggtggaacattctttttaggttaaaacaccatatagggttttttttacatctaatagtcggtagttactccctcagtcccaaaatgagagttcgaccattaatacatggaaaaatatataggttagctttaataaatagtattgaatttgtcttgccaaatgctttcataatagtattgaatatgacttacatttttggatgtttgggagtaatagattgtttgctcaaatgtagtacagttcggcaataacaaatttaatgtgtctaccccatagacgagcattattatgatagaccagtagggtaagattcctgtcaatcctctctccctcgtcagttctactccaacaatggatttgcgtaggaacaaactcttttcttgctattgcattcaattattatttgattatttctcagtctccctgctatatgtcggaatccctttggttatattgttatcccaacaaaaatgctgtgtagtcaggaagctagccaataacagatgactgatttatcatcctatgtctccgctgtatgcttatacttgtctgtattttgattctttccatcatttacttatatgttccttttatgtctccctttcaaaagttcaataagatgcagacaacatcttggaggaatgcaagtaacagctctaaccgtggaagtttcagtgaggatgctaggagaagatattaccaacgtatgcaacaggaatatgaggaggaacaagagagagttgtaagttttaaataatgcataatccttttaacttctttatattccaagacattcatttatctttggactttgaatttggaagtcggacattatatgaatgctgcctatacattgtaactgctgctgttaaggtttagaaattatcgtgagctatgttttaattaaagttatacacattcacgaggaacaaatgattcctatttcatcccttaaatgtctcaattcaacatcttctcaggtccttttcccatttcccttcagtatgttcactttttatttgcttttttgcagcaaagaataagacacatgcaaagtgttttcaacagagagaggaacaagtttaggagaagttatgaagcttggagggagaatggccctccaggtggatataattatgtcccacgggacgactggtactggcagacagatacatcacactcggaacataaaaataggcggacatatactcctgcaggacctagggtgtattctatgtcacatcactatacagtccttggtctcaataggtatttgtttaagtctctagctgcatacttctgttcatctgttaatatactcatttcatggtacagatatattttactgccatactcagtattaagtgatctgtggtttatggtactctgaagtttctcaaatcaatctaaattgctaagagcctcagacacatgttgtaatatagtggagctgaaggtttagtattttggattagaaggctctgttaaacatttcatgtagtattgacccatggacttccttgtgtatggtataatctggctaatacactagtcagatggtcattcctttttttgcactgagttcttgtgtttttgtttgaatctggctattacgtcttctaaaaatagaacaagcctgctttgcttcaatactaccattttatgaacccagctctatattacctgaaatccctaaagtggtcctttggtagtaggaagctttcattagcatcttgcagtcatctggcatgcgagaggttctattatgggaccagtttctcattgctattttttgctatataatcaaggtcaaattggcattgctatattgttctgtatattcatgttagtttcatagtttttttaccaattctggttatctggtgaaacatttctgctattgataataaaacaagttgtcaattagttggtatccaaagtagtacactagaagcctttataagaagtgacggaagcacacgtagcacactataatcagtagtgaaatgaggattgttgatccttaaagaaaaggataatcctttgtcaggacagacatcaaggctatctgagctcagtgaactaggatattttgatgtacagacaagtctattatgagtttaaaagataatcttggaaatcttatatgctgtatactggtgctgcgatgtttatcccttttctttacgcattcagtagtacataagaaatttcctattgcatttctaaaagtttttttttgcaatctaactgttgatactcatagttcttgatggaaaggaacaaataaactatgatgtcgatttcatttgattaaacacaatgatgcttttatccccatttttttcccttccctcaactgcctttgtttgagaataaccttcacaatagtaggatgtgctacagatataccaatttgtcctaacaagccatgtcctcctttgtaggtcacggacaacaccatacaccgacgcagaagtcaaggtattgtattcgaatatctgtctgtcatgctattgttcctccagacttgtactgtagtatgttttaacttgtctcagctgacatgatagtggcatttcctctgatggtttaattacctcctttctgatcctggatggaagcctaccgcctgttccagctttctttatgctttcaactacctcttttttacatcccctttgttgtgctaaactcttttgctctttctgattcaagagttttcatgccttttcttactagcaaagaaatggaaacattatgtttgtgattatttatttttgttttaccatatcacttatcaaatatccaagctaactaaaaatccttcagctagctatccagaaatcataccctgttaatttgtatggatgttgaggattttgcattgtgccgtccccaattttcctacgatggaacaactctctaaccgtgtttttcaataattcttacgtgatctttgattccaccaatcaaatatttcatattttatgttctttcctattgtatatgaatgtattaagtggctttttgggaatatctggttataaagggaatggccaaagaccatccggttcatgaaagaaattgaaatttttctcatttcctttttcaagagaagatagccccaaaaatctagtagggatttgttgttctagatctgcagaccgaatttgttgtttggtatatttaccatgtttgctgtgtgtgatatgtagctgagtatctaacgtcaggaatttacttgctgcagaatgcttttagaacaaaagcaatggaggttcaccctgatcaaaatcaagataatagaggtggctaacaactccatgctttttttttcttgattcgtcatatatatgtatcgtgttgttatgtatccacgaataccatgaacatcttatgttgtgcagaggctgcagaagagaggtttaaggaggttgtcaaatcatacgaagcaataaaactggagagaaaaaatgatgcaagttgaatgtgaatatgtagcttcactggagctcattgggaagattgaaaggatcaatgaagacagtatcagcaggccttgcaatcaagtggatgatctgttaggttcggctgtatctgttgatagcctgtaagcacaagtttttatttgcgagtttttttttttgggagcacacggccctgatgtagactaggatattgtcgacaaaggtgcaaaaggaaattgctcatttgtgcttagccactaatttggggtgcaaaatctggactgcgggtgagcatttttgttgtgtacacctgctggtttattttttattagtagaaagtagagtgaagatctgatagaaaataataagtagcccataatattatagcagaaaaacaatgtttattacgacttactcagttactctgttgtgcattagagctgtggttagctcaaaccggtgctgcctatcatctatatgcgttaaatgatgcatggatatgaattcggtttgttacagctgaccctgttgattctgcacagcagatcgcagtatcagactgaaattgtgagtgcaatctagccataaaccaacatgtcactttcgaaatgacaccgtatgatcatactctgatacgtggagagtactccctccgtcctataaaaaatgaatcttcccataaaaaatgaatctgatttatagtaatagaatatattaaatctggtactaagttgttcctataatcatgttgccacgaaaaagaaaaataaaaaatgaaccaaaaagaaaagaaaaatgaaccgggcaagcattctgggcttgcgcagttgcgccacactgccacagtccagcccaccatgcggcgcctcctctccgctccgctgcgccgccgcctatgcacggcggccgtggccgcggcggcgcccgacccggccctcgcctcctccgcggagctcgcgtaccgcctcctccgccgccaccactccgaccccaagaggctcaccgccgcgctctccggctcgggcctcgacccgacctcgccgcgcctcctcgacgccgtcctccgccgctgcggcgccgcctccgcgctcgcgctccacttcttccactggtgctccccgtcgctgccgccgccggggccgctcccttcctccctcgcgctcctcgccaagtccttctcccgcgcctcctccgcgccgtccccttccctcctcgcgccgctccccgcccagctcctctccccgtccctcctctcccccgtcctccgccgcctcccgcccccgcgccttctccccttcgcgctct

SEQ ID NO: 76268 - DNA, 23713 bp, Oryza sativa
  unsure (1)..(23713): unsure at all n locations
gtccctcgccaagaccggccatgtcgccgtctccgagcagctcgtcgaggagctccagcccaggctcccgctctcgctccgccactacaccgcgctgctctacgggtggtgccgcatgggcaagctcgacgaggccaagcacgtgctcgcccgcatgaaggccgcggaggtcgccccggacgtcgtcgtcttcaacaccctcctcgccggcttcgtcgccgacgggcggttcgaggacgcgttcgagctggcccgggagatggagcggcgtggctgcccgccgaacgccgtgtcgtacaccaccctgatgcaggggcttggcgccagggggagggttgatgaggcaatgcgggtgtttgtggaaatgcgcaggaaggggtgtgcaccggattccgtcacctatggcactctggttactgcgttctgcaaggctggtaggatatcacagggatatgagttcttggacgtcatggcaagggagggtctgcgggtggacgccggcgtgtacctcgggttcttcgtcgcgcacgagaagaaggagcagcttgaggagtgcttggagttgatggagaggatgagggagtgcaggtgcccgccagacctcagcatctacaatgtggtgatcaggttggcctgcaaactcggggagacgaagcaggctgtggcattgtggaacgagatggagaccaacgagcttagtcccggggttgacacatttgctatcatggtgactggcctcgttggccaaggcgtgctggttgaggcctgcggttatttcaaggacatggttgggaggggactctttgttgcaccccagtatggggtgctgaaggacctcctcaattcattggtcagagatcagaaacttgagcttgcaaaggatgtttggggatgcattatgaccaaaggctgtgagctcaattttggcgcatggacaatctggattcatgcactgtacgcaaagaaacacgtcaaggaggcctgcatgtattgcttggacatgcttgacgctggtctgatgccgcagcccgacacatttgcaaagctgatgaagggactgaagaagctctacaacaggcagattgctgctgagatcactgagaaggtgaggaagatggcggaggagagacatgttagcttcaagatgtataagaggcgtggggtgagggatcttgaagagaagcctaaggcaaagagaaagaaagggcagaaaaggagtcgcttgaggcaggctggtcagaatcaatccaataggcatgctgacaaaactgacctttttgatgattttgatgatgaataatttcatgcaaggactagtttttgccttctgatagttgctctatatagtttcgacttattactctagatcattctgtgtgaggtttaatattttttttcttggggaatcactggatctagattgtaaagttgctaatccaaacaagtcaataaacatgtcacaaaaaaatatattgttttttttttcatatgcaactagagcgaactgtaaaatcttacacgtgcagagaaataggtagtctgtaatgatctactttatgtctcttaagttgttgcatgcagtatgattgtgatcataagtatatctcattgtaatttcaatttgtgataactggtaggttgatgtatacgtagcagtatttcttttcccaagtttgatgggcattgaatttctctggtttcattatatattgtagtttaaagtatcacgaatagtattactttaagttacatttgtttaagtatttcttaattgaattcctcccttaagaaatacggagtactgcactaaagtaatgttctttgttctagggtggtgaggagccgaagaaacatggtttggttttctattgttcgtttggttaagccaacaaaaaccagatcgggtgttttgactatgtgtacctgcggaaaacgttggctagaagaagaaaatgactgtttgcctgaaaattgggatgaatacatacatttgtcgtgtagtaagaccccccttaaaacgcacgatagaaaaacacaataggttcccggcgaaaaaaaaacacaataggaaaaaaacgtaataattgaagtattatgtttttccaatcctatgaaaattgagaaaaaaatatatataaaaagatgagtaaattacacccgcggtacatgaacttgtgtggtgggtgcaaatagatacaacaacttacaaattgctcactttgatacaataacttggctagttggtgtgaaccgggccaaaatgatcacacaagtaaaattgctctaaattagtgcacactaatgacataacaacatatacatataactgtgatttggagatcttatttcgaatccaaataaaaatgtgcaaaagtttatttttcatgtccatggtacaatatttgtttcattttttggaaaaatttgatcatctatataactcgtctaatgtttatttatctgttcaagaccaagacaatttttatatgtactattaactactaaaagaaaattttaattttcatgttcatgttctgacactttcatcgaaagtgtattttacaatcaggtatttttaattattttgctttttcgttggtctagatcttaaaagtatcatgcgactaataatatgtgtcagtaaaaaattttgatgtgtaacaataattacacactagtacgtatcatattacatcaattttacttgtgtggattagtttggcccatctttgtatgaactagccaagttattgtaccggaataagcaatttacaagttattgtacctaattgcacccaccatacaagtttgtgtatcgtgaacgcaatttactctaaaaagatggactctttgattgcatcacaggaaacattcaacaatcaacgaagaaaagtttcacaagagatctaacctcttatttattttcatatggaattgaccataggaatggaatcctatggaatcaaaggactctagaaaaaaatccttcaaaatttctttgctaatcctccatttcaaagggtccctaaattaccatttggacaagattttttaacaaagtttcactttgaagtctttgcgctattctaaattctatattttatataataaagctaaaagtatttacatattttactttgaaccactctctaatgagcggattacctttgtaagtaacgtgtgggccaaaagattatcaggcccacatggtagtaagaaaggcaatccctaacgactaagagtaagtataatagtgggctataagaaggctgaatgctgaggtggatgggagaaaagaggagagagatgagaagcaggctgtaagtttgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacagttggcgcgccaggtaggggctgcgtcgagttttccgtcgagaagtgcgatggaactttgtgccggcatcatcggtgctactcttgtctttggccgtgatcctctcaacaaaagggcagggtcttcgtcgccaaaaattctatctggatctggtcaatcaaccaggagattaatcaccgatcgaatcgatctacaaccagcttgttaccgtcaattttacctccgtcagtgagatcaaatccgtcgctacaatgctgccatatctgttggtccgtcggtttcgtcaccagggcatgatttgaagcaatcagcaagcagccgccgccaaaatcatgcgaagatcaccgttggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacacggctgcatgctacggttcatccattgacaggcctcgaatcaaagttggatcacaaaccaggtttatcgttctaaattttcttatataaattagaattaattcacagatcactaattattatttgatctattattttatacatgtaccgccggccgccttcgtcgctgccgattggtttcatcgcctccacggttggtgtgcgccgctgccgttgcnnnnnnnnnnnnnnnnnnnnnnnccggcctgcctccgtcgccgccgactggtgtcctcgcctatacggtcggttggtcacaccaccgttgatgggcatcgtcatctacaccgccggcctacctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtcttcaccgaccggctggccttcgccgactggtgtttccgcctgcacggctggcctattatgccgccgctgttgggcgtctacgacttcaccaccggcctgcctccgtcgccgccgactggtgtcctcgcctatacggttggttggtcataccaccgttcatgggcgtccacgtcttcgccgaccggctggccttcgccgccgccgactggtgtttctgcctacacggctagcctattatgccgccgctgttgggcgtctacgacttcaccgccggcctgcctccgtcgccgccgactggtgtccccgcctatacggtcggttggtcacaccaccgttgatgggcatcgtcaacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggacgtctacgtcctcaccgccggcctgcctccgtcgccgccgagtggtgcctccgcctacacggctggcctattatgccgccgttgttggacgtcttcgctttcaccgtcgaccgccttcgtcgccgccgactggtgtcttcattgttattgatggacgactttgttcccacattggccacttctgccatcaccaaggggaatattataaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagaaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacgtcaccaccggctcgcctcgaccgccgccgactggtgtttccgcctgcacggctggcctattatgctgccgttgttgggcgtctacgtcttcaccgaccggccgcctcgtccgctgccgactggtgtttccgcctgcacggctggcctttatgccgccgttgttgggtgtatacgtcttcaccgaccggccgcctcgaccgccgccgactggtgtttccgcctgcacggctggcctttatgctgccgttgttgggcgtctacgtcttcaccgaccggccgcctcgtcgctgccgactggtgtttccgcctgcacggctggcctttatgctgccgttgttgggcgtctacgtcttcaccgaccggccgcctcgtccgctgccgactggtgtttccgcctgcacggctggcctttatgccgccgttgttgggcgtctacgtcttcaccgaccggccgcctcgaccgccgccgactggtgtttccgcctgcacggctggccctattatgctgccgttattgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgtcatggctgccgactggtttcttcacttccatggctgcatgattctgccagtgttgattggccttaccatcttcatcgctggtcgtctcgtctgctgctgactagtgccctcgcctctacgtctggtttatacagctaccactactgatggacatcatcatcttccgtcgccgactgattatgccgccgccgactggtgcttttatcttcacaactgcgcgtcttcactaccggtttgcttctgttgccgccgacttgtgttcacttcattacggcaatacaactttgtcatcatggtggagcgacttcatctttattatcttcggcaccggcaaactctattgttgctacttcgcaagttttactacttcaccacccacgacgtctttgtgaacctcgacatctcggcatgcaatgccatgttattttactacaacaagtggctctccaatattcaggatttctacttggacatcttcaacacatatcttcaatcaagtgatgactactcgacaacaagaagctataattctcgactctatgttcagttgtttcccaactaatcaaagagtcgggggctacacaaatacatggctcaaaatttgacaagctttatgtcaagatgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagactttgccaacttgctattccgccttcacggttgacctactatgcaaacgctgatgagcgtcttcgtcattatcatcggctattacaccgctattgactggatcaccgacatcgtcatcttcatcaacatcctgtcaaacctctttatcatagcttactctactgctattgataggcaacttcgtcatcatgtttgatcatctctgttgatgcttatcatcattactgtcggttacgtttgtcgtcgccgactattttcctcatcttcatgattggtggatttcgtcatcgcctttgatctgcctcgtctgtcaccgactgattatttcgctgccatggctacacaactttatcgctgggcgccttcatcttcattgatggctgacctgactgttgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtattatatcttcaatttggacttgctccggatatatgcaacatgaattcatgatcatgggtctattttatatgctcaaagactggactatttattattccccgtaagggttatcaactgaatacttgcgccagtcgggattcaattgttatatctattttggagtatcccataagggataatcactcagatcacatggtctatatcacccgggagcatgttacatgtgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctggcttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttatttttcagccctccacagtcttcagatttggtaaaaatactcgggagaccatggcaaagatgattgaagtactcggttttggagtaatctagttcgagagaagattatcttttcgactgtgaaggtctcaggggctactgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacaaagtttacagccggcttagacataggaaccaagaaaatctgtaagacagacatgtggatcatatatttatagtgaatagttaaccactatatgagtgagctgatagatagactataactaagcagctggatgtattattatcttgctctaacgagcaccggctgctgggctcctctccccgtcgctcaacggtctattggcccggtctaatagtagggtccgatcttttttggtccaaccgatcgaccgaaccgggtctgctacgataggtggaagtgtgcccatatccactcctcggcaatttcgcattccccccgaaaaatttgaaatccttttcgcatccctctcctctccgcgattccccactcccggctgcagggcggtgcggcgatggccgacgctccgccgccggtgctgacgctgcaggtgaagaagggccgccgcggcggggagacccggcagtggcgggcgggcgccgtgctccgcgtcggccgcgtcgccaccggcaacgacatcgccgtgcgcgacgccggggcgtcgcagcgccacctctccatcgagttcctcccgccgccggcctcgcggtgggccgtctccgacgtgggatcctccaacggcaccctcctcaacggctcccccctcgtgcccaccgtcccctccccgctctccgacggcgatgtcatcaagatcggggagtccagcatgctcgtggtctccatcgcgcccgattcggatcccaaccctggccctaggcgctcctcgcgccaatccgccgcagtggtgggggagcaggagaaaccccctgcggtcacccgccgtggcggacggaagaacgctgcagcggcggcggtggcggttgagccgcccattgcggagaaggaagagccagagccggaggaggctccagtggtgactcgccgcggtgctcggaagaaggccgcgcaaccccccaaagcggaggagcacgaggagggcgaggaggaggtggtcgcggcggtggtgacgcgccgctgtgggcggaagaaggccgcagagccccctaaaccggatgaggaggaggagcaagagaaggggaaggatgaggaacaagaggagaaggaggaggaggaggtcccggtggtgacgcgccgcggcaggtcgaggaaggcggcgccggaggcagccgttgcgccaccgccgccgagggcaaggtcgacgagagctgctgctaggagaggcaaggcagtggacacaagcctggatgagagggagagcgagatggccggaaagggacggggaagggctacaaggtctaatgcaaggaagtgtaggatggccgttcctgaggacgatgacgatgatggggaacagcaagagggggctactgctgtggcagaagagcagataaaggatcaaccgagggcaatggcggtgactgacggtgaggaggaagatgataaggtggaagccatggatggagaagttgaacagaatgacaaggcatcagaggaggaggaggtgccagtggcgcggagaggacgggcacgaagagctccaaaggggaaggctactgcaagtagtaatgctcatgctgcttcggacaacgcggttgaggaggaagacggcggtagaggagagggagcggctgtggaagtggagggggagagttctgggagcagcagcttggaaaccatgacactgagggagtggtttcagaggatgaatgtgtacctccctaggatgatcaatgaggctgctgaagaggcgctttcagccctgcgggagaggcatcggcgtatagatgagtacatttcaacgcttgaggattagcgtgattcatggtatgttcatctctcaagagaaatctttgtccttctgttacttctcttcagcaagttcagttctctttatgaaatttcctactgctgtcagaatgttctattatgttcgaatagctcaatctttcaggtctagcaatgacttttctgcattgcccagtaattgataattcattttaattactagatacagtatatgtataggaactgtacttgaatgcagttggtattggggccgtatctgcataaatttactatgccatgcctaatgccttattgctgactatcaatctggattgcctcaacatttgcttatgttaaagttttctcgcaacaattttgtaggatcatgtttattgagaaagttcttgcataccaaataacttcatcaggtgctcttgtcatatattttatcttcacttcataagtctgatttatgtcctctcccagcaaaaaccagaatgccgagtgcatatctggctaatctccagtgcaaccattacccattattagtctccaacatatgatgggaacaattacgatgtagttgacagttactgtttagatctgaaatgaatgtgtaattgtgaagcaagtgtgatctattcattcttgcatattgaataactgtttactgatcaattctagccattgaggtgtagcaattaacatagacaattactctctccgtttcataatgtaagacattctagcatttcccacattcatattgatgttaatgantntnnatngatntatatntanattnattaacatcaatatgaacgtgggaaatgctagaatgacttacattataaaacggaaggagtagaacatacttatatctgcagtttgttctttgcctgtaatgtttcccttttgcatccataacatatttacatgtaaaagctgcctctgtcaccatatgatgtgcctatttccatactgctagtgctatgacactccacgttcctgatctgctactatgggactgaagtttcatgagtgatctattacacaaccgaacagataattgttcagctgcagttctttgttctgcttgacgttttgccacagccaatgcttgatgccttgaactaaaatgacaatgttgaagaaattttttgcacgactctttcaagatctaaaattgccttttggtgccacaccgtcttattcagcaagctttacaacccagtgacacagaactcgcaaatagtttttcacagtttcagcgtttccgtttgagatgctgaaaaggaagatacatccagtggatcatatttttctgtgtaatccttgctcccatagtctcatgtattgagctgtggcagaagtacggtttattttgctattcatctactaatgcttgtgcttagcttttatccacaatttgcttaacatgccatctgtctgcaggataattaggagctatttggtcaatctgacgtaggggtgatgcctggagataacattaattggaggcaatgctttgctgaagcgccacaaagatttgctgaagcgccacaaagagccattaggtgatatttcactgggatcatctcattatcgattccagttccaccaaatgccgcaaaaatcattgatgcaatacactgtagcactcttcatgtttactctagttatgtagtaccagtactctagtactcatgaagtaggacctgggttcgtaggcctctatgcaaaggcattcaacatgcatcgcagatttcattctgtaaattgcctctctaaggtgatgtttattcatgcctaacctctatctggaatacaacgcgacaatgttttgaatgtatatgtcgtttctaccatggctgctattaggagtcagaactgattattttgcccctcccccgttttttacttttgaataacgtgttcctggatgatcagtatcaactgttgggaatttgttggtgaagatgagttctcatgttttgatactaaatcagaccaccttctagtctcaatgacctctctcatctcacttggaaaatgtacctgatttgttgcagtgatcctcatattgttaaaacccactctttaatgggatccttcgatcctctacatgcaacgctcagtaataatctcaggtgaaaaatgaacgaatgctcaatcttatctttattttcagcgatacgaagcgcacaatgcaatttcacctgcacagcatgaactgttaaatcgaatggcaacacagaagaaaggatcagatgcaattatctaacaaagaacaacacacgcatggcaacatctggtatccatgccattttgtggagaaaaacacacccatcacccccagctcattcagtgccatgtactgatgtacagactcacagcggaagacatttccaaagggtttaacctgctcatcgggagcacgcagtccacattctttttgcagatgcagaagcattgcttaacttcatacaatgaacaatctaagttctaagacctaccatcagtaactcctagctcaactagaacattggcagcaagagtcatcgttttctcttgccatgagtctttgacttgttctcaaggtcatttcctggtggcgccttaagagacttggatgcaactgctgagctccacagcgctctctcaacatcagaagtagtgaaaacttcttctcctgagctcaattcctaccagagaaacaaaaaatatgaaataaatgtcaatcaagcaccgcatgtgttcatcttcagacttcagctaacagtccaaatgttcaacaatctataattttgatatggaatttgcagtttactcggtgttattctagcaatgcggacgttacatgcttgcattttgcaaatataaaagcataacgttcaagtactaatcagcttatcagtatattaccctattgttgcagctgctgtctggaataaaaaggcaagcagctgaaaatttggcatacgatttttgtaatgcatactctgtaaatttatgagcctggcatccttgagcctattggacgttatgatttagagaagcatcagcaaacaagaaaaaggtgttatctttctgcactagttcttgaacagtactataacaaaaaatatgtggtggtatgttctatttcaatttcaaatgtcagctaagatcaattcttctaaaatgactccacacaaccagctaccttttgaagtccctttcagtttatctgcattaaatcaaccacatatttgaagtgtatcaactagaaatctccacacaagggaatacaccgtatttttttcccctttgtctgaactcaagtgatagtcaccgcaaaacaatcctaaagcattaactaggttcagacttgcagctgcctagcaaaccgaaggcttattatacagacacttcgatcagcacaatcaggaaaaacaaatgctatcttaacaacagtttatcacacatcacaaatgcagaagcaataccttcgatttagtttgcaacttttcagcaaaagcaagatactgcttcagagtgtactcctttgcattgcctaaggctgccaccatagcctaaacacagtccatccatgtttacaacatcaaagatgcattcatctcacctggaaatgcagaactgccaaaacaaaattcacaaactcacctcatcagacatgaacggtgcaacatcaggcgcgtaggcagcgagaacagcggatgccgtggcagggccaacgcccttcagcacggtgagctcggtgatggccttgcggaggtcaggcagcgctgcgaacgccttgcacgatgctgattctaccactgcatcctccaagcccttgacgaaatccatcagtctcggcctgcacaaaagaacagagcaacaatatgattattttttcccccaacgagtttgataataacagggtagtgtaggagtatcatcaactaaccaactagggtaatgattgatttgccaagaaaacgagtccctaaatcaatggatcaaatcagtccaagcacccttaagatactagcatcatccaattgatccacacatttcggcacgatttctagggagatttgagcgagaaatactactacaacatcacacgcccctgggaaccagaagttcaagtgctctaaagaggaacaggaaagaaaatctaagagcgggatgagacgacctccacttgccgcgggagagcttccattggaggaggcgcaccagctcgggcttggcgaggaagggctccgggtcgcggcggcgcaggagatcggggaggtcgcggcggtagaaggagtcgacctcgacgaggtcgggcttgcccagggccgcgagccggcggtcgtacgccgccagcgccgctcgccactccgccgcgtcgccgctcgcgaagtccaccgtctcggccatcgtcgttaccggaggcggcggcgcggtggaagaggtcacttcggcgcctcaagagccaggaatttcaaacagactagtatctacccatgtattaatatctctcgataaatacaacttcggcacatatcattggatatctactctattatattatcatcggtcgattggattgattgttcaagttcttctattgtctttatatcattatttatctgagcgttagaatttacctcggacatatagccaattgttcaagaccatatcaaatcggcttattggctgatcggttcttttatcatcaatttatctatcttgtcagttatagtatcaaactgactgacacgtacaaacctgatattttaggacttgcactggagcaaagcacgtatagatgatgtcagcacaagcccatctatagatagatgtttgttcctccttttttttgcaagcgtcctgtgcgttatattcttattagacactctttaggcccattcgtgaatgatcctatgtaaatgtaagcttctctattgcctttatgcgtacaaaaagattattccgtataagccttttctagtcttatttcgataccttagttatcttctagagttaggtataattatgataaataattatttctaaagtgtgaatgatattgtccattcaaatatactccctccgtaaaaaaaaaaagacaaactctaggtttccgtgtccaacatttgaccgtccgtcttatttgaaaaaaatatgaaaaaaattaaaaagacaagtcacgcataaagtattaatcatgttttatcatctaacaacaatgaaaatactaattataaaaaaattcatataagacagacagtcaaacgttggacacggaaacccagggtttgtcattttttgggacagagggagtttgatccaaatgactacaattattctaaaccacaacaaaaataatgatgttggcataatatatatttaatgtggatgttttttattttaccaattttcgtttttcgtgtgctggaacacatcaatttctcccagtggcaacgcacgaacacctacctagtgtaaaaaagaagagagaatctactatatgctactgagtttgtctcagttcaacgatttgctactgataatgtctctttgtgcaatataccgatgggacactgaggagagtacaaagttcaagaagattgcaatatatcgatgggacactgaggagagtacaaagttcaagaagattatttgagccagtgaacatatcattatgatcatgatggtgagcagcgtagtggatatatgtcccacgccataaaagaactagtgtgcttcttggaggagcaactccagcaaccccaaaacacctcagaccacgtatccacccagacatatctacgtaagttcgataagcatatcagtcatggtaactaattattttagtaaacaacaacattgaacaaactctccagattaactcggaataaaaccataaaaaagtgggaacaaactctccaacaaacattaacctgtaggacagaggcttgacataagacatcgggacatagatgataaacattaacctaaaggcaaggatcatcgatgtgatgctcgccacgtgaactacaatcttcaccctcttgatctccatggttttgggttgctcgtcatcgccaatttgaaccaccatacttattttctctaatatctattttgtcatatataagtcaacttaaacgcataccacctatacacgattcttggtagatgagcactacgcgaccatccgcagtagctagtagcgcctcctttatctcactctctcccgcaccgtcgttgcaacagtgcctaagagcgaagtccacgacaggcaataccccacatgcccccctacgctcataaaacaaagggtaccttatagaaatagttgatctccatggttgtgggttgctcgtcgtcaccaatggagcttaagctaaagtggaggggaaacctatagaaataaacatcaatatttgaataaattgatcaaacatttaaaattttaggatgagataatcaatttaccatttattttggttaattacaacactttgagctaacatatatcacttgaaagaaaatagataacaggatgacaaaaacgaatcatccacaataagaattaacagatatcacacctgaaaataaacttacactaataaatataaaaagggtttgttggaaccatgctaaatttgagatatgccacccgcatctcaatgacatgtaggacccacgagtcaatgacatgtgggtcagggtggcatatcacaaattttgcaaaatttgtgtggcatggttcaaattgtcccatataaaaaatgcattatcatttgcagcgtaaggaaatcaaacttaatatgaaatgcattcctcagcacgagacggtagatgtgtacatagtgctaacacaatcagatgtagagtacatatatcatcctaatcctcaagacgaaaaatacgtgtagttttatagatcctcctacttctcggcacgaggaaatcggcatcgaagatccatagcatgcctagtgccttgacaatgctacgatcgtgttgtctagcaagtagggcagtacccaaggctgcaattagccctacctcacgtgcagcacatgagtacctgcatgaacataaatataagttaatcaaattagggggcgtttgagagggaagtgagttgaaagacctcatttacatggcaagcattaaggcccatataaataaaacattaattaactctatccatttccaagatatagttagttttataaataatttctgacactattccaaagccaagtacactcatccactgttgtttaaaaatgtatttgttgtactacaatgatgaggaaagtagtaacattttcaacccaagacaaatttattatgaaaatatattcaattattgatgtgatgaaactaatttagtattataaatattactatatttgcctataaacttagtcaagacatatccgtaaggtcggtaaggataccagtcatggtaactaattattttagtaaacaaaaacactgaacaacaaactctctagattaacttgaacaaaaccacgaaaaagtgggaacaaactctccaatgaacactaacttgtaggacataggcttgacataagacgtcgggatataatgataaacaccctgatgacgaggatcatcgagcacatcctcgccacgtgaacgacaatcttcaccctcttgatctccatggttttgggttgctcgtcgtcgcaattcgaaccatcaaatctcactttctctaatctcgtcatatataagtcagccaaagcgcctaccacctacgcactagataagcatagcgcgaccaaccgtggctaataacacctactttctctaatctcgccatatataagtcagcctaagcgcctaccacctatgcagacaagcatagtgcgaccaaccgtggctaatagcgcctcttctatcttgccctctcttaactagacaagcacaacgcgaccaaccgtggctagtagcacctcctctatcttgccatctccgcaccgtcgttgcaatgttgcaacggagcgaagcccacaaggggccaatgggggcacatgcctttctatgctaatagaacaaagggtaccttatataaatagttgatctccatggttgtgggttgctcgtcgttaccaatggagcttaagctaaaatggaggaggaacctatggaaataaacattaatatttaaataaattgatcaaacatttaaaatattaggatgagataactaatttaccatttattttggttaattacaacactttgagctaacaaatatcacttgaaagaaaatagataataggataacaaaaataaatccaaaataataattaacagatatgacacctgaaaataaacttacacaaataaatataaaaaatatattatcatttgcagtataaggatatcaaacttaatatgaaatgcaatccttagcacgagacgtagatgtgtacatagtcctaacacaatcagatgtagagtacatataccatcctaatcctcaacacgagaaatatgtgtatatataatactgcgtatagttttatagatcatacttcttggcacgaggaaatcaggatccgaggatccataacgtgctagtgccttgacaacgctaagaactccaacaaacaccgctagcacagatccaactaggaaccgtgtgcactcaaccacgctgatgcaaagatcatgctgtctaccaagcagggtagcgctcaagctgcaattcaccctacctcacgtgtaacacatgagcacctacatgaacatagatataacttttactctatataacttaatcaaattagggggcgtttgaggggaagtgagttgtaagacctcatttgcatggccagcattgaggcccatataaacaaaacattaattaactctatccatttccaaaatatagtcagttttataaataatttccatgacactattccaaagccaagtaccatcatccactgtttgtttaaaaatatatttgctcgtactacataacgaggaaagtagaaaaaatgttagtagtgctttactactccattcattgcccagcttattttggtccatcattggggagggatctttcattgcacggcttattttggtccatcattgattggggagggatctgaggaaaagacattgaaagtatttcattttattctcaattttttctaaacaaactattaatacttgtactttgaaactgagagagtagaatttattgattatcgtcatgctctatgcatattaatcatgagattataaagtataaggagattatttgagccagtgaacatatcatattgatcataaccatcatgatgtgcagggtagtggatatgtgtctcacgacacaaaagaactggtgtgctgattggaggagcaactgcaggaacccaaagcacctcaaaccacatatccaccgagacatctccgtaagagcaactccagcaaccccaaagcaccgcaaaccacatattcaccaagacatatctccgtaaggtcggtaagcatatccaccaagacatacctacgcacgattctttgtagacgagcacatcgcaaccaaccgcgaatagtagcgcattttctatcttgccctctccgcaccgtcaatgcaatgatgcaacggagcgaagcccacaaggggcaatggggggcacatgccccttaagctcatagaacaaagggtaccttatagaagaaatagatgatctccatggttatgggttgctcatcgtcactaatagagcttaagctaaagtggagggggaacctacagaaataaacatcaatatttgaagaaatcgatcaaacatttaaaatattaggatgagataagcaatttaccaattattttggttaattacaacactttgagttaacagatatcacttgaaagaaaataggtaacatgatgacaaaagtgaatcatccaaaataagaattaacagatatcacacctgaaaataaacttacactaataaatataaaaaatgcattatcatttgcagtgtaagatatcaaacttagtatgaaatgtaatcctcagcacgagacgtagatgtgtacattgtactaacacaatcagatgtagacgtgcacattacagtacgactgtgtacatataccatcctaatcctcaacatgagaaatacgtgtgtatatatagtactatgtatagttctataaatcctcctactacttgtcacgaggaaatcgggatcagaggatccataacatgtctagtgccttgacaacgctaagaactccaacaaaccccgctagcacagatccaacatgatataaagggcattaagtggaaatcctctatgtttaactttgaaatcaactagttcttgagaggatttacaacatgtagttgaataaatttggaattcttataatgaaaagggttctagtattgacaaatgcgttggagaatgcaaatgataggaaaaaggctaaaaggatagaacatgaactgagatggtgaatacaaatggaaaaaaaggtggcaaatgaagtattcatatcaagattcggatagagatgagccaagagaagtttggagtggagggactgaagtttttgtgtgctcctctttttggcctgatgccgatggatgcaggttttctgccctagcttatttgtagtttttttggtagtcgatttggtcacacctgaaccaacgagaattaggccaacaccttttattttctttcttgaacttaatttctcttaatacaatgatgcataattctttgccgtattccctgaaaatactttcactgaactaaagtatataagaaggagaaatagtgatcaagctaataaatgaaacatggtgtaataaaaaaaaccataaacaaacatgtgagattgtgataaaaagcaattgtaactatatagcagctcatccctcatgcggagagagagataatggggagaggggtgtttataataaggatgagtatgcattcatgataatcttaacaacactaaacaaccttgactaacctggccaacagttcttgtgtgcacaatccagaggaaggcactaaatcactacatgccaatcgatagaagagacaaatacttggatgagcccctacaatatgtccacaggcaaaaaaagttgacagacttgcttaggagcacaccaaaagccagatcaagtaaatacaatcaccaaacatctattttgttttgtattttttatacaaccccctaatgggaataaactaagcatgttcttattgatttagttgattgacatggatgagccattgaaatatttgttaaatataaattactttccattaaaatataataacaaaaacaaggaagaaggtttccgcatgtaaaagtactaaaaagataattcaatatgtattcaaactttagtagtacctcaagaaacatttcatcgagcagttcttgagcaccaaaaacctctaatgcgttcctcctcttccttgttctctttgtatccttctattctctagccatggcagcagtacacggcatcacatacatcatgaggtcagcacagagcagaagcaaatcaacaacaaatcaaaaagagcaatgcggaggcagtaacataatagcagcagcaacaacaacaacaaggataccaagacaacaaggaagaggaggaacgcattagtggtttttggtgctgcagcggaaca

SEQ ID NO: 76269 - DNA, 707 bp, Oryza sativa
cgatcggctttcatgccgatccgagcccggggggctgccgccgccgccgtccgtccgatcggcccgagggcgatccgggccgtcggtcccgtggatcggcggtggatcacccgcgtggtcccggtccacggtggaccgccctccccgtgccgctgaccggtgagcccgcgggccgacgcctcctctttcctccccgtgccgctgaccggtgggccccgcatgtcggcgccgcgccacccgtgctgacgtcagccctggttaatattgcgcaataaatgatttaaggttttttcttttatagtaataaacacagtgaatcttctaaaaatcataactaattcatccgagctccgtttaatcccattcaagtctcagtaaatcaagaaaaatgtgtagaatccattaaaaatggttttgttctctgtttcagtagtcttatagcctgtttgcaatgtttgccttgtatgtcgctagattccggttcctccgacgctccggtgtacttcgagatagtcgccgaggttcctccagcagcagagcaaggcaagtcatgcttgtcacttgatcatattgatcctatattgcaaatgctctattgttttctttcaaataccgcatttgttttgcaatattactatagagatggttacctattgttacggccatactattttgataccatgctcctttgttagcttgggttataa

SEQ ID NO: 76270 - DNA, 1635 bp, Oryza sativa
aacctccggaacaggcaggcaggattaagcccctagcagcagggcaccaaccttctgcaatgacatctcgactaccgggccgcagctcgtgtagccttcatttgccctggagaatgtccatcgacccccgacttcatccatctccaatccgtgtacttttgtttataactagactgagccacaaactaagccttacccactagacatgtgaaagtacggtagtgctttgcaacagaggcccgagcttaatccttatagtggccggggtgctacttcccacaactggcatgcacccaaaccccaccgaaaacaggtttttaggggttttgaaagaggaagagaggtgtatgtcaaattccaccataaaccaacaattccatagtgtccagatgatatgagtattcccaaagtctagagttataaaaccacctaatattgcctaattaatcagcgaagcatctacctaaattcatactagtggaaccatgaatagaatacccactagttggggttttgtttatcctagggtgaacaaggtaataatatcaatagcaataataataaggtcataacaaaggtaaataggcatggctaaataaaacagtgacaacgcgggaattttaaataaagcgataatgcattaatttaaactaaaataattttataaactgggattcaatatgctcaaggatgatgtgacttgccttgctcagagagaacggccttccgaaccttcggcgacgaccacgaaccacgctttgggaacctccggaacgacgaaagctacgcgaagcacacaagcaaagctacaagcctataaagaagcaataacaatacataaaaaacaaagcacagggttctttaggttataacaaacattaagagacttgaacggatcgattcggagttcgtatgaccaagatatgatcatccgaagtttaatgctgtatatatggcgatttgcggattattataattaagctttgcaactataaaaaatgtggaagcgctagcctggaaaagacaggaaggctgcgctgctgacatgcggaccccacatgtcaacctaaaggaccgcggtagaccgggtacacagagacggtccacgggtcgacggaagcggatcccgtgtgtcaaccgaggcgagtggccgacaaacggactccactagacaccacacggcctgcacacgtggaaaccacgcggctaccgagcgggcacactaacgcggacactacacggtcaccacccgcacgcgtgaacgactaccgacaccggtacacgggtaccggggccgacaaccgcacaacgagcacgggcgacaccgaaaggacgaggacggggcagcgagggagagggatccttaccaccacgcgacgaggcgcgggaacgacaacgacgaacgggcgcggcggagacagacgggcacaacggagacgaacggcgaggggacggcttcggcggcgatccttggacgaaggcgagacacggccggcacgaggcttgacgacgcggagccgaggacgaagacgatgacggggctgctgcacacttgacgaaacgcgggcggcggacgagaacggctcgacggagggacgaacgccacgacgaccgggaacgacgagaggacgacga

SEQ ID NO: 76271 - DNA, 9565 bp, Oryza sativa
ttactaaccggaactaaagatcatagggccctgacacggcctgacatgtaatcaaccgggactaaaaatgaactttagtcccggttgaagttaccaaccgggactaaagatgatttttagtcccggttggtaacaacaaccgggattaaagatctttctcttattaaccgggactaaaaattatttttattcctggtttttaatggaaccgggactattatggatttgggttgaccaaccaaagatggtttctctaccagtgttcggtttcacaaccttcatatgactgtgcttattacgcaatccaatcgtgacgtatgaagctaggtatactgcccatcgatcgattctaccgagatggcaacatatattcgtatatatcgatgattaatttcacaaggccatgattctttcgaatttcggacaccgcaatacacttatatatggacagctcggatcatcaacgaaaaggaagcaatgagaggaggcggcggcggcggcggcggcggctgctgcggctcatccgtggcgggtggccgtcgaaaagcttcgggctccacatataccggaggaagttcgccgcccgctcgtctttcctcatcaggaacgactacggcgtgtggtcgcaggcgcaccggcggctcatcaggatgacgcgcctcggctactggatcgtctacgacctcgacgccaaggagctgaggacgtggtacgaggagaggctcctgcgggaccgcggcatggcgcggtggccggagtacggcgccggcgacagggaggaggtccggtcgctgatcgccagggtgagggaggagtactggcgccgcatgcccgagcaccggaggcagaagttcgtggcgagactcgaggaggagcggcggctcaaagaggagagcgatcagcgacagcagctcgcggcggcggccgacgagcgccgcggggcgcagatggccgcggttgacgatggcaagctccgggcatcgtcgcggtcgtcgacgcagcctcctcctcgtcgtcgtcgtcgtcgtcgtcgttgggctccgccgccgccgccgccgccgcctcgcctgcttggtattctactgtggatacttgctgcggaaatcgtgctgctgttcgtttacaaatttatgcttccatcgtttcgcttcttctaactcttataagccaaaatttaaatttaaaaatttattttcgattttatgatttttttatcgtagtttattttactgtatttgtttttaattgatcgttataaacatgtatataaaagttttattcgtaagttattttttctaataacctgtaccgcttttgcttctaaagagcaaacggtcatatgcacctctcgttttagactgaaattgacgatttactttcctattcatcgtcgtgtgaacttgagtctaaacgaacacccatctacattggagtaagttccatttcttttccttgttgtaagccgaaattcgagaggagagaaaccgaactaccggagagtgttctagtacaaggaactttgggtgaaaatgaactttgggcgaaaattaaggagtaggccaaaacctgatcgctagcaaaaagctctgtagatccaggaaaaaataatagtggggctggacaaactatgctagtataaatcaaaacatgtatcacatataaattggctacatatctagttcaaagtacacatacattgaattaatgatatgtagagaattttgtccataccaaactaatgtccaatagataatatgtcacacccaattgcctattattcttcatgagtaataatctatacaaagaaaaaggcaaactaacgaattcaaaaaatttagagacctagggatcactgatagtgttgcttgaactattataatacgtgaaccatgttctttttgacatgctgacaatctataaatgtacagaaacaattataaatttcaatcactacctcacttaacttgaactattgaggcacaattttagactgtctattagtattagaggttagtaggctaccaaatttaacttcaatcaccggttgctgctgcaagttgtgtagttgccggccactgcgccgctgcctgcctaccttgcgccctcgccggctccaggctcggcacctcccgcccggcgtgtcagcgcaggatcgccgcctggtgccctggcccagctcgtgtctcgctacctccccggcactagaccgccgcttggcctgtctcccgtcccaccctccaggcccctagcttgtttggtgctcgcggcttgccacttgcctgcttgctacacgccgcacacccatggggccacgagccacgttgcctcgtgcctaggggtggcaatttccctattgggtccggtgacccggcgggaacccgtccctacggggtcgggaccgggggagaattctcaccagcaggtgagtggggacggggccccgcaaaattccgaggataggggtggggatcagaattaatccgcgggtgacccggaggggccccaaatatatatgagttacttttccaaaattagcccatttcaataatatagacccaataaacccatttaaaattgacatataaaagctcaatatcctagttctcctcaaccgtaatccatttccttccttcaaccaaccctcaccgccggaggctattgaaattttatcacactattattcagtgtattacaataaattttacagagtattaactccatccgggtgatgcggggccctgatcactcgccggttcccctgtgggggcaaggacgggtgatgtttttcactcgacttcctttgtggggccgagggtggggatacctgcaagagggcgggcgggggtattccagcccaacccggccccgccccgccccattgccacccctactcgtaccctcgtcagctggtgttgtcgccgggtgctggcctcctcggcaccttgcgtccttgcctgtccaccgtgcacggccgtctcccgtcgcccatcagccgcccccacacccgtgcctagctaggtccttggagatttggagaggggaggtggggagttggcagtggccaattgaggaagtagccgagtgggccggcttgacctgttggtttggggagtgcgccttgcttcattgcttggagtgtgttgggccaaaattggaagattgagctcatgggttgctcttcttagccagcccaaatcgcgaaatacttcatcttcaacctctagcctcccctccagccgatgttgacgatctgatgaaccttcagcccccacatcccatggatctatggaagaagtttttagtggggggtttatggaggtctccatggttccggggttgatagtggggtctgaagatccctctcctcccctccctccccgcgcctccacagtaaatccatccctgctctcacagcttattcccttagctttatttcactttatttttctttatataataattcttcatgcttgtaaaacttcctttaacttctgctgtactcaatggaattgagatactttaagtgccagttaatgaaatgaaactttaagcacatatgaaaacttacagccatgttgttaataggattagggtgcaaactcccgtttttggtagcactttattggtggccagagtcgtccatcaccatcactcatggactgttgtagttgtgttccacattatcgattcaatctcctcgagtgaggtctacattgataggatatcccatatcctcaaaagttaatcaaccaatacataaccagggtcctattagttgaactgcagatggtaacatcttttctcaagttaaggcatacgtggtttagcgacgacatgtagaccatacttgagatgaacagctatcccattgacctcactcatgtctactggcaacgcccatgcttggctgcccctcctcctgtgatcagttgccgccgcctcccagtcaaaatggtagagcaagctcgcgagtgctatctccatggctgacaccccgaacacgatcccggggcaccccctcctaccggcgccaaatggtagcagctcgaagtcctgtcccttgtagtcaatggtgctgttgaggaatttctccggtgagaactcgtccggttgctgcccccatgctgccgcgtctcggccgatggcccacgcgttgatcaccacccgcgtgtgcgctggtatggtgtaacccaggatctgggtgtccgccggtggctctcgtgggatgaggagcgggagtggtgggtgtagccggagcgtctccttgaaaacagccttgaggtagggcagcttgtccacgtggtccttggtgacatgactagtgttgcccacgactgcccagatctcgttctgcgctttgcgcatggcgcgtgggtggttgatcagctcggccatggtccatgccatcatcgtggtcgtagtgtctgagccccctacaaacatgtcctgctcgtgtccgtgaagcaagaagcatatcagctacggaaatttcacagtaccttaacctcaaggtatctaaattttgcactaaattttttgatacctaattaattagtacctggaggtactaaattttatactaataaatacgatacctcccgacactgttttaatatggtaaaattgccctatcagctatattaatattcagtattcacttttgtcataaatatgtgatatttagaataaaattttgttaatcttttaaaactttgatcattaataattttttattgcctagtttgaaacaagaaacatattttgcatacaattaccttaaaaatcactacaattacacctatttaatattataaaattgttccaagataacatgatgatcagagttttaaaacctttggactaaggagtgctagtattccaactagactatagctcgattcataccatgataatagccttgatttcgacggtgccgagctgaatgccagcgtccttgtccgtctcgttcacgtcgagcaacacgtccacgaaatcccggtgatcgccgccgccgtcgtcgtccatacgccggccgccttcacggcggcgacggtgatcgtcgatcaccctctcgaggatgccgtccagcgcctcaaacgtgcgctgcaccttcccgtctatccccctcaaggcgtccacccaccagaaccatggcaagagctcccccatcggctccgtcccgagcaacctcgcgaagtcgtcgaacaccttcctcagctcgcgccccctgtcgccgccgccgccgccgccgcgcgcgctctcgtcgccgaacgcgatgcgcgtcaagacggtgttggagtaagcgatgaggaggtcggacaggtcgacgacgacgtcggcggcggcggcgcggacgcggccgacgagcgcggcggcctcctcctccctgacgcggcggaacgagaggacgcggcgcgcgctgaggaggtggaccacgcagatgcggcgcgcctggcgccagtactcgccgtagggcgcgaacgcgacgtcgcggccgccgtagagcagcagctcggccatggccatcctgggccggctcgcgaactccatgtcccgcgaccgcatcacctcctcggccgcggccgccgacgacacgaccaccacgggaacgcggccgagccgcagcagcagcaccgggccgtgcgccgcggcgagggaccgcagtgcccggtgcggcagcgcgccgagcaggtggaggtggccgagcagcgggagcccccgcggcgacggcggcagcctccggcggcgccggccatcaccgccgtcgtcctcccacctcgcagcgccatttctcgtcgtgtacttcacggcgggaagcagcacgaggtacaggagcggcgcgacgatggcgaggagtacaaggacggcggggaggagtgagacggccattgttttgcgcgcgtgcgtgcaacggaaagcgtttggttacttggttgtagttgcgcgcggcagcagcatgggactattgataatgttgaggacggaaggaagggtagcaaatcaacaaccagaaactggacgggctgacggtgacggcccctcacgaaaagtatattttctggtggtgaatgggagcaagggacaagtgataatgttgaggaatttttcgtttttaaatataactcatctctcacgatgttgtacacgtactatatatactaccgccatatctctaaagtactataggtcccatactcccatccagaaaattttctctattatacccttcaagtagtgctagtggtagagccataatttttctggaccttaattgaattaataaaattttgcctttatcttctaattttttgaaggtttaaaatgaaatttcaatgaatatttaggatcggctacagctctacctgctctactcctatctccacccgggccttcaagtaccactccaatcctaactatacatcatttataaatgaatggaactattattttttccttaaattttaacctatgctaaaatatatagaatgataagtactccctccattccataatataatgcacaaccactttttttagatgttctataatataaggcatacatgcatgtaggccattaactatgatcacttcttcattaaattattacttttttaaatcctccactctcatgttctctaattctattctcactccctccatacttgtaaaggaagtcgtttaggacagcgacacggtctctaaaacacaactttgacttcttatttctataaaaatatttattaaaaagtaatatatgtaaacttttatgaaagtatttttcaaaacaaatctatacatataatttttacattttcaaaactcaacaacttgagagttattcatgatttatattcccaaggtttgacttaaacattatcttaaacgacttcctttatgagtatggagggagtatttattaggatgatccaaactacaagatgataataattattttcttggtctttgagttaggagtggttatactttatattttggaaagaagggagtattttcgaacggagagagtacatgttttaaatttgtttgtgcaaatatgcatacctcgcgggctagggagcgcgagggacgagggagtcgtcaccctcgaagacgtgagacaaatggaagagatggtggtgcgatgccatcacacgtgaccgctcgtggatcggggacgtggaaccgacgcagtcgcgcaaattggtcacgccgaatggcagacggatcgatggcgattaaatagcgtggtcacttttcgtccagctaattaactagcgtggttgctttcttccatagatttattagggagaaaacttcaaatctggcgctcgattgttctaaataaatcaaatgatccaaatgtttcagttgaccacggtaaaaattaagttacacatggtggaaaacaaataaagtcactgaatcattgaaaacttttgtgaaacataataaaggcacacgttgaaacatgttgctatcacgtatgtgtcgacgggggatacctgtaaactggatgaatagggtattgggatacgttggtacgaggatatacatgatcgacatcaagcaaacaagaagacaaggattatactggttcagacccctcataaggtaatagccctaatccaatttatataagattgatatggaaagaccatagattacaaatagagaaccgacgatcccgagattaccggcgagatcccttgtcgagatggtctcgacgagaagtcccgcaagtaggctatggtggttgtgttggcagtatgattcgatgatctaaacccctcagggggtgtgccttttataccgtgaatcaactaagtctccaagtagaactcggagactatggtccccacatgatataatataaaccttatcttctccaagtaggactctgatattcacttgcctgtgagaataatttccataatctcttgttagttttattatcatatacggaaacatatcatatactcgaaggtataccatatccgtatattccataagtcataggatatgaggtatgtcttatctgtaaccatgacagtatgacacatcgagtgttaacggattgaaatatatgttttttcattagaatttaaacatgcgatacttgttataaatatttaattataacaaatataacgatgtaatcggataagtaatttagaagaaaaatcgttttgaagatcgttaaatacatgcaggatggagtggagggagaataggggtgagttttgtgaaacacagtgaaaatacacatgtaaacatgttactatcacgtaatgaaacatctagttttatcataatatagttatacgatatcttgttgtaaagatttaattacaacgaatataatagtgtgatcagattgtagatcaggtaaataattgaggagaaaagtaattgaagagaggaggagggaaggagaagaaactagcttagtgatcaggttgaataaagtttaattttattcagtgaatggagccaccggtccaaacattcttcatttgttaggtatagattcatatagttaagctcgatcgatgaattcgatgtagatttcttaattaaatcttgatttttatacgtgtcgcatcaattttcttgttcattgcgacaaaattaaataaattgggtgccaccaggccaacacacgaccaatccgcgggaccacgtgtggctatagattgcaggccgcatcacaccggtgcctcgtccgcgacggcgcttgggtaccgcgctcagggttagaaattccagttgaaaatttcgaccatctgatatgatattattttgaccaaaatttttaatattttttaatctaaatatatataaagagaacaacttatttctatggttagggtgaaacttaaccattgtttcgcagcagcttgcgagttatatgtagtcattatcttactcaattcaggaaataacatctccaggatcaatatccgattattttgacgattgaatttcaccacatcagcgtcaatggctgaagtcgaattgaagtgaaagataccgtcagatagttactgagttgtaatttgtaaatcagttgccggcaaatgatcccacttaggcacttaccatcagaacaacttcggtgatgccgtgatggtggatgtcaatgtcagtggtgaaaatacacgacaaataacgtttccttttcctctttctctatttggtaaaatagaaaatatactaccaatgttttttttactaggggtttaatttggccattgacatagtatctaatttataaccatccaccattttatttttatctattttcttaatctttgtacctatttaaaggtagctatatttaaaacacgagagagtaattatagccactggaaataagataaaaattaggaatcgacaaatagcaaaattgtcgattttgaggcatgttgaggtgagatctaattcgatctagccccctagtgcatacaaagttcaaggccgatgatcagcggctaactcaaaaaaagtggcaccatttttttttcactttgtgatttttaattaactcgttctcatataaaaatat

SEQ ID NO: 76272 - DNA, 1551 bp, Oryza sativa
ccaatagtaattttattactatgaattagccgctaaatatgttagaaataattgttttgagttttataaaatccattcataatcataatcattgccaccttatttaattacttattataggagatgccttgattgattgtttaattatctgcccaaacccctccatatctgtactgatagtaatttaattactatgaatcagccgctgcaaaatttccgtatgcatgtacatatgttgcttttttaatctaaagtccttttatattttatatatattacaaataatagtactgagttttataaaaatctatccataatcataatatttgccaccctatttaattattatttatattcaacaaaggccaatgtcgaatccatgagaattattttaatttgtagtaaatatttaaattgctattttttttgtcaataatattctttcgatcctggatggatagcaacgaacgtttcctaaaggcacgtttttttttcttggactaaccagtcaatcggattgattccccatcttccatatcctttctgtttttatcgctccgcaggcggcggcggcggttcccggcgaccgtgggcttgtgacagaggacaccggaggggtgagccgatgacctgattctgcgtcccctgaagggcttgctccgacgacgccggactgatcagcctaccgccggtgacggtggcttcagaatccacggccagccaccattgtttcaaagaatcctgaaaacgtgagatctgcatcccccatccctacatactcatctcatctatctatttaactatcatcaagcatagcttcatcaatccgtgcatttttttttggatagattcaagttgctcatggttcttttaatttcacccatccttctgtagatgaagcggaagggcaagatgccagaaaaagtcaggagtatcaaattcactgaatcacaatccataactacctccctacattcccattttttttttataaaaataacatttaataaaaaccttcgaaattacagcgcacaattcactatcaaagcttccagaaacagtaattttaacgtccagtaaaaattttactaccgactcaattaatatattaaaaaaaccataagtaagggcaaaaatcatcgctgtgcactaattgaatcaatagtaaattgttttctaactgaaaaaatgaggttcttatcgtaagataattactaaatcgcacgtaacttttccctccgtgatgacagtgcgatcgaggatgagattctgcaagcatctatcaacaatagtacattttttgctaacgatatatttatatagtcatagtaaatgagttactaagtcaaaccttcagaggttacaggtgtgacacacgcgttactcggctcgttattgcggaagcaaaccaaataatcctcagtaactccattactgctagaccaaacatcataattaagtaactactttactcacacaaactaaaaaatattactcggttggttagtgcagaagcaaaccaaataatcttcagtaagggctgcaggaatt

SEQ ID NO: 76273 - DNA, 3583 bp, Oryza sativa
attcgcaatgcgatcatgcaacagcagcagtgggagcaatttcaacgggaacataaagattaaacgcatctgaatcatatatatatccatgatggttttcgcgacgaatctgtgggcacggctcctggcatggttgacatatacgatatgggaaactgttaacagctcgaatagacgtccacctatttattacatgtccagtacgatatactattttctcatcattcgcaatgcgatcatgcaacagcagccgtgggagcaatttcaacgggaacgtaaagattaaacgcatctgaatcatatatatatatatatatatatatatatatatatatatatatatatatatatatatatccatgatggttttcatctgtgggcacagctcctggaatggttgacatcaattcgtccatatcaggaattggattttcatttttagaaaggatatcctcttttttttatactacttaaatagtcatagaaaagcttataataatttgataacatatattagcatgaaatatatcactccatgaacatataaaactaaattgaacttctctacaagttacaaaacaaaaaacaaattaaactgaaaatagttaatgcatatacatagttatatttattattattaagtaacgtgaacggagaagttgaattggtatttacatgtttgtaaagtgatatattttatattaatctattttttttaaaaaatttttatatgactatttagatgacttataaatctgcatatagatcatgcttaaattcatatagaaaatttagtttttattttacaaaggaagtaacatggcagctagtgcatccgtgcgagcctccagtttgcagtttatctatctgctctattattactgcataccaagaggagtttatattcttttttggtgtcgctgcatatgcctaccgcacatgatggttgcccaccgaagcacgtacgggttccctcgtgcaccgggtgtgccaagaggagtttatattcgctcttaacactgtgcagaactcttgacacgtacgtttccggtgcatgtacgttttgtacttcatttctggacgatactgcaaattgaatagtgatgatagcctgtatgttgaactcttcttccctcccgtctctctcaaatggataagataagagggatatcgatgtatatatgttcatattcatcttcttatttatttatttatacatcctatagttcaaaaaagttgtttcactcatttttcattctttcattcatcactcaagcgtcaagggtccagatcatctcggtaaaatccaaacggcggagatcgatcccacctcccacctctctcaatcaccgcacgccccctctccctcaatcgcggaatcgccgctctctctctcgctctccaactcgcacctgcgccaccgccaggattccgctcccgcacgcgctgacgccggaaagagctccgccatcagtgctcccctctctatcagccgccgcgccgtcatctgcatcgccgatctgccaccgatccccgccgccggctcgccctacacgatccccatcacccgtcctctgccaggattcacgtcgtcgccgatcaccgtcctggtccaccgatccccgccgcacgaagtcctcccgacgccaggtcgccaccgacgccttccgcggtgatccgatctgccaccgatccccgccgcacgaatcccttcccgtcgccaggtggccgccgacgccttcagcggtgatctgctcctcactgcagacgtcgccaggaatatcttcatcaccctcatgccatgcggcccttcatcgcatcgcctccgccaaggcatatgggaggtatgggcgtctgatcattaagaataactgatgagatttgaaccatttttgagaattgctgtggcaggagttttttgcagttactatacgactcaaacaaaaatgcatgtttgctgccatatttacattgttcatttacacatgtacacctgggatacgcttttcagaagttttttttttcaaattcatatgctcacttgctgttattctcttctagatagacttgttagaatttttgttagaatttatctcgtggtttacttcctccgtttcacaatgtaagactttctagcattgtccacatttatttacatgttaatgaatctagacatatatatgtattcagatttattaatatctatatgtatgtgggtaatgttagaaagtcttacattgtaaaacggagggagctgaatggaaacatcaaacccgtacagataacccattggtaaaaggcatatgcagcggcccattgaggttttgtcacaaactgtacttccaaaaaaacaaaaaaactttggctcattcgttctttaccgcagttcatgtatttgattccattgaactttcaagaacaagtcccaaatgttgcatgagaggccgcacgtctactgtgacagctcttttgatctcatacatacttatctttcatctcatgtcctttcaagcttctgaataaacttataagatctgttcagtgaagtttatgtttctatttgttccgtttgggtatgatttattcatcctaaatgttagatcatttacttttaagcaatattacacaagcagctgcaaacgatggccattctgttaatcttgtgattttaattgttcctttttgttgatttttcagctgcactaactatattttctttagtatgtgttatggcacccacacaggcttttgtttctagagaagagtatcaatgataatttcttctgacatggcaggtaaatctccaattcaagggggctctgcgcctttcctcaacaagaaaaggtgaattttactactgcaactataggttgaatgcaactatcttgagtcgaaagttttcaaatatgagttgaaagttttttaaatctgagttacaagtttttcaatctcgagttgaaagttttcaatcttgagttgaaagtttttaaatctgagttggaagtttttaaaatttatcttacaaatttgaattttgagttaaaaatttccaaaatttgagttaaaagttttcaaattttaaccttaaaatttaaattttaactcgaaagttttcaaatctaacttaaaaattttcaattaaaaaaatcttttcttaatacattcattatccttaactaaccgaattagttacgttaactcattgaaaaaagaatccgaaaaaaaagaatctgcgtggcgtgcgcgttgccggcacgtacgcgccggctaccttttcactttggcaacgcgccggctaccttttcacttttgggtaaaggtgcacgtgtgtatatgggccttgtgttcgcattttcacttttgggtaaaggtgcacgtgtgtatatgggccttgtgttcgcattttcatttttgggtaaaggtgcacgtgtgtatatgggccttgtgttcgcatataattatatgggactacctatacatttgtcgacaaatttttctctaaaaatttgatagatgtaattatagtacaatcgtagtgtaattacactggtacttgtttgtgagtacactgtaactggaatgt

SEQ ID NO: 76274 - DNA, 8120 bp, Oryza sativa
gcgaacgccatgtcgcggcggtagaagagccgctccgacatgcgcacctggggccggctcgcgaacgccaggtcccgggtcctcatcacctcctcagccgcggccgccgacgacgccacgacggcgggcacgcggccgagccgcagcagcatcaccgggccgtgcgcctcggccatcgaccggagcttccggtgcggcaaggtgccaagaagcgggaggtgcccgagtagcgggacacccggcggcgacggtggcagcggcagccgccggccgccatcgccgcagggcggaggaggcctcttcttggtcgacgagacgatcagccatgagaagacgagcaggagcacggcaaggaggaggggtgagtgcaacagagcagcaagcgacgagagctccatgtctgaacgagtgtactcggctcgatccgcttgtgtccaatgacagtgatttaacatcgccgaataatttgtgttgatggaaaagccaaaatgctggttgacgtgattaaaacgaagacaaaaatgtagctctcgcgtatagttgttattgtagaaaataagcgtaaaaggacatgtctagtggttgcagtgatctgagtagtatcctaaggttttgagtttaaattttcatatgagcgaactttatattaggttatttgagggctaagtttctaatttataaaggttgcatatatccggttagatgtagaggccgtgtaaaaaaaataccctttctctaaaataaataaaataaaataaaaaaagtagaaactaagcacaatccttccagagaaattggaaaagtcacgacagtaaattgaagtctacaattctatatacacagacggcccgtttggttggagggagttttcaggagggattgggagtttaaaaggataaggatattaactgctttgtttggttgggatacatgggaattttggtgggatgggggtgaggaattgagggaggaactccctccttttcaatacctgggtagggggtggtaattgggaaggaattcctcctttactttacctaaataaatctcagccatccgttttcattaatgacctaatttccaactaaactccctatcaatttccaccacctctaccaaaaaagatactgggattaaaaatcaaatttctatcttaatctcaccatcaattcccttgtataaactcccaatccccttccctcgcgttgtcaaacaagccgtctagaacctctacaaagtccatatggaatcaccatcatgttctcaaaaaaaaaaagaaatcaccatctttggaccatgcattatatggctggaaataagtctattttggtcactcgtctatttaactccctaatcattggaccaggtcgtgccgggtcggcccatcatgccgaggcaaaggcccaagcacggcctaaagatcgggtcgtgccgtgcttgggtcgggccaaaaccccgtgccatgggtcggccttcaacatccacaaacactgaaagtcagtgtccgagtcggtatatgcatggtagaggcccttccggccatatccgttccctggtgcttcatgtttgatcacgaaagtggaaataaggatgttgtcgtatcatacggggtctgttgtctctgagttctacttggagactaaggtgatctgcggtataaatacatatcatcgaatcttagtgcaagacacccaccacagcaggagcaatccagaggactacttgaaagccaacttgcagataggtctcatcaagtagttctcgacagggatctcattggtagtctcgggatttttgttgttctctattgtagtctgtagttttcttcataatcccatataaactagattagggttattaccttgcgagagacctgaaccaatataatctctgtctcttatgtgcttgatgtcgtatcgtgtagatcctcgtatcaacataccccaatatcctcagaatacggtccgcgagtatccccgtcgacaatagctgaggaggctcgtgacgcggtcgcgccggtcgccgttgagccgcaggggtgaagtgtggtcgagcgggacgagaactggcgggtcaaggacggatcaggaaacgaggtagcggagcttgtccttgaagatgacgagaaggggatgatccggggtggtgggcgcggaagcagaggaggaaaccgtagtcggagacaaggcggcgccaccgcttgtagacgaggaaggcacgagagatagaggacgagtgcgaggggaggcataagaggatctcttggatgaggtcattgtcatccggcggagagccaacctctatatttttctttatctctcttctccatataagattatattagccttggggtagtcccaaccctccacctcaactagtttacataacattaatatactatcacataatcaaaaagctaggtggcaagaggatttactgatgagagaggaaaaaatattaagaaaccatttttcatgaaaaaaattagttttatacaggaataaagaatgaaataagagaatacatggacgaatgcagagagaaaagaggtgattaattggatgataatttattatgaagaaactatctatcgggtatacagtttttatgcatgcttagtgtctatatgacagataaatatggattaaaaccattagataatttctaggttgggactgccccactattatcattgctctaagttcatgtgcactctatctacgtactaagccattaaatgctttactgatattatgaattcatgttataccgagaacataatatatattgtgcttaactaaaatataaaaagtatacactaatgtcaaagcaaatctaacggtgaagcacgtgtaggtgcacatgcacttaccccttaaatatagatgaccctcgctacacaaattatatgttgcaataggcacagatggtagctagcctgcctagcagctttcatactgaacacatcaaacatcggaagaccatggctttgcgactagattcagcgtcgtcttcattcgcatggacagcccaaacagctcacccatgtccagcctcgccgccgtcgccgccgccgctccgtcggcatgtggcggtagctcccagtcgaagtggtacagcaggttggtgagcgccagctcgatgctcggcgcggcgaacccggcgccggggcaccccctcctcccggcgccgaacggcacgaacctgaagtcctgccccagctgcgccgcgtactccacctcctcgccgccgccgtcgagccaccgctccggcacgaactcctccgcgcggtcgccccacgccgccgcgtcgcggccgatagcccacacgttgatgatcacccgcgtccgcgccgggacgcggtagcccagcagctccgtgtcctccaccgtctcgcggggcacgagcagcggcaccggcgcgtgcagccggagcgtctccttgaccacggccctgaggagccggagctcgccgaggtggtcctcggtgacttcggcgccgccggaggcgccggggacgccgacggccgcgcggatctcgcactgcagcttgcgcatgacgggagggtggttgatgagctccgccatggcccattccaaggtcgtgaaggtggtgtctgtggcggccgctatcatgtcctgctttttcattgttcatatgcgtcattcattaataattgaaatgtatcttaaactgtttcaggttacaagactttttgactttgatcaaaatcaaactattttaaatttaactaagtttatagaaaaaaataataatatttttaactcaaaacaaatttattatgaaaatatatttaattattgatttaaagaaactaatttgatattataaatattattatatttgtcattaaacttagtcaaatttgatgtagtttgattttttctaaagttaaaacgtcttatacctgaaacggatggagtaatactgcagtagttgtattgaaaagtgatatgaaaaattgaaaacacggtttaatattggcaattaatatgcatcacgtatcactatgactttgaacatgatactttgaaccagagccaagatagatactggtgtggtgtggatttattgtcatggaaactaggattatactccgtattatttggactttgatgaagtggaatatttagaagatactccatgattttgcaaaattatatgagacggtttcgatcgcaataatcaacgtgtcgtgtcacaacgaaaggactcaccaggataatggccttgatggcgacagtgtcgaacagcagcacttctccggcgccggcgccctcctccacctcgctcacgtccagcagcacgtccacgaagtcccggtgatcaacgttctcatcgccgtcgccgtcgccgtcgccgccgtccggctggctgaggcggcggcgctcgcggtggtccgcgatgacacgctccagcaagccgtcgagctccgccgatatgcgcgccgccttggcgtcgaggcccatcagcttgtccacccacgccagccacggcacgaactcccccaccgtcgccgtcccgagaagcgcctcgaagttggcgaacagctccctcagcttctcgccgccctcgtcgccgtcgaggccatacgcgccgtcgccgaacgcggcgcgcgagatgacgccgttggcgtaggacatgagcaggtcgctcaggttcacggtctcgccgccaccgcgaacgccgcagcggcgccggacgcggtcgaggagcgcggcgacctcctgctccctgacgccgcggaaggaggcgatgcggcgcgggctgaggaggtggagcacgctgacgcggcgcgcctggcgccagaactcgccgtatggcgcgaacaccatgtcacgcccatagatgagccgctccgccatgcgcaccctggcgcggctcgcgaacgccgcgtcgcgggccctcatggcctcctgcgccgaggccgccgacgacgccacgacggtgggcacgcggccgaaccagagcagcatcaccggcccgtgcgcctcggccatcgaccggagcttccggtgcggcaaggagccaagaagcggtaggtgccccagaaacgggacgccccgcggcgacggaggaagcggcagccgccagccgccgccatcgcctggcttcttcgccgacgagaagctcagcaaggtgaacacgggaaggagcaggagcgcggcgaggaggaagagaggtgagtgcaacacggcagcaagcgacgacgagagctccatttctgaacgagtgtactctaactcacctcgatccgttcgtggggaatgggaacaaatctacactgaaagggaaattgtttgtgatgtacaatgtttgtattttttttttctttgaaacgagatttatttcaaaaaaaaaactaaattcagacaataaagacgaaaatgtagctctcgttggggaagcatcggtgatgtgctgacggaattatgggtgtatgacttcacctactgtagtttaaatcctggtggctgtaaatattacgcacatgtaggtgagcttaaatattggtgcccacgactattacgcacatacaggtgaactttcaacaagactttaataatttcagtagtatgtcgttggtttctgtttttagagcatgtgttaggggacgcgtaggttttcaacaggactttaatgaaatcaataatataccgttggtttgagcatgtgttaggggacgcattcacatgtgtgagtgagatgttacgtgtgtgctcacgtttgccatgtaatcaaaagaaaaattgtagctctcgttggtcctggatatggttgaaagctcaggacaaatgcacgatctttccagagaaaaaagggcaatttcacaaccgtattttctattttttgtggccaaaaaacagaacctccaaagtccaaacgagcaatgaattcgatggatcaaaatgtagtacagagcacggacatgaactgtacatcaagcaagacataatggaaggattgtattagcaagtagcaagccatatagatacagatctggcacgctctaccatcaaaatgggcagagaacagaaccagattgataggttgttctgtcaatttacaagctttcacagaacatgttttggtctctccagatatgcactgaagcaatcaaacagaaaagatatgtgcactgcagcaatcaaacagaagggtagaaagactaaaaaggtatcccaactctagcatctagcagatacaaaggtaggagtaaaaacagttacaaatgaatcttctccaattatgttggagcactaaaaaaacaatatgtagcattggacatagatagaggctttcaaactaaagatatcacacagtggaagaggtgaggatgatgatctacaccgatccggtagaatcaactggcgatatcgctggtgccatatcttctagcattcacagcctgacgagcgctgttgccttccagcacctccaacatcaattgtatcaggaagatatctacaaaattatagcaaagtgtcattgaacggcatggtttgcactttgtagttcatctctgcgttagtacttctaaatgctccccttatcaggaaaaagaattgagtttttttaaaattgatgtttctactgggaggctgcaagatacaaattttacctcgatttccattagcaacgcttttcaaactgctaaacagtatatttcatgcgaaatctttttatatagaagttgctctgaatatcaaataaatccaatttttcaagtttaaaataattaaaacttaattaatcatgtgctaatggctttctcgttttacgtgtgcgtacttaaatcttcatcttcatcagattcaaacagggcaataattaacttacatctcctcttccggttcattcttgatagcattccttgctatacactcaaaagcagcctccacgttgaagccttctttagcagatgtctcaaaataagggatgtttcccttagaagcacaccaagctttagctttcttctcagaaacctgggaagaacaactaggttaagaaaagcacaatgcaaatcaggaaatcagaggctaaaggcacttctatgaggacaaatactcacagtccggctattaccaccatcaacatcaattttgtttccaagtacaacaaaagggaaattctctggatctgatgggctagcctgcattgagaataatgattcaactttcaataaacagattgcagtacatttggaattttgggtaatcgataagtaagctacttacttgaattaggaattcctcacgccagctgttgagcctttcaaatgacttggtaacattgacatcatatacaagaacacaccagtcagctccccggtaaaatgccaccccaagactttgaaatggttcttgtcccgctgtgtcccaaatttaagttccaggtaaacacaagtattagcgtaaatgtagacagaattactgtttgacaaatgacaaggtattactttgattgccatacattctagtatttctatgatttataacacttaaaccagcagatattggtaataattatcaggtattgagctataacagcaaacgttggagttactttgctgatttacgagttagatacaaatcgaaaaccacagtctttgttccaataaatgtgggaaagtgaatataatttttggcactgatggactactatcaaagagcattatgggtgtggatattttctccaacttgctgtaaagtgagggtatcattagttccacatagtcaagatgattctctactgcagttgattttgtcttagaaaagcatttgccaattaataatgtaatataatatttactactccctctgtcccaacatatcttcaagcgtttgaaatttgtctcaaaatataaggacttccatagtactacttctcccaccaactaacgctcatttaattttcacccaattttaccccaaaccaccttcccactccccaatcacccaacatttaatgaggagcatcatagtcttttcccttcatcattaatctctctcaagaaaaaatctagaagtccttatattttgggatagagggaatagaacagaatagtactcgcttttcacgaagggaacaacacattg

SEQ ID NO: 76275 - DNA, 2189 bp, Oryza sativa
ccagttacgtacaacaactgtcaggcgactcaagctcgtgctgcccaccggtggtgcttccattttttcccctttgtccgcaggaaaccgccactatggccgttaccatctttcccctttgtccacaaaaaaccatcgctatccccatcctttgcatctgtagtgatacatggatggggataaacggaagacaatggatcattttataagatttcatctcttcctcctcttatggtgacgacgttgcggcctgctacctagtcccgctttgctcgccctagggtcacactcggccctcaacccatgctcactgcgttccttatggcgaagatgcggagtcgaggacgacgacagatcgacagcaccgacagcggtgggcaggcggcgatgtcgagcggagttgatgtgtagcggccacagcgcactgtgttgaggggaggtggcgacatgggacaaggtgacggtgctgggctaaggcgcacggtggcaggcctgttggtgagccggcgacggcattggatgagggatggcagtggcgatgagccacatgggaaggaagaggggtggttcaaggcggcgacgaagtggaggcgtggggtgctcaaagcaaggaggttgtccattggtttcactaatcctactactaatccatctgctaatccaactcacaatgtaggtcgttagatgagaggatccaacggttaggaatgatctgggtatattttgttaattcgttttgactttttccgtagccaaacttaaccaagttttttgataacatatttgttttgtatttaaaatgctatgctaacttgattaaataaagtttgattagtcaaaacaacttataatatgaaacagagagtatatgcctactaattactaattgacttactatactagtaatatgaacgtgctaacgctacggtgatatttcataaaacaatggtgatagacagaaaaatagaatcatgttgagaatcaaacaactaattatacttgttgctcaaagtatattgatttaaaacccattgcatgatcagtttcacttgagcaatcaaagcgtaaggattctttgaaaaataaaatcaaccacatacaacagtagtgggagaccatagtttacagggtcaataatcatgttttctccttttctagcctccaaagataggaacattgattcaattgtttttaaaagagtaaaatacacggccggtccttaaacttgtagggatgtgttatctaggtcctcaaaatacaaatccaggtcctagaacttgtcaaagtgtgtcatgtaggtcccaaatcgtcacagctcctccaggatcttacatggcactgatgtggcaatgacacacagacatgacatggcataatattgaatgacaaatgagacccacttaaaaaattttcatttcccttttttattctcttttttttcctttcttctccttttcttgctctcactgcagctataggccaccgctacacgggttgctcaggtcacagagaaaagagaagagaataaaagaaaaaaaaagagaagaagaaaagaaaaaaaaggaaaaggaaaatttttaaatgccacgtcacgttcgtgtggcacgccacatcagcgccacgtaggattttggaggagttgttgcgatttgggacctatatggcacactttgacaagttctgggagttggatctacattttgagagtttagggacttagatgacacacctctacaagtttaaggaccgcctgtgcactttactctttttctaaactcccaagttactttagaaaggttgattttgaagatcatctgatttctaaccaacattttttaagatgttggagaggtggttgaaaaccaaagacataaaaattacatgatttggtacaagacaatcacttgttaagcatccaaactacccttcatcatgctcagaagtaaaagagagctgaaactcacagattcagaagtttggatcactgaaggctgcaacatggactgttcacttcagaaaagagtcgacacttcaaatttatctacactgatcacacaacctaatagattcaccagacaccaatctaatgacatatattttgacaaaatatgtagcagagaaagtactaatcattcataaattacaccatgaacgttgcttaccacgtagagcaacaatcgacagaaagc

SEQ ID NO: 76276 - DNA, 662 bp, Oryza sativa
atgtgtacttgtctttttttttttgatttttgatttttttttttggctttaaagaattggctcgactcaaatcgagccgatcgggcttttttttttttttttgcaaatcgtatacctcaaaggtgtcggttcctaaaccggcacctttgagtcatctcatcagtgccgccttggtggtgctggttgggaaaattggcacctaaggggatttcccaaccggcaccgaaggctctttctgtggtagtgaccctggttttgttagcacgtttttcaatctgctaggtgtatttcgtgcgaaaactttttatacataatttaagttgctttaaaatatcagataaatctattttttaagtgtataataattaaaagccaattaatcatatactaattaatggatttcttgttttcgtgtcctagctacttcatctttagtaaaaacgagcatcaccaaactatgttccccggactggttggagagtggatatattttaaactttcgagaagacgttcccttgttgtttacatatcactcaaaatagttattaaaaaatttaaaagatatattaatatataatatatcagtatttaaaattcaacttttacaagttgtaaaaaaaaagtacagctagttaatgtatattgatagtcatttttttttt

SEQ ID NO: 76277 - DNA, 1577 bp, Oryza sativa
cgtaacataatcctcattgtagcttatgaaaggagctatgcaatatggcttccaaactgcgtaaatagagtggaataaaaacaattttctagtaaccgctctatcccttctgtcatatttgtgttttacatcttttgtgatctcattaacgtctccaataagcaattacatgatggttgcacaggtatctcacatctcacactaaaataaaacaagagtaccaagcaaaataattacatgaaacctaaactctaactgtcacaagcaaaatattttttcttttgagcaaaacgattttactgttcccccaatattatctgaatccattgttgtctagtagaccaaacctacagtactagtagacggtcaagctaaatcaggtctgcacgatttggcaaaaaagcaattccgaccacaatcagtcaacggtgcatgtgcatcacgccctaatccccaattcccctacttatctgcaaagatctaagcaccccaataatccccccaaaacaaactatcaccgcgcaccaaaatccagctgcgatgaagctgcgaagtgattctgggaaagcagattagaccgaacctgcaatgtgaagagccggtcgtcgatctgcacctccttggtcaggaaatccgcgccgatcgtcgctttgtactgattgctgaacttcttgttcacgtacctgaacaacaaaaacaaaatcacccaaatcattcaacatcgcgaagtcccccttcaaacaacgcctaaaaaaaccctcaaatttgacgaatcggacaacgcaagattgcgcccccttgatcttactggttcatcagagacgtcttcccgaccctgccaacgagaaaaaaaaaagagacgcatcagcgatcagagaaacagaataaatttcgcccagaaagaatatcccccagtagaaattgaacgaaaaggtgggggattttttttgctttttcgcacccgctgtcaccgaggatgatgaccttgaggagcattcgcctgcgcgacgccatgggcgcggatctggaggcggcggacggatcgggcggagcacgaggagggagaagaggaggaggaggagaaggcgagaagcaaagagatgatctttgcgcttctctttgctttgggattggcgtctcttgtgtgctcaagaaaaaaaaaggcgtttttttttggagggatcttttgttcgtttgttgcttggatggtctggctaatttatttatgagatttatttcgtctaaagtgcgttttgaagtagtagatgattagtcacacgtggaatataaaggtaattaaaatatgattaattgagtattaatttagatagttgaaaagtaaattaatttgttttttaaaataataaaatttttccacaaaatacatcgttcagcagtttgaaaaacatgcctatagaaattgggaaaatggtcaaaaccgaaacgtagtgtatacttgtggatgctctatcaccctctaaattttgtggtggttggacaatggagtctgtgtatgtattttggtttctgtaataccctttcgcttacttcttggagaatggagatattgtttgtgg

SEQ ID NO: 76278 - DNA, 32555 bp, Oryza sativa
gtcacatatgcatgcgcccgcgcgcctcggtttagcagttccatgctattttggccggcccccttttttccggtcgaggcacgtactgtactgtactacgcgctcgctctctctctctctctttcccgtccttcctcacatggtcgacccgtcgccctctcactgtgctggtcctgcacgccgttttcgctgctccccggcgaaattttgttttgcgcgtcgtgtacactccatatgcgtgtacggtgtaatggcacgtgaaaaatttctctggagcaccggatatatatatatatccagatgcactggtcgacgggctcgattattattacacagggaataataaaaaaaaacgaggatggatgcatgcatatgaatgcatcgcacgtcgtggcacacgggttttttttgtatcggtccgtgggggctcactcactcacacgctcgatttcttttgcctttgcttgttgtttcttcttcctcctcctcctcactttgagtgtcaaaaaaaaaatactagtacatgagtgagcttaaagtcgaagcaatcacaagggaggcgtgcatcagtacatgcatgctagcaaccgagatacaggcttaccgacacttggtcctccaggatgcaaacaacaaagttcatagctcgatagattgacttttctctctctctctttctttcctttttgcttttagatacgttgaatggagatcgagcatatgctcctgaaaatgactaaacagctcagtccaacggaacaaataaccacataacctcgcactgaggacagtttgcgcatctactacattcaagttacacagatatactactgtatgtcaacttgccaaggcattgattctgaaaataaatgtaaaggaaagttcaacgcgacgagcccgacgcatgcagatgctccacggtgtgtgtgtgtgtcactctctgaacgccaacacagtaactagctggacgcctggagagctaaaaacagtgacctctcagctgcctgcctcacttatctctgtttcagactaacaatggaaccttgcttgtcctgaagacatgaggcccagctttaggtgcacactacactgtggttgtgtttagttttatgtgtgtaaaatttttaaatatatgaatacacatttaaagtattaaacatagactaataataaaacaaattacagatttcgcctgctgcaagacgaatttattaaacccaattaatctgtcattagcaaatatttactgtagcatcatattgttaaatcatgacgtaattagacttaaaagattcgtctcgtaatttacatgcaaactgtgtaattgatgtttttgttaaaaaaattttatctaaacaaggcttataaagctagtacggacgggcagcgaggtgtcagggcacaggcaatcatcgcagaaaattaaagattatgtgtaaacaggcaagcacggtgtttccaagttgagcacttgagcatccggtacgcggaagggagaaagccaataccgggtggattttctcatgaacgtcgcgacctatttattcggcgcgtcaaaagatcaatgttgatatcgatcaatcggccaaggccaaaggagacgaccacgtagccacgtaggagtaaaaagcaacgaggcggcgtcgcggcgatactttcgtctgctcaactgtcggaaagggtgcaaggcaaatactccctctattccaaatttataatgtcgttgattttttacataacatttaatcactcatcttcaaagtgtgaaaacaagctaaatgttaaaacctcgtaaaaatcgtatctgaaagtttcataaataaacgaagttgagtttggagctgggatttggtgagaatgtatttcatatctacacccatctctagtatttttttcatgaatttactaaacttttaagtatgattttcatgagtttccaacacttagctcatttcatcggatatgtccctatttattttattgtgaattattttatcatcaaataaaatacaaacttaacttattctttaaacatatttatattaattttttaataagacgaatgatcaaatattatacgaaaagtaaaccatatcatatattttgaaatgaatattttgaaatgaagatggtatgaacaaatgagtacggaatgtctgaatcactgacccctagtagaacagttgtggtcgggtagctttggctaggtgtatattaaggctgcgttcgcttgggtgtgatatagggtgagaaagcacctcgttttccacgcgcacgcttcccaaactattaaacggtgtattttttataaaaattttctatagaaaagttgctttaaaaaatcatattaattcatttttgaaatttaaaatagttaatactcaattaatcatgcgctaatggctcacctcgttttgcgtatcttcccaatctccccaatctctttcttctcaaacacaccctaaatcagcccggttgctcatctattctcttcgtcccataaaaaataaacatatgaccggatgtgatatattttagtacgataaatatgtacatatgtatatctactatgatgaatctggacatatgtatgtctagattcgtagtattagaatatgtcacatctagtactagattgattttttatgggacggagagattaccttgtactgtgactgtttttagctagcaatgataccctttgtgattgtatataagcagaatgtagggacacccacaccctatgaagctaccagtctactttacaaactttggagtttttccctccgtgtcccacgatatagaaatgtaagcatcagatgagatatttcatagcacaatgaatcaggacattccttgttcagatttattgtactatgaaatgtcatatctggttctagatttttatattatggaatgaagaaaataataaaatgatcactgtccaattcattgtaatataaaatatcatatctggttctagatttttatattatagaacggagggagtaataaaatgaacgtgcatcctctatacggtattgccgatacatttgactgtccgaaactttagcacctgtgagcatatgaacttctaaggaagaaacacaatcaaccgtcacataatctctctctctctctctctctctatatatatatatatatatatatatatatatatatatatatatatatatatatatatatataaactcgagtacgttgcaaggcatcaggaactttaagtacatctttcttgatatgcacaaggcatgaaaccaccacgacgaatttaccttgaaacatgggaggtggtggagagcaaaagactccgggggcagtgtgagtgagtggcgaggccactagaggcggctgcctccttgtgcttcttccccttggacatctaccaccgcacctagcaatgccacatacctaccaggaaaagcagcgcatatgcattgctttgcttgccacatttgcgctattctttccacttgtggcatcacacagaattcgcatcacttgtccttgaaacattttcaactcaacgaagctcctctcttctatgagatgcccgcaaagcaacagtggttatcttttgctatgctccatggaatctagtacatatataccgtatatgcaaacgcatcaaaagaaaaggaacctagaaaggacaagtagacctctaacatggcgtgtttagcaaatgggcagcatctaaaacaataggatccaaccaatatgccccgagtgtgcaatggaatattggaacaatttgtgaggttcttggagctcgcgccgtcgaagaaatcttctccaacattgcacttgaaaagctgcaaagacagagaaaaaaaaaagaagtgggctggttcttccggtaaaggagagggaacgaatgggatccaaatcaaccagttggggcgtagaaaaaaaagaagaaagaattcaggcaatcaaaggatcgaccaggaaaaagacggcatgttacgtcggtggcgcaacttgaatcaggattgtgtggatcgcaattggaagaagggggagatggaaaagtcctggaaaaaacaaaggagatggtacatggttgtatgtggccattgatgtgaggtcacaatcgtcaagtacttctttatggcctctttttggagaattatgcagtgtccaataagcgcaataagcaaaggaacagcgagttccacgtaaatctgacggccgcaagtggccctttccagttctgaactgtcaaacagtttaccctagtcgataagtcattgtaaagcaatatgagtgaacaggaaaacaattatacgagggaacaggctaaatcggaacataggatcctaccatagaaagcaggcagattttggagagcagaaatcgcacatatgacccaactgatggaaactataataacgactttagaatggaggatggcgatggtgatggtgaagaaaccaccatttaggtgtacagtgaaaatggcatctttgatagttttggtggcagcacgtcatacaggatcataagtactgtagcacagctcttgacaaaaaaatatatactcaatagtcgaggtacagaaaaaaaaattaaaaaatgtgccaaaacccaaaaaaagccgacaaactatcctgacaaaactattaaaacatgtgatcttcaaatgacctaacatcatgagtttattgcttgctatccccttgctggatacttgaatcatcaaagtcaagaaggcagatggtttttcagaatctgaatattgttttgtcattttcaagtgacacggcacataatgctttacatcagaaccaagaggattgtttatatagaaagcatccactaatcacatagaaatagtccacaaattattgtcaaagatatcaaaactacattgaaatgctcaaaagtttgacgctatagttcattgaattaccgtttgctaaaaaatatataaaataccaagatggaaagggctgtcaaaacggttaaaaaatcactgtacatgtatagtccacccaatgcttagatcgtaaggtcacaatatgagctttggatatcctccagacaattttataatacagcactttatctctcagtgcttcaccaaatctgccttgatcctacaatggaactttggaagcattaagaatcactaacaatttaagcaagtataccatttggtttttagaagataacttaacattgcagtctgcagatacttttccatgagttgtcaattaaccaaaactgtctttatcttactccgatacatcgaaaaggaacatggacatttgtaagatagaaaacgaggaagcacgtaatttcagaatcaatgcaaagaaaattggtaatacaaaagccaaatacaacaaagttacaattagatgtcccacgatatcagcagactacaaagccccagaagcctaggctatgaaaaaaaaagccacaaacaggctcgagacataaatagtcacaggctaaagaaactatttcgaatttgggccctaaacatggcctgcaagattttaacccagtccataaagcattcctatacaatactatcagattttgcagttcagattgtaaacttagaaggaaacaatatcaactacattcaggggatagtaattagctacaacagtacaagtgatgtttattccctgcattcaatcactgacttggacaaaaaactgttggacacttggaaccatcacatgccaaatcatcataaagaagctttgtgtgttaagaattatgacataaactataaaagaacgtgcaaatcagttaaacccagtaaacatatctcaacaaaagaatacaaacaaagttacagaaattaagctgatagttgtgacttgtgagagaaccagatggcattcatagcatcatcctgaacttaatctgccacttgcatcttcaaccttttaagacttattgtcctttgcaacaaatatggtaactaatatgatatccacataaaaaagctcacactaatcattccaaaacacttgacttttcaaaagtcaaaccaagtacagagtagttagtactgatatcattttttgttctcagaaaagaagggaaaacaaatcactatggacttgtttgcatcaggcctttagtgcactaatcctctggttctaccattgaagtatctttctgcttattaatcttcccagcactattataataataatcatttgttcattttatgtttcattaagggatcattcagaataattcaaaggccattaaggcttgagaactatcccacagagctagtctgtaaaaaaaaaaccatagaatactgttctatgcatgctgatcaatcattaatgtgtgatctttcctctaaaccaaacaatcacacctttcaaactaaatctaagattaagtacttttgatcactgaatatgaattaaaattatcaatagtccctcagattaaactaaaggttcaactgttactaaattccacatgaccacagaagacattaattagaagcagtgaaatgatagatatatgtctagttattatgaattgtctgtacataacataattcatcaggtaaagtgtaagacaaacatgaatacccatgtacggccaagttaaccttaaagaacagtggctacatatttcacatgaaaatacttgaaaataatatgatgtcattaaaacttttcacaacatctaagtttgcaatgctactacaaatcaacccaggcaacaattttgcaatgcagctgcagcatcaagaaagcaaacagccccaggaataatccaatttgacaattcttcacaatagcactatcaccgataaatttgatattgagcaacaagaaaatatccacatatgccattaagatgagtggaaatactcaggcattcaggcttatattgcttcaaacgaaatcttcaaaccttaaattgaggttctttgagcatagcagataacaaaatgattccgcgctattcattgtggcactataattctataattccattgattcacacaaaaaagaatcagtgagacatatttgcagtaacaacaatagatgctataatacaactcagcactatatcctcatggttaagaaactaattttccacaacaagaagaaacaggctatctccacaaggaatcaactgaaagaaccgaacctattaaatgcctggactcctcaatggcgagggctctgtctggtaatgccaactccgccggagaagatgctagcaaaggcctgcaggttctcgtcagaggggcttatgtggatctttcttggtaatggtaggatacaaggcccgcaaaacaccaccccgcccatctctctcaactcctcacgctcctcatcgctccgatcatctgcgccattgttcagcttcaccgcaacgtccagcttgtcagcgcacttcttgttcggcttggctgcaatctgctgcttcttggtcgtaagaaccgtcggagagggtgggggcgtcggaaacgagcggttgaggacgcggagcacgcggcctgctgggatgggcgccgtggagaggccgctgagggagacggcgggggatgagcggagagcgtgggcagctgccggggacggcggcgcggcgacgagactggccgccacgttaaggaggccgtggacgcggccggaggggcggcgcacaccgacggcgaacatcgacggggacccgacgggccgggacaggaggccgtggtcgccgagcaggaaccgggcggagccgaccagggagtcccccccgatgtgccagccgccggcgggcgcggcgtagatctcgacggtgacggcggcgcgggagtcgtcggcgagcgcggcctcgtggacgcggaagaggaggcgctcgtgccactccgggtcgaccccgcccgcgcggtccggccgcgtctggagcctgcgcgccgcgtccacccacgccacggcgtacgcctgcagcagccgccgccgcaggccggagggaggcttcagcccctgcgcggagatgagggtgacctccagaatccgctcgccctcggggagcgccagcccggcctcctcgtccggcgccgcctccatcatcgccgcccaagcggcgtagggtttcttggtcggcgcctccgcgctccgatttggggggtgggggttttccgcgcctctcccgtttcgtccgtttcccagagagggatttgaacggacggatggattgctactggccattgaccgatcgagggtcacaaataaaccccgccagattgaaagcgtttgacagctgcacgaaaaattctcaaataaaaaggagggtattccaaaaaattcaatcacattgcatctcacacacgccacaagccaatggctgtgttcagttccacgctaaaattagaagtttgaagaaattagaacgatgtgacggaaaagttgaaagtttgtgtgtgtaagaaaattcgatacgacagaaaagtttaaaatttgaagaaaaaaaagttagaatctaaacaaggccaataagaagatggtactcggatctaaatgggggagttcacaactatgggggtgtttaggagagaggggctaaaccccctatatatgctctactctatctatctaacgtgagttctaatataagtatagtatttctagttagtggcagaatcagccaattaggacctggcaatcctatgcagctgcataaacaccatggtttgaatcaatagtgtagttgctttgctccgtaagtctgtgttctttgctcaatgttcctgtcggtgatatgggaccgggagtatcatgaccagaggcttgaggtagacgcaatcgcccgcgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggttagatttataccaggctttatcctaaccattacaggcaaggtgttacacgaagaagggcaaacatgcatcttgttaaactgacacatggtggacaagaatgaccagtctgacactggtcgcgtcagcaacgggcagccacgatcccacgttgcgcccgtctccgccgggagtggaggtaggtgtgggctgtcccatcgaagtgtcattcggatggaaaccgtaccgatctccgcccattaaagagaaaaagaacagtccagtttggaaagagaaaggtgcatgtggtatccccttgagatataaaaggaggaccttgcccatttagaggggggatttttttcccggattgaaagctgagaacgggggagaagtcagcggacactttgtagctcgttcatacacagatccaccaaaacacaggagtagggtattacgcttcgcggcggcccgaacctgtatacatcgtcgtgtctcgtgtgtcttgccgacgagtaatctgaccacatacagagagagtgagagcttgagatttcaccctaagcccccggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaagccctaagcagggggaggcgcttgagagggtcgacaagtccgcagcgtcaccggccgcaggtgatgcaggagaacggcgagacggggagcgtcgcctcctcgtctacggcgacggcagcacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtatcatcaaggcggagggcgcggcgagtggcggcggctgcacgtcattcggctgccactccctcgtctacaccgtcgactcgggaggatcagcatggggagccggatgcccgcctcaacatcgggcgccggtgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaacgtccgttggcccccaaggttccggcccaccatcaccgagaagtacgacgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacgtatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggacggaccgttccggcgacgagggtcatgtcctcgccgtcgagggcgctccgcgggccacccgaaaggggaggcctgcgagcgacaaaaagaaagaggccggaactcccggcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggtggttccatccggcaaacggcgaggtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccctggtggccccatctctgtccgtggcgaccttaaagtcgcgcttgcttgcattgagcagcgcgcggaccgcctcgctgctgcgtccaagcccgagggtggtgacgagaggcttggcccttctgcccccaccgccccgaggcagcggatggccacttgcgacgaggtcccggtcaaggaggttgccttgggcgacggcccatccaagaccacacggatcggtggttttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagctttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcgtatgtcgatgacttggttgtaaaaacacgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcattgaggccaaccccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatcttagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggaggcggccctccacccgcttgtcaaacggtgctgggtgcccccgaccctcaggaaggccccgaggccactgagggaaggctgcacttaaagccctttggccccgaggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgcgccccgaggggccacttggacgaagaacgccccgggggtacggcccctaacgaggaggatcggccccgccgaaaggtgcagcggcctgtctactttgttagtgaggccctccgggacgccaagacccgatacccacaggcccagaagatgctttacgctattctgatggcctcaaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccgaacggagacgtcctcagatatttggtccgtctcgactttcgagcgactaacaatatggcagagtacgagggactccttgccggactcagagtggcggctggactagggatccgccgcctcttggtattaggcgactcccagctagtcgttaaccaggtctgtaaggagtaccggtgctctgacccacagatggacgcctacgtacgccaagtgcggcgtatggagcgccattttgacgggatagagcttcggcatgtgcccagacgggataatatgattgccgatgaactctcaaggctcgcgtcctcgcgagcccagaccccaccaggcgcctttgaagaaaggcttacccagccgtcggcgcaacccgaccccttaggggagacggatgcgcctaaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccatggaacatcgaacaccttcgtcgcttctacccctgaaggggggggtcgggtgtcaggttttggctcgggctaaccccgcaccccccctcgggtgtgcagggttagccgggggctaccacacatgcatatatattcctttcagcatttcaatagaagcagtttcaatttcctaaaggttgtgtctgtgccgttttttccttttgaagaatcttgacttgaaataatgtcactcgtgctcaaccttgccctcgggggctcggttcggtcggctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgcgagcccttattccaagctaagtcgcaaaaggaccatggcacagatcatcctcaactcatatatatagcaaaataaaactaacacaaaaatttttcatcatttctcattgcagattaagttaaaattgtacaaaaaagaggcatgaaggccttagaagaaagaacaagaaaaaagataagagtggcgggggcctgggggctcattcatatgcgcccgggtcgccggcctcgtcgccgccgtcatcctcatcgctggcgtcgccctcctcgtcggagctgggggcgaacgcgagcaaaggggccgacccctcgaagccgtcgacgatatggtcggcagcatcccggacgcgcgcgcgcgcgtcatcctcggtcccgggagggaactcctccagcgccatccagggagagaaatcggggtcccgggcctggtaactcgctagcacgagttcgaccgccccccgggcgaggtccctcgaggatgacttgatggtcttctcgagctcctcggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccctatctcgcccgccaagcggagggcctcggcctccccgatggaagaatccagcgcgcgctgcatgtcagcgacggtgtgttcggcagccgcgaggcgagcggctaagtcgctttcgcccgcagctgccccgccgataggcgccctcgcggccagctctttctcccgtgcctcgaggttggcagcccgctgctccagcgcggctctctcggcacggacgcattcaaggttgcggcgcgcctgctcctcttgcgccgcctcgcggagggagaggctgttcgccagccgttgcgtcgtggcctcggcctcctcgagagctcgctcccgctcagcgagtgcatcctcgcgaaggcggagcgcggactcctcctcggcgcaggcggcctcatgcgccaccagcgtcgcctctcggagaccagcggcggcctcgcggcccgtcaagcccctctccacggcgccggcgtgttcttccagcgccatggcacgggcctcaagggcctcttcgcgccgccgcaacgccgcttcagcctctgttgctcgctgctctcgggcggcggcggcgtcgaggaccccctgggcggcgtcgagcttgttcttcagctccgcctcccagctcccgtgttgaaggcggagggagtcctgcgcctcgatcatcgcggtggtggcgacgagggcggcctctcgctcctcctccacctctcgggcgatctccgccagcgccgccttgcgggcttcgagctccgagatgtggcggcggtgggccttacggcccacctccaccatggcgtccaccgagcgccgcccctcctcgacgcgcgcccatgcggcctcgagctccgctcgttccgctcgcaaggcctccacctgggcgctaaatccatctagcaccacggtgtttgcggcggctaaggcctgcataatgggctcggcgctcaccggggcaacggaagacgaggagaaaagtcgccttggagaaaaggcgacgcggcttggccccccgaaagatgcgctgggctcggggatgtcccccgggcccgtttgatcctgggcgtcgcccggtgaggtaggcccaggcgatgcgcccgcggcctcgtcgcgagccgcctcggaggatgtcacctgaggaccgcccgagggagtgggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcccgggcggcatcttcagcttcccgaaggcgggctgcggcttcacgccggtcagactctcgcctccgctcctctgcggccgccggatcttcggcctcggactggccagatttggggcggcgggaggaatgcgacgggacatcgctgaagcagaagaaaaaaccgaaagacgaacaaaatgagtaagaaaaaacttcttttttgggaggaaaatggttgcaatgagagtgagacgaacctgcgagggggtcggttgaatgaccaccttggaggggaaatcaggtttccccggcatggttccgtctcccccgtcttgcggagccgcttcttcttgcgcaccccctcgggctgcgacgtcggcgcggccccctccgggcgccgactgctggcacgcgccgccccgccccctcggggaggagatgtgggaggtgttcctcccagcttcctcttcccctgggcgtcggcagggcggctgctccccgagcccccgacgcggggcccagaagcgcgaccccctcctggggcagattgttccccccggcggcgctcgctcgcgccgtcgtggtccttaggggctctctcctctgaggccccgacccccatcataatggttagaatggaggcgcggtcgggatcgctgcagagggggaggatctcctgaggaatgcgagacgcctccgcggagctaagattcagcaccctttgaaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtactcttcccccagatctaccggcgcccgccagctggagacctgcgccgggggctggctcggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccgaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactcaggcatgaagcggcgcggcagtccggcgtgcctctcgttcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacgacgcatgaagtggatatgcggttgaggcgatcgaaacggattgtatcgtgcgcgcgttaattacgctcgccgaccgaagcggcgttgccgtatctccgggcgagacgaatctgctcgcccagattcgcgcgctgctcaagtggtgtggcagtcttgaatagaccgcccattatggacaaccaaagttaccaataccaatgtgcatggattgagaccgttgggtattttgcccaactacggagaccggtcccacccgtcaccaggctttaggggtggcgtcacacctgaccgcttcccttgggaagggaaattgctctggcataacgccgggggctactgtcggtgatatgggaccgggagtatcatgaccagaggcttgaggtagacgcaatcgcccgcgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatatatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcacgccttgccccatcccgtcaagacgaaagcctctaggcaactcgtctcaagccggagctagcgtgttatctcttagagatggcacgttagccctggttagatttataccaggctttatcctaaccattacaggcaaggtgttacacgaagaagggcaaacatgcatcttgttaaactgacacatggtggacaagaatgaccagtctgacactggtcgcgtcagcaacgggcagccacgatcccacgttgcgcccgtctccgccgggagtggaggtaggtgtgggctgtcccatcgaagtgtcattcggatggaaaccgtaccgatctccgcccattaaagagaaaaagaacagtccagtttggaaagagaaaggtgcatgtggtatccccttgagatataaaaggaggaccttgcccatttagaggggggatttttttcccggattgaaagctgagaacgggggagaagtcagcggacactttgtagctcgttcatacacagatccaccaaaacacaggagtagggtattacgcttcgcggcggcccgaacctgtatacatcgtcgtgtctcgtgtgtcttgccgacgagtaatctgaccacatacagagagagtgagagcttgagatttcaccctaagcccccggccgaactggcaaaggggggcctgcgcggtctcccggtgaggagccacgagctccgtcagttcccaacttcaccctactcgttttccacgcgcatgctttctaaaccgcaaaacaatgtattttttacaaaaagaaactttaggaaaattgctttaaaaaatcatattaatttatttttcaaacaaagctaatagttaattaatcatgtacgaataagtcactccgttttacgtgcgtgacgaatgatttccaactcagtttgtcaaactcatcctaagagtaagtttaacagtatagcccactactaactccaattcatctatagccgatctaatagccaattcatacaatagttgctttctatactattaatatatggtcccacctctcatacacacattgcgtcttgaagtccgtgctacagctagctacagatctgtagctcgctgctcttctctctcatcttttatctcattaaaatatgtttatagttagctaatagtctgctattgtatctgctctaagtgatgtgggtaaatccacaatctttcatggcaacgaggtgttcttttatacttttgatgcttatggattgttgtcagagatttttctttcttaccttatggttatgttgactctttcatgatcaggatattcatgtaaattgaacatcgttttacattaaatttgttctaggcagccaccatgaataatcattgtatacgctctgattagttgtcatcattgttagacatgcccagacttaggagtctatcagatttatttgacagatgaaaaacatttctaaaacctaagaaatatacatattgattggtatagttcatgacttcatgtgattaaaatttggtgatgttatgtacctattgtattgcagtggtttggtagactaatagttctcatgagtcgtgagaccatcgagccttagttccgtcaacatgcaaatccacgtgtgcaatcatagcgagagtaaatctccctcctagagagccatcacagtggtggtgagcatcccaacggaacggccaaattaggctctttaaatatctatatagccagctctccaactaatttggacagtcaaacttgttacttactcaaacagcctctccatatacccttagtattttgagcctctgacattaggacctatatgtcagtctctactatcccttcttcctcctcttcctccccctcttcatcttctgattttatccaccccttcctcttctgatcttcgcccttcaacggtggtggcggcgcatactacagtggcggcagctgccgcagcagatggtgacgatgacggtagatggcaactgcagccccacgcgaaggtgacaaaaatcgcgcggaagcagcagaggtcgcaccctccccgaatccacgtctcgctggccgaatccggtgggggcggaggccgcgtgcctccctgaatccacaccgcgtaggcctaatccaacaaggacgaaggtagtggagaccgaccggatggcacatatgacggctggtgatgacgacctcggcaacgatggcagtggctggcgacgatgacctcgacgacaatgacagcggatgacgatggttggcgacagagcaaacaacgacagtgtcagctggcgacgaagatcttggcagtagtggcggatggcgatggcaatctcgacaatgcaggcgcaacggctggcgacgctgcaacgacttcagccggcggtgggcacgggcggagatggggacgacgacggcgagctctgcgcagatccagcgtgatggcgctgcagaggggaggcggcatgtcccggcggcatcggacaaggagggaggttgagcgtgagagaggagagagatggtggggcaatgtttagcatgtcttttttggttggccaaatttggctagtgagggaggagtttggctagtcatttaacttggccatccgagtagaaaggctattggagtgcgattttatgctaaacttgtcaaatttaacttggatagtctgttggagacgctctaaatatagtgtctgtgagtctctgagagagagggtagtaaatgtttgtctagacctgaccatcacaacgttgtatagtttctttaggcagttttcataaagggagcaaataataaatatttacattgagaccggtaaacaaaaaatcactggcttgctctattgcattttgttgggtctaacaattttggtcttatcgcccatgatagctcttgcatgagacctaatttcttcaaatttccctctcttttctccctcctctaagtaagtatcaggctaaaatttttttatgtgatagtgcaattaattatataaagatatattaattgtgatattagaacaactctaagatcacttgaaagagaatgagaattaaatttgaaaatatattgttcattcaattttttctcagaaatatttgggatacaatttattttgaaaatataccgtcgattttatacaaccgttggacgtaacgtcgagggcgcggtatcgcgaggtataagcgcgagaccgcggtctcgcgcagcaatgacgcaagaccgtgcggtcttgcggaatggaagagcgagaccgaacgatcccgccaaatcaaacagcgacactgtccaatggcttcattttattagtgattaattactcaattaacaattaattaataataattaatgactaattatcttgattagcgattaattaatccagaataattgatcgctaattaaatcggcatgccacggtatcgctcattgcttcagcgagaccaaatggtctcagtctttctttccacgagaccgcgcactctcacactgttcatgcgtggtctcgccttttcaccgcgcgatatcgccctcgacgtcactcccacatcattttcgcgcaacggttgtgcgagaccgacaatatatttctataaaaaaaaattgtatccctaatatttttttaaaaaaaataaatgaacagtatattttcaaatttaattcaagagggtgattcggtagtttagaacaaataagttggccaggcgtcgctaatgatcttgtctataaccgagtgccagatattatacgtagatggatttaaaaagaacaacaaaacaatgtcactggcatgtttaaaaatatggatgcgagtgggacggataagagcatcaccaacagatgctaaaaatctaccctcgcaattttgtttttaagattcctaatcatattttgagatatgaatagattcataaatatcttaaaaatctgattctagaaaataaaagtgggtccacactaaactaccaatagagatcactctcccctccgatgtacgtgtgtgttactggtagccgatgtgctcccttgttggtggagagcaagaaggacggagaaagagattccaattttaagaaggtactttggaaaattagaaaaaaaaattgaaatcatcttttaagaaaaaactaaaatgttgagattaggagttaaattaggcatgtgttagcgggtttctttttcctgtttattacaataatggttattgttttcttctaaattatgtattggcgaatagaaaatgatatcaaagccggggttttttcaggtaacggattttcttacttgcatccctatttaaagaacttggtacgatcatactgtatcggggaaaaaaacacaaagaattcagcatacagaacgtggtaaaatatgcacgctgagggcggattgcggaggacatatggactttgggggtaccgtttaattgggaagtcaaggccccttggttgcaacggtgagcccatcgcatccttcttgggccaaaataccaggcttaccaggttgcacgcgctagttctgggctatcaaccaatgggaaggacagaggcaccgttgcctagcaaggaaaattgccttgcaatggtagctttagcccctttgatttggaggaaaaacatagtaattttagaggattttaatcctatagaaaaatttcctatgaagccctttgaaacaaagaattgaatcctatctaatcctttgaaattcctatggaatggataatcctatagagattttggaggaaatttagcaagagcttcaatctcttgctaactttccttttgagtctatctctctcatccaattcctgtgtttttcatgtggttcaatcaaacagttattcctgtgttttgcaatcctctgtttcatacttatatttctattaaaatcctacgtttttcctattcctatgttttctcaattctgcgcagggccggtcctgagtttccaaaggcccggtgcgaaaataaacataggggcccttaatatattatcccttaatatattatctaaataattattaatagatctatatatatgatatgctgctgataaatacctaaattacatggagaaataatatttatatgaaaaacctcatatgtataaccttaaatttgtttttgggtacgtatgtatttctagatgcaagtattgatgatctaccaatatcaatttctaaatttcactacaaaacaataaacctaaatgtaaaatcttactaattaattgagcgtgggtggccggatgtgcgggtcactcaagcgcaacctctgtactatacacatctaattaacaagcagaattagaaagctattaatccaacatagccaaattacagatgacaaacagatagcatggaaatttaatttgcaacaaacgagagtaccacaagaacgtggtggtgttgctactgctcacctcctctttcacatgtagtgcagtagaaagcaacctcttcaatattcagtgttgaagatcgatttaaagttttgcacttccgccggcggcagcgtcgtcgcggcaggcgacagccgactgccgatggaaggcgcgtggatgcggcggcgattggaatgtagtggatgggattcctggatggggaacgaacgggataaacggcaggcaggtgctaatgtcaacaacacgcgcggcggcaatctcgcttgtgtatggtggaattgggaacgacgtgctgcggcgctgtgagcctgtgacctatatgatacgatgcctcttcgtgtgtgctgcctttctacgtactgggccaagggaggggggaggtcaggtcggggcccctacgacctgggggcccagatcggctgcactgctcgaccccccgggccagccctgattctgcgattaaaaggggcccttaactgatttatctctatcggcaagacagcttgtacgccgtacgcgggccacaaaaccgtgaccgaaactccaacggctgcagaattttttttatttataattttttttattaaaagttttacaaaaataattttccattttgaaaattaacggaaatagtcgcctaccgcccaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcctgcaaatgggcggcgagggggggcatggaattttgcaggcggcccccttgccgccctccgctagggcgattttgcactgtgcgggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgttgactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgttgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggtgagggatcgacgctccgtgagaggaagagctggcgaacgcgcccgaagaggtggcgaacgcccctgcggagctcgcggaagggccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttgaaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtagggctcgatgatgtaattatcataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactcatccggtcgcaaataagcatgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacatcagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaatagcgccggtgtgtcgtacgccatacctgcatcaaataggttgatcagaaacatataaataattagttcaacataagtaataaatgttcataagcgaattactaacacatattaaacaaaagtacaaacaaacaaaagtgtttagtccgaacactaatcacgataacattatgacacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctccttactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagaaacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaagatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaacctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagatccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaac

SEQ ID NO: 76279 - DNA, 3538 bp, Oryza sativa
ccatttggaataagcctatggagcagaagcttaggaatctgcacaaattagatgtttgttcaattaacaagcacaaaacaagggcaacatataacgtgggcctacacattaaagcaacaactttcagtttgggaacttcaatatcagtgacaaacatttgtttgcaacatactctcttcagtggccccgcccctacaacaagtttgcctagtgcccactcaaactgactgtatcacttttatacatttcttttctcatggattagtattttaatttatcctgaattgcacatgacatttcaacaattctctacttggacccaaaccacttaagcaatatagtaagaagcctcacgtaattatactatgttagcattcaagtatgaggtccatgaggtttgtttgtctcctgtaaatataccgagagctagtaatgcatcacaaggatataacgtcgacagaaattacaagtcataagaatggcaccttccccgtacgccttggatcttcgtatgggagatttcgaacgaccactagcctccataagccaactttgttgtttctgtacaatgagctagaattttttacataagcctctgtttcttcatctacaaacatataaaaacatgcatttgcctttgaaaattcgctggcattccttggatgttgaatcatatcataattccctggaaaacggtatcaaagtgtgagcagacaagcagaatgcaatcataattaatactattactgaacagtgatgttaccaaaaatagcagaagctacaaccagctcacggcatttctccatctctaacagatcatcatcattgatatcaaatccagaaccttggccaggtttctttcctctaacaaagctgataaaacagcacaaatcatttcattcagcatacacatttcagccattaagttttggcagaagttctggattaaatatgggtaagaagatgcaagtaacctacccacagtggacagtcatagactcactaatgtcaaaagatttatttctctgctccagagatggatgcccaccaaatacagagccctgatttgagaaatttgcagtgatgttgtcttcaaatacataacttaagttcttaaggacaggagatggtgaaggttgtggaggcataagagcgaacgcctggtctacaggcacgtagcaaacatcacatgctacagggaaaatgagaacatatcttacgattaatgacaagtcaaacacaaacaaacttgcaacgctaaccaaaaagatgtaaagaactaagcttacgtcgtggtccagtgcgtttcggatcaaccaggggaggggcaactgagaaaccttcacaaggatgatgtgtaaagtttgcaaatgaaagacgaagtcgatttggaagttcagttttgttgacgctactagcagagaattggtcgctggacgtcattagaggccttgtcatgctgggatacacagagttctgtatggtatttgcgacttcatagttatttgcaatgatcattgaagcattatcatctgaaacaagtcaccaaaccaacaagtcaatgactatgctttctaacaaaaacatatattatttttcattcaagaaacatcattttcttttgaattccttgaataaagtacatgtttgagaattccatagtaaaagcatatggcatgagcagctaacgtcccttgatagttaggattggcagacaatttatcatatctgaggctcccaagtaatataacaaattttagtactaagtgggagggtattcggtgatcaagacggaggccacacagctctgcaagattcaatctaccatttcaaatctaagagtgtgtagttcccttgaccttatgaaggtctctaaccatcaagaccacttgtatgcatcaaaacctggtttatagagaagtactctacctggaccaagatatacatgacactgccatcagaccagatcacagacaacaacatccaattagtctagctgatccgcaacaccacaaaactgagacatgtaaatgggaggcgatcacacgatcagcataggccagtatgtaaccagaatgaatgccgcgcgctattgattcccaatgtttagagcatcacaaagacataaactaatctggatttctgcaagcgtgaactgcgtgaccggaacaaactgctagtacaaatgcccatttcgctacgaacagcagctagggagggaagcgtgcggcgcgaattcagcgcaggcagccaattggcagcggcgagaaagaaaagggcagagcgcgtacaaacctttgacgacggcgaagatggagcagaagacggcggcggaggcagcggcgagcagcagcagcaccccggccctccggcggcccaccagccgcagcgcgcggtggagcagctgcagccgctccttctccccgccgcctcgccacccccaccccctgcccccgcccttcctcccgccgccggccgacgcgagggagccgtagctcccgcaccgcatccccagcgtcgccgccgagccactcatcgccaccgccgcagccgccgcctcccctctctcatcccaatcgccgaatcacacggcgccgcaatcccctccaccgaaacacgcgagatcccgcgagctgtggctggcaaccagatcagacaaggcgccgcccacgcggggattagaggatgcaggtggagcaccgacgcgcgcgcgcgcgcgggcggtgggtgggtgggtgggggttagaagcgcggcgcgggcgcggcgggcggcgagacggggaggattttttttgccggttcacggagctggaacctaccaccacaccagcagcagcagcggcagcagcagcatgtgagattcctgcgcgcgagcgcgcgtgacgactcactgacgagacggcgacgcggtggcctcgtcgtcgtcttcctcgcggctgacgagtcgcctggcgctcgcgtggagtgtagtgtgccgccccgtggtgacaagtcggggaggttaaaaagcggcccaagccgcttcggttaaacgccatcactactagtgatgatgacttgatgagtgatgggcaacgcgatcttcagtagtagggtaggtgcacgtcagagcttgctgctgatggacgaaaatattacactttttatttctcccttctttttaaaatatatagcaacctaataccctctctgttttttataaatgacattaatatttaatgtgaagtttgatcgtattattaaaaaattatataaatatcacttcttttattgtgacacgttttattattaaagaaacattaaatgtgtcttattctttagcacatttacactatttttctaataagatgaatgatcaaatactattttaaaaaacaaaaacattatctactaaagaaacagagttagtactgaattaactgccgaagaaatatgtgataatgattgatgccaaattgccatttggcagattgaaatacctggagagattctcaaaaggatttttttgaaaataaaaaatggaggggatgtgtgagaa

SEQ ID NO: 76280 - DNA, 3096 bp, Oryza sativa
agctacaagcatgtgtgattagtgtggttgtgtgcggtcttgccggctttgcccaagccaaaccgcgttgggtacagatcgtcggtgaccagtcgactatacgtgatcttgatgggtttgtggatcaaagattgacaacagattgggctctttatcttgcctttcgtgggcttttctgctttactattctttattgggctgggcctgatagcagcaaagacaaaccaattctttctttatttgaatcgcaatcggttctacttactacaacctattcatgtccaatccagcaaagttgtcagcatgggagactgagttaagatcaagaaattaacggattcactgaggtaattttacgtgataggaagaacaaggttacagagaaaattaaacgatagcgaaataaacatacaagctgtctcaattgcataacatcttgattattacagccatactcctctaccatataagcatcgtaaaccaatgcaaaaccagcactaactacgtaccacagcaactaattcatctccccatgcaagatcgagtcaatgaattaattagcctagccgatcgatttattcaggcccggtctctgatcttggcgacgacgacgatcgaacacaccaacatggatcaatggatcagtagcacttgttggggtatttgggggagaagacgaagttgccgacggagtagaggccctggaggccattgtcgcgcttgacgaactcctcgaacttgagcggcaggcccctcctgccgtggccggggacggcgcacgcgcgcgacggcgaccggggcacgtacaccctgcactcctggctcgtgaacgacgtcagctgcgacgtctcgatccggaagtagccgccgctcccggccacccccctgatcgacgccacccgccggtgcccgtgccggcaacgcaggtacgccaccgctcctgcacacacatatatacacgcacacgcacggccgccggcgagatggtacgttaaaacaaaacataaatattaggaaagtaccaaatattaaataaatagaagtgggtaaggctttgaacccaaataagctaacccacaatcttgtgaagctagccgaaaaacccctaacagtttctatgttacgtcgacaacgacaccgtgtaatcaagaatattgattttaccgttcttaaaaagatattgggaggtatcatattttttttagtgtaaatttggtgtctctagtattagaaggtacggaaatgcattaaaaaaattattacgtcttgggaggtactactctctcccagaaaaaagcaaatcttagctatgaatctagacatgcatatttccaggttatacgtgtctagtttcgtagctaggattggattattcttgggacggaggagataactctcgaaaactgtaaaatttctcaatggtgaaatgtatggtcggtctgatctgcgagcttacctgcgagcggggacgcgtccatggcggcgaggtagccggggtacctgcaggtcttgcaccacaccatgccctgcacgccgatgctgaagttcaccgtcggcggcggcgggggcaggcccatggcggaggcgccgccgccgccgtcgagagcgagcagcacggcggcgagcgagagtacaacgaacgacttgacgaacaacagtgccatcgcgatcgaattcgccattaattagtcaacgtaatccacacaagaatacgtaataactagctagaagacgacactaattcgctagctagctaagcaagatctagtctggtaagatatggtatagtatacagacagaattaaacacttgggttaactaggatacgttgcgaagacaagaagcgagagatgatggtgcaatttatagcgtgcgtgtgcgtacgtagaagtgcatagacgcatacagtgataataaataaatagtaagaaatttaagatggctcgtgattgctgttttggattctgattagaaggggatcagagagactgtatattcaagttgtgtggaaaatacgagggttcgttggggaatcgagggccaggaaatgatgaactcgcgtgtgggctggagtgcgctgcaagcgatcagtacttcgttaatagcattatctctgtttaattacttgattccaggtgtgttagaagttaaaatacatgacactatgtaccactgtatcgcactactgtggacacatcgtgtttttttaagacaatcacgtacatcggccgttttaattcgcctagtgatcggagtttagtagtgtacactccagtagatctatctaagtaccatgcatccttagtaaaatcacctggttaggcaaatcgaggatgcatgggatcgatgaacaagagtgcatatcttggacatcagaataactgcagtatacgtagcgttcaaggcatcggatctgtttcgatcgggaatgtaataagctgcttaactggtataatcgacgagcccaaagtctgaagtggagcaagtaaatactactctccccgttttatatattataagtccgctttatttttctcctaatcaaactttttataatttaaccaaatttataaaaaaaactagtaaattagtttcattaaattttaaattgaacatattttaatagtatagttattttatgttaaaaatactactgtgttttttcatgtatacttgattaaaattaaaaatgtttgactagaaaaaaatcatatcaatttataatatgattgatggacagtagtgacaatgccgcatatatagattccaaggttgagctattagacctaaaatcccttatattatgggatagagggagtagtcaagtagtagtactccaagtcaccaacgcaaacaaattttgatcgagcagtgtaaaaacagtagttttttctgattccagtacgtagtagctccttgtgttgttgatgtattgtatttgtatcgtatgcagatgcaactgccaactgaggttccgttcggcagttgcaagcgctggcaatctggtctgccttctcgagcgggccaaaaaagcccgttagcccattaaacctgagtcatttggcccaatactcccaagcgggggctgcaggaatt

SEQ ID NO: 76281 - DNA, 5640 bp, Oryza sativa
tgacgtagtccgcgacgtcgctcgcgaggaggcgctccgcgatcagccccgcgggcccttccccgaggttcgtccagtctctcctaaaataaaagacgagaaatcatcgtgttggattcggaaatataccggagggtaaactaatatatggccccgtcgattggattattcacggcatatttgcaaacgtaaaataatttataaataaaacttttatatatgcgttcttagcgatctgaaaagcaaaggcgggaaaataaactacaatgaaaagacctaaaattaactttaaaattaaagtttaaagtttaactaataagtataagtataagcgaaaagatgagactcgtagaattagagtggaggataaactttgtaccaattattaggctggatgaaggcactcgtttcacacccccccaaaaaaaaaaaacttggagggatctgcgatgaccaccagcgccgcggatcattttctgccgtactgatctggatctgggagcttggtgccgctggatcgtgacggttgtacggtagctttgccgggcgagaggctgccggaagaaaatttggtgagacggaggtcctacgctaacaagaaagacttcgtttccaagcgcgacatgtgtgggcaccaatcttaaagcaactccatcctcatcttcaacctcacgcctcacgaacgttctcccattccttgtttgcccagcggctcaccgctgcccccatgctcctaacgagcttgcaaagaggagcacgtgggagcttgcccttccttggtctgccgagcagctcacagcaggacattgggttggggagcagtggcgaactccagcggtctagatgaagaatttgtagcaagcttgactgcttgaatagttgagtacatcgagcacaaattgatgggcagttgagtctgaccgtagggtgaggagcttgctgacctctcgcaggccaccgcttcgcccccaccagtgtgaccttgctgcttcgctgaacaagaaggttgaatcgacgcgttgccctccatgtgtgcgagctcgtcaagatgccgaatgggagtaaggaatcgcctcccgccgatctcctgttctctatgagcgagagcttgccgccagactgagctggacggatcggaggaatcactcatgcgccgtttcatctgtgcaaacggaggaattatctgtgcagctgtaccgaaaggggagaactgagagattgctttgagatcggtagggaacacgtgtcacgttttgaaacaaaatctttctgataaacataagacttcagtcctaccaaattttcttccgaggctgcctggacttggcaggacgctctcctcttcgccccacaagaagagcgcctcggcatcttgcgcgtcggccggacacaaagatttgtaggtcccacatctctcaaggactgaaagcaccgaaggaaaactagtcggattggcccagccgcagcagcccatagttattcggctcgttactgtgtagtcgttggagaaggtatacgcatcggaaacgattttgcgactctttgtgtatttctatttcgggccgagtttagttccaaacttcttctttaaactttcaattttttcatcacatcaaaattttcctacacacataaactttcaactttttcgtcacatcgtttcaattttgatgttaactaaccacatcctcggtacttttccgagaaacaataaaaatgctccattttggatgcccctgaaattggcaacatatatatcccataatcttcgacaaatgcatgcgcatccctgaaattggcaacatatatatcccataatcttcgacaaatgcatgcgctaaacaaacgtcagatgattgaaaaaacattaaagttacaatgttcagtatcaaatatcaaatacgtacattggtcatttcaaggaaggcttttttctaaaaaaaaataaacattgcgcggaagccccatggttaaactccatagctgtattgaagggactgtatcttaataaataaaattatttatttgcttcgaaatacttcaacatgtatataaaactttctccacaaaagtgagaatcatggtaactatgtcgtggcttttttttttaaagaaaacacacaatataaatgcacatactcataatgggcgtacacacccctataaacacacacgtacatcgtatctctattagcacctttgaaaggttaggtatatcactgaaagaatgattagctataaatgcgattttgtagtagtacctaggaaataaacaattaagtggtgttttatatgagtagcgagattttgcagctagaagcggaggtctcatcgtgttcactgtcacgccataattattttaggaattaataaaatgtttgtagaatttatattaaagtgggagtaattaaacaagtgaagttaatatgagaagtaaaatagcctttagtaaattgtggcaatactttactttccccatgtcatacaatactctctggagtttctcagaattttcggagcctaagatttaattttaacaaaacaaacatcattcagtaattatttgaaatgaaaaacaccctctgatcttaggccaattctagcccgtttcccgcctagtgccaccagtccaggaccatttggcccaatagtacttactcacatctaccacccaacatgggccgcagtcggtgggcctatcgaggcagcgtcccccgctcgttgcttttctcctggcatgcaaaagatgaaaaagatttgaaaaacgcctctgaaacaacagcatgatcagatgcacaaactcatcataaatcgaccgaaaggatagacgtactcagataattttttttctcatgacattacactgacgagcgaactaaaaccactgcaaacctaagcgacgagctactacaaggttacaacaaatgctccatcgaccaaaagacgagctagctaatttctacccattattaattccaaataacgtgcacgaacttaattaaaccatgcatcatccaaccaaaccactaactaaattggcgatatgcgtgaacgcacatctcgaattctccatgtcaatatcgatcgtctcatcacatcatcggcacgccggcggcgtcggcggcggcggcggccgggcacttgccgccggtgccggggccgaacatgagcgtgctcttggggcggtacacgccgcggacgcccttgggcagcgacgccaccctctccctctccagcgtgagccccagccacttgttcgacgggatgaacggcgccgcgcacagcggcgacggcgacgagcccaggtagacccggcacctgctccgccggaacacgtccagcctgtacaccatcaccaggaagtagccgttcttgtccgtcgccgtgctcgtcatgttcagcaccttgtccccgtagcacaccagctgcgccgtcgcatctgcaaaatattatcatagagactatgttagtcatggaaaactgttttaatcgctcggatgattgttcacctgtttgatgcatatcatctaaatagctataaaaactttttaaaaaaaattaattacatatattgctccacaaacatacaagttaaaatttaactttaataaattgtaacaaaaataacaaacaaaacttaaattactatatatatctccaaagtgaagattaattaatttctacatatgtaatgaaaatggtttacatctccgacatttgcctacggcactggatactaacttggtaggggagacgcgtccatgtagcggttgtagccgctgaggttgcaggacttgcagtagattgtgccctggacgacgacgaccggctggatacggctcggcggcgaggtgcgcggcggcggaggaacaggaacaggagccggagccggagctacatacctccccgacgcatgagaaaccgggaggagaattgcaaggagcagcgcggccatggcgcagtggatcttggaggacaccatcgttgatcagtgtaccgcacttagctcgagtggaactgaaaaaatgagcagtactgatcgagtgtgagagcccttccagatatgagctaatttatagacggagatggctagggtttcctgccgtttggagtaatttggttggtttgcttcatttgcgatcaaacaactgatagctgctaattgagattccatttggatgcatcgcagttaatgctgttgttggcttatgacagtagagtccgttagggttctaaacaaatgcatcacactactccagtacgctgctgcaagcatgaaagcgtggacgtctttgacgcctgtagatagccaacgcaggatcgaattcgtgaactgccaactgttctttacctggcttcatctcctgcaatttgttgtcacctttgatctcagcatcatatccattctcagagtttttgcttactgcaaatatcggcagaagatactactacacctgaccaagtgactactgcgtttactttgacagagtctgagccttttatcggattcaatccttacaccaacttgacacttctttaccgtgctcagttggatttttcgtgttttttttttacccctgaaagttttagatcgagctaggcagatagctgaagaagaagctgtacatagcttttcggggcgttaaaagtttaatctgatttgtcattggagagcgtggccagtactgatgttcgcgctgaacggcgacgacctgtgtttgtactcttctacatgaacgaactatagagtagttttttgagctgggtatttgtgcggagttgcttctaaggcaggcaagcctccctcctgaatccttgatttctggttctgaattcgttcatcgatcgttactagtcagtactctttttttcccactcagaagatgatctagtcactcgatcaactacttgtcacgaaatggatgcttgtagcagaggaaacgtgaggatatacaagtgttcacgaacagataatgctatcaaattcaaatgtatgcatgaactagggaataaactatatgtctaattttttttcagtaagtttgcctcgactgcaccagttttcagtcgagacaaaatttgactcaggttgactcattgagtgggcatttgggcctgcaagcggaaggcgaaaaggcccatctcggtatctctctttcattaggcaacccaacacgagacgggggccaatttacagtgctattgctcctctattgggactccaattgtaatgcaaaagcccatgaggttctcttttcgctgggctgaaagctcatgtagtcttgcaggagggaaaggctctacatgcatgatgcaactacatcaggacacatcaaacctaaaagaaaaaagaaaaaaagatttggagggagagacgtcattctaaacatttttaagaaaaaaattatgagcgtgttagaaattaaacacggaactatcaagtgcatgtcaggagacatcaaacctgtttttcaactgaaactttgatgaggaggaggtaattgagaagatgcttttcgctggtgatatatattgagcttgcaattgacggtgacctagatttcttgattgagaatctgggagaaatcatgaaatcatcaggagtatgtgcgccgatggaagtacgcttccggttgctat

SEQ ID NO: 76282 - DNA, 7446 bp, Oryza sativa
aattcctgcagcccatttgttttttttaatgattttgataactgttcttattctctgagaaattggagtactagaatttcaggaagcaccgaaggacggccagtttgataggataccttgtcatttgctgaaattaatgaagtttagatagtttggtagctagcttattgagctatagcaagtagtagttcttgcgttcgcataggccggttcccatcccgaacagttggcacgaaaaacggagcggtccattagtacatgattaattaattatttgctattttttttttaaaaaaaaggatcaatatgattttttaaagcaacgttcgtatagaaactattttttgaaaaaacgcaacgtttaacagtttgaaaagcgtacgcgcggaaaagttggaaacttagagttccaaacacaccctaagtgtagtcgtcgaagcattccggtatcgtgaaatgttgcccatgtttctgtatgcgaaccagtaaatttattttttgcatgaagattgaattatctaaaatcacctagatacctgctaactactagtttagattcttgacccaatcaaagttttctgaatttgctagatggaaatttgttttacagagttacaataattcagcaactctgtagcatctggcattcatttttttcccctttcttttgttaatttcttatgtaatacatgtacatttattccacgagccagcaacttgcaatcctacagatgattaattaattaaacaaagagttattgcattccgcaaatatcttcagccttcaggcaagctgaaaatcttcaggtttcagtatatcctattcgcaatcaatcaatcaaccaatcaatcaataatcttaattctgtgttcatttctcgatgaatccggtcatctggaggacgaggttcctgacgttgcggaggtcccgccctttgagcgtcctccccttgccggcgcacatggagtacgccgccgtccttcctcggagcctcctccgatcaacaatggcgtgcggcggcgcgaccataactccattattcatcatcttcttcttcacagcgtcgtcgtcgtcgttggtctggtcgaacatgttgtactcggaagcccacgaccgagaccgccgcttccggcgagaggcggcgatctccaccggagcagacaacgacgacgactccggcgagcccacaggacgacgagccaccggagacggcgtcgtggtgacaaccaccgcgccgtcgtcggagttgtcctccgcgggctcgggccacaggatgtcagcctcttggaattcctccatggcgtcgccgtcgccgtcgccggccgtctcctggacgacggagagaggtcggcgaggagacggcgagggcgtatttatatacggtggtgtgcgctgcaaggaggaggagaagaggaagaagctggcgtgtcttggtgagcaagcacaattccttggggagacggcaatgagaggagcggagcggagtgtgtctgtacgctggaaggaaccgaacagggttgatgtggagtgcggtgcaccttatcgtcggctgccacgtggatagcacacgctaatacagttgcgttggtcatttttgtttttgaacatgtgggtcattttagtttttactgtgtggcacactctcgctataagcccttgtgtagttcccaaatttttttcccaaacacatcatatcgaatctttcacacatgcatgtagcattaaatatatatatataaactaattgtacaatttgcatgaaaatcgcgacacgaatattttgagcctaattagtccatgattagccataagtgttacagtaacccatatgtaattaggcttaataaattcgtctcgtggttttcagacgagttatgaaattattttttttcatttgtgtcagaaaaccccttccgacatctgatcaaacgtcctatgtgacacctaaaaattttcttttcacaaactaagcagacgctaaatccctgagaatgtggagagagtctgaaaatgaactacagttttgttcagactgttttgatttgtgctaatataaggatttgattttctttttaaaataaattatctgaaatattatagcatgggtttaattgggttgtactccctccatctcataaaaaatcaacttagtactacgaatctggacataggatgtctcatattcggttctagattcgtttttttatgggacggagggagtatatattagcgaggatgaacaagttcttttgtgcaccacagcaaaacggcaaaacggcaattttagagtggtgttatgatttctgccaagtttaatcctacgctctctctaactaggtcgcttactgtgtgcccacgtgttgattaacaacgtaacacacgaggtggtattaaactggggtagtccagtttcctggtaaacccaacttgataaatgacaattttcacacggcaagataggtatttacaatccacggcatcctcagtgtttgatcccttttgatatactgaagcatgacaaaatttcccggaacttatttgttcaagtaaaattaaagcaacgagaccaattcaaatcgagctcccaaatcatcttcttacattttaattcctcattcatgatacaaatccagtacttccatggatgcatatacagcttcaacttcataacctgtccttaaccctcaatggcagcagcgcatgcatcatcatccttcgatgaacccggtcatccgcagcaccgagttgcgcaggtggcgcaggtcgcgcgcccgcttgcacggccgcgtccccaacgacgacggcagcgtgcacggcgccgccgccatctcctcctcctcctcctcctccggccgccgcacgccgaacagcagcagcaggtgcggcggcacgatcaccaccttcccgacgacgctgccgtggccgtcctcctccatgctggcaccaccgtatctccagttccaccggtgtaagcgcgctcccctgcaggggacgtccaccggccgagagtgcttgacgcgcggcgtgggcgcgcgtgtctcgtatggctgcaccggcggcgcaggcgagatcgccggcggcggcgcgtcgtcgtcggcggcgtcggtgtcaggccacagcacctcgaactcgtcgagctcctccaccaccatcgccatggcaaggcgtggcaaccagctgccgagagaaagagagagagagctcgcagctcagctcagctcaaactgaggcgcgcgccgcggcgtcgagcgcgtctaaatataccggggcgcgcggcttgcctgcctgatgggattctaccgcgtctgatcggatcggatcgcgagagaaattctggggcgacggcgaccgctcggcgggcgagctccacacgcgtccgcgaaagagaagcggcggtggggaggtgtacgtgtggatgccgcggccgccatcgcgccgcgggctccggacgcggcgaacggaacacacgtttcctctcgccggcacgccgccctgttgcagcgttgcaagggaatcgacgcgagccacttagtacgtgactgatcgcagtgtgcatggtttgattttttttgtttggtgatgaatttattaagcatgggttgattaattgggcccggggtcgtaatcaaggctgtaatcagtgagcagttgggaattgggatcgacaaaatgcaactagggatataggaatatacagtatatgcttctgttctgctccagtgcactactacgccagtacgtagtagtagttgcgcccgtcaacatcctcactattcatcagcatggatccatcaatgatcaatccgtgtgaacagccaaacagggcaattttggctctggtttctgggtggatttaggctggacgtgtttagttacttttcacaaaaaaaaattagagtatacggacacacctttctttgaattattaaatgtagactaataacaaaataaattacagatttcgcatgtaaactacgagacgaatctattacgcctaattaatccatcactaacaaatgtttattgtatcaccatattatcaaatcatggcgtaattagcctcaaaagattcgtctcacaatttacatgcaaactgtgcgattgatttttttcgtccacatttaattgctatgtatgtgtccaaacatttgatgtgacggaatttttggaagtttgaaatgaactaaacatatccttagttcttatcttcactttcccaactcatctccctcgtttttcacacacacgcttttcaaactgataaatagtgtgtttttacaaaaattttctatatgaaagtaactttaaaaaaatatttttcaaatttattttggttaatacttgattaatcatgcactaaacactgctttgttttgtgtgctagggagtaaggttcccaaccctcactcccgaacacagccttatccgtcttcccaacgccggagaaatacccagggtattttagctagattctcatggtgatgggctagacaatctggatttaaagtttcaccccttctaattatttatattaggtccttctctaatattcgcgtatgtcttcccaacgctgcagcagggtgtgaagtcggcagacttgctacaggcctacagctagtgatctccacgactccacctaacctaggttgtgtttagttccacgtcaaaattggattgaaagttttttttaaaaaaagttaaaagtttatgtgtgtaggaaagttttgatgtgatggaaaagttaaaagtttgaagaaaaagttagaaactaaaccagcacctaaacttaggccctgtttgattcagcttataggattattataatctagattattaggagtaagctgaaacaaacaagtagattattatgctagattattataatctataagccagattagtataatccaataatcttttttagaggagtttttttccagattattaagtggctaaatactctctacccttaaatgtctccaataatcccaagaaataaacaactcacaacttattttatatcagattattataatctagcttagagtaatctgatttaataatctagattacaataatcttaaactgaaataccttaaacctgcacggaaatctcgccgggtcaaggacgacgatgagggcgccacggacgatggaccagacggaattggggcagcccggggctggggcggcggggggcggagcttccgtagttgtcaccaagaccatgcgagatcaggtgagtcgtgatgtggacgagtgtcacaactcacaaggatttgttctgaaaaaggacgtccacatcacataaatctcaccacaatcagagccgttcaatcttgatcgaacggcgcagcagacaacgagatgcacttggtcttgatagtgcctaagcacaattaaagccgttcaatcttgatctaacggcataatatacaatgggatacacttgacagtacaatagtaaaatgtgtattgttataaccctgagtttccgtattctatacccgacacgttcctccttccaaatcttcaatagacattttcacgaaccaaatctgctatggtgtaaaaggaaataatctatggttttgctattctctccgtttcatattagaagacgttttgattttttctaaagtcaaacttcttaaaagctttatcaaatttataaaaaaaatgtaacaatatttatagggattaattcgactaacataacatttatagtaggatgttatatagcaatttcctaattatagtattaaattagttttaataaatctaacattgaatatattttaatagtttgtttgttctatattaaacctgttgttgtattttttttctttataaatttgatcaaactaaataagtttgacttataaaaaaacaaattgacttataatatgaaacagaggcaggatctcatttgtaacagattttttactcatatcttttgatttttcttctgtataatcttacataaaagatttatatcctgtagatccaacttatagttgcacccagttatagagcactttatactttgttacttctatatagtaattacactcagctacaatacaataaaattatattttacaactatttttgtctttaaatttacgatttttgacatatttattctttttttatttcattcaaaacgggttgtatctattggttggtaattccataagatttgagcctctaagttctacctaaagatcattagtagtcccataatcaaaggctatcctgtggcgatacgtttcatcccctgcgctgacgtatcacatgctcaatccaagccgctcaaatgtgatcgaacgtctcacggagtcccggagcgggttgactggttggttcctcctcctcgccgagtcgccgttgccgacttgccgtcgtcatcgagttgccgcccgcccgccgccggctactgtacctcagtagttcgcgccggtgcgccgcctcctcgctgccctagacgattgcccgatgcggcagcctcagccgccgccgtccactggcactacggcggcggattcagttgccaccgtggccaaatcaaaggatggctactcatcagggcgcctccgccgccggccatggcaccctgccctgttgccctgaattatcactggcacggcaatgtccggcaacgctgcctccgatgtgcagcgggatgatcacggcgacggcagcatggagttacacatgccgacggcgacttcactgtcggctgtgcactctgcactagtccactactgcagaagttcagagccatatcatcctgatctcatgtttagtcagatcttgcaggccgcaggttatagccctctggtctgtgacctaggctgatcctgcggtgcaaaataatcgatcgaacctgttgattcagtgaagcagattgtgccttctctgctcgctcgtgtcaatttggccgggcacagtattgggatttgaggaaggcgtcaacattaagtttagtttggatcaaaaaattgctttccagtttctcttcttttctttttttttttacatcttcttgtcttgtcattctgtacataaactctttctatataggcgtgaattgtttatgattatttcgttatcaaacatgacaggaaacaaagcaacggttgcagcaaatgctatacaattcagacagacagcaccatcaaaagaacctccttttcaggcttgaaatctctgggaagtgatcagtagaatccttggaactcaattgtcaaataatctcaaccaaatctaatgcagaaattttatttgtacaaagttttaatgctgaaactttgcttttttgcagatgaatatatctttccccacagtatgtgcaaatgtgcaatcagcatctccattgcaacagttacagtatcttgagagttgagtgagttgccacccttgatttcctttccctagtccaa

SEQ ID NO: 76283 - DNA, 549 bp, Oryza sativa
ttgtgatagggttgtctattggatcacctaggtttaggtctagtcgggtggttctatttgcaatggatgaacaacaatagatgaatgaacaaagagggagtgagaggatttagggttgtgaccagtcgttgttgaggaagaggaagtccggccggccatcgtcgttgtcgtcgcgggcttgacgtggacggcggcgacgatgtgctcggttccgatggcggtgatgcggttgcagcagcgacggtgtcgacgacgaggcgtggcgcggcggtggacttcccgtcactggctgcgccccctcgatcggttagggtttatggggtggagtggcggcggcgacaaacctcgttccttgtgtcgttgtaccgtcccgtcctccacccctctttatatggcacagtgtgacgggggcccaccagccattgggctgggcgcccccgatcacggcgcgggtcaaggcccccttgatccgttgggctcaaggggagggagatccatctaatattctcccccttgatctcactaattcctttatcttttctattccat

SEQ ID NO: 76284 - DNA, 19920 bp, Oryza sativa
  unsure (1)..(19920): unsure at all n locations
aacggttaaatatatgctaaaaagtcaacggtgtcaaacatttcgaaacggagggagtatgtcgggtcctaatcgtgtgggatatgtatgatagaaggccgttgaaaaatgatcgataaaaaattaagaactaatttataggtaaaacttttgtatttactcatgatttaaaatccaatagtagtagcttttaaattttaaattttggttgtgcaggctgataaaatatcaagaaaacgacgagggacgtttttttgcacatgatgggtgtagacaaaaaattgtgaagcggagataataactacagaaaattcgagattttagcattattattgatttattgtgtggctcaaatgggagattagaccggagaaacaatgcatgccatggtcaagattgagcagagtccatggtctatatgcatttgttttttgaactgtggtctatgcatatatacatccaaagactactaaacttgtgttacacggttttgaacttggacaagtatatacaagcatgctaatagccagctagtgcttctagtgtccaagacacagagtttcgtcaccgtggagtttaattaggtctaaatttaggtcttcatggaacattccgttaaaggtgccttctttagaccaccttggttaaactaattttacaaattattacaatggctaaactgattaatctaatgttatatattttatctctttgagaaaactaaaattggaccgcattgcaagctaactagacgttttttttttgcaagctttctctattaattcaaaatatgtaggtcagtggcggatcgagaaaatcgatttattgatgtcataatatgtctattggtgttatagtatgctaattatatttagatcatgatgttatattatatggataagcagtttcgctataggttttaccgaaatttgtcggtgtcgcctgacactagatccgtccctaatgtaggtctcaaagcattctccgcttttcgtttttttccctaaaaagaacttattttgtactgtacgtggtttctttgcacttaattttaattcttttgttcatgttctattttccaataatcgcacccctaaatgtccatttttctctttgatttgatgatgactaaaatgtcttcacgtacgacttctactctcgtctttgatccatagctagtacacaaaggggacaagaagaagttgaataatccctttttgataagatgggtgaaaagttaagctgacgttgttgggttaggcgtgacagataaatgccaaacagagccgctcatttcgtaaagatatactacttgacttgaaatcacaagtacacaccaaggacaaagctagatggttagtgagatcagcagtcgagagaaaagacaacttcataagtgatattggaagataagtagtttgaaatctgaacctctgaacatggcatgaaacttcagaacagtttcgtgttgtcttcaagcttgcaaagactattcaaagttttcttaaatgaaaaaaatatattctggccttctggggttcatgagatcgaacggtaggcacggcacaggtgtgtatcatcatgcgaagatgatttgattatttgattgttaatcacgcttaccaagtgttcctgccattcagattctgttggaaaaagcagaactacttctcacaactttctgttctgaacatcagaacatggacaactcatgctagagaacatttgatggagttgcaggggctggagctttcagttgaacttgtctctataaaatggcagttgaatggggctgaaatattgcaactgaaacagatgattttgctgtgaaggtaaaggagtttaggaaactgaatttcatcttgtcagtgacagtttaaggagttcagtttgctccaacatcttacctttggagcctcaaccgatagtggctgcaaatatgtggagatttaggccgcgttctaaactgggtttcagctgtactaattcatcgtttaaagtgagcaccctttccaaactgataaacaatatgttttgtggtaaaactttatatagataagtttctctaaaaaatcaaatgaatccatttttaaagtttacaatagataatacttcctccgtttcaggttataagactttctaaacatctatataaatgtggacaatgctagaaagtcttataatctgaaacggagggagtacttaattaatgctaatggcttatattattttttctgcggctaactagctatcctaaccgctatatagagcgcacccttacttggctagacatcgcatccaaaatctttggcagaacgagaaaagatttggttctctgtagtatctcatgttcacttgccaaacaaggatagtgcagagcagtgatttttaacttctgttcttctaactttctctgaagaaccttgcttggaagctgaatgtgtaagtaggatgggaccaaatcttcagcagttaataagtttcagttaagcaattgattactagttgtgaaatcttgaggacactcttgccaataggtagaatgttagcttggaattggatggagcaacgcttcactgatgaaacctggttctcctcatgcaattctcagcattcagtagtaatcatcaatcaagctgctaaacagaatagccatggcagttactacctcagtcctaaaatatataaaaatctataatcaaatgagacattttctagtatcagattcgtattactaaaaaaaatattccatccgatactaagttcttatatattttggaacggagagagtaagtcggaatgcatcaaacggatcccaatgaaattgatccgaatctacgagagcgcaagcgaatattactacagaatatcaggggttacatgcaaaaagttcttcttcccattcccctgaaactgaaaaagatttggcacgaatcgaaccctccaatccattgcttgcccttttttgtgtcctccagcttctagaaacttctagaacccaagtaagtccaagccgccgccgccgccgcctacagttgcttgcaagccgcattggcccaggtaacacgcccgcgatgtgctggtcattctggtgttgataggaattcacagttttgatctctctgctccattctgtagcctccaggtttggcgctcaccacctgttcgacgaaatgcggcaagagggagcagatgtgcgcggcagccacaagatcaagaagacgactgctgatgtggaaggcgggggtgaatggatcaacgccctcccggaagaggtcctgcagcacgtgatgtcgttcctgccggcgaagcaggccgtccggacctgcgtcctcgcccggcgctggcgccacctgtggaaatccatgcctgctctgcgttccatccatggtatctgaacaagcacgatgtcaggaacctgaacaggtttatgaattgtttgattcgctaccgggaccgcagaatgccactagatatgtgcgagatcaaaatcggtgcttttggggagggctgtggtgaaccacaggttgactcacttatcagatatgcctctgttgcgcaaagctcggataatgaaggtcgaattgcatgagcacaacgataactttttctctagccaagctgcctcttatctcccagcgcttgacgaggttagagcttagtaatgtgccattattatgtggttttgttgattctttgagcttcccagcatggaggccctatggatgaagttctgctatatagacggtgagaagatatcgtctcagtcacttaaagagctgaccatgattgactgtatattttttcgccaatttcggatttctgctccaagtttggtgaggttggaaataactgattgtgtgggtaaagctcctgtgctggaaataatgccatctctagtaaaggcatttatcaggttccgagactctagagatatttgtggtaaagaagaatttgggggtagttgtactaatgctagctgtgataattgtggtgctaatggtgttgacagtggagattgtgtgcttctgaagggtatttcaatggcaaaaagcttggagttggtagctgaacctggtgcggtatgtttttgcctactttgtgcttaattctgttgttgtgtatgatcgactgtttgtgttgtgctatctgtatcgttgttttatttgtttagtatatgtattctgtaaattagcacaatgtggcttatgtgtgtggctaccgataagatatctttaatgtcatgctacatcaaggtggtttatctgtgattactagtataatgtcttgtgttgcaatagatcccaactaaaagtctgaaaaataaaatactacaaatgaataactatgctcaaatataaaacttacatgcatttgtgtatgagaccagttggctacctatgtatactcatctgcaaaaaaattacaactgagaaatctctaaatatttagtatttacaacaagattttcaagtgggggtgggtgtagagcataccgtcaccccgactccctcttctaagttctgaaagctgtgcactaacactatctgtaaggagcatacgctgtgcaatcatgctaaggtccaataatcaaactaaaattttctgaaaaatatcccggtgtactccggcaatagtcaaatactccgtatcatcggttattcagaggagaggaaagcactaacaaaaaaaaattgactagtcaacaggctgcagtcccaacaggatctctgccacgtgtctatccgactggcttaactccaaccgacagcagcagagcagctgcactccggcgaattcgggttaatctgcgtggacgccggcgtcagtcattgagcctgatacgcttcgtcaggccagggaagcagaggcggtgcagcctctgcgcgggttcgtcgtcttccaggctcggagggcgctcgtagtagagcccaactccggcggcattgtcgccgccgcgtcgctcctggaactgcacgctcggcgcgcgcttgacctgcgacaggtgctcgagcaccttccccttggtgacctccgtgctgctcgacctttttctcgccgccgtcgctgtcgacgtcttgtaatggagcttgttcccctggttcttgtacatgagctcgtagccgtggctgggtatctctatgtcgtcggggagcttcctctccttgccgacggcgaccgccgtctcgtagcaccacgcggaggcgacgtggttgatggtgtagccgccgccgccgacgaggagcagcggcaggttgaacccgcggaggaagctgacgcactccgcgtggccccgcaccgacagctccatgccgccgaggcggtcgccggagagcgagtcggcgccgcactgcagcacgatggcctccggctggaacacctccatggccttgcccacgatcggcttgaacagcgtgtggtacacgtcgtcgcggacgccggcgtccaggggcacgttcacgctgtagtgctcgccggcgccgtcgccgatttcgttgatggcgccggagcccgggaagaagtccttgtggggcgtgattttgccgtaccggtggaacgacagcgtcatgacccggttggagtccaagaaggcgttctgcacgccgtcgccgtggtgcgcgtcgatgtcgacgtagatgactcgcctgaaggtgccgaggagctcgttgatggcgagcacgatgtcgttgacgtagcagaagccggtggccttgcaggcggacgcgtggtgcatgccgccggaccagttgatggcgatgtcggaggcgccgtcgacaagcgcgcgcgccgcggcgaacgacccgccggggtagccgcggcagtacttccagaggcggtcgaaggcggggcaatcgtcgtcgccgccgatgccgtggtcatcctccgccttctgccgaagcgcggcgtcgttgaagtagctctccggggtgaggtcgcggaggaggtcgacgtactccggcgagtggaagcggcggatctccgcctccgtggcgggtctcgtgcggaggcggcgcatgtcgccgagcatgccgtagacgccgacgaggctgtgcgccatggcgacgcgggcgggcaccatgacatggtcgtcgctgaatttgatgtgggcgatgccggggtcgtagtagtagcacacccgccgcttcttgtcatcggcgcacgacggcgacggcagcgagttcccgccggtggccatcgctccaagttccttcttggaagatcgagatcgaacagaatgcagcaatggtgcagaaatctcacatggatatacaaaagggacacatgagtctctgtccgagtcggcaacgaaaaccgtatcgtaaacaaacaaactagctagtcgagataagttttaacaaccagtatgataaccaattgagaagtaccgtgtgctagttttctgtaaccaattcgatcaaagctgtatttctatgagcttcagcaagcaacagtgttagtattaattcttgcagacccaaagcacacactttcagaattcagataaggacttcagcatggacgtcgtcagctcgatcaatcatctgctagatctctgaacttctcagactgaatcctacacaagcacgaagagcatattagttcagataacctttggcatatataaaaaaactttgaattgcatgataagggactttgcagttgataaaagtatatactatagaaattattacatgctcccgattactaaggctctgttcttttggttgagttgggaacccatccctccggtacggaaaacgaagcagtccattagcacgtgattaattaattatttgctaatttttttttcaaaaatggatcaatataatttttttaagcaactttcgtatataaactttttgcaaaaaacacaccgtttagtagtttgaaaagcgtgcgcgcggaaaatgagatgggggagttgggaactccaggaaacgaacagagcctaaatgagctgtgttttctcctaacagaatcattgaagagtatgatgttgaaagtataggtataatgaatgccaaagtacgggccagttcaggagtgatgtactcaagtcgccaatgattcatttatttggtcatgcacaccagttaatggaatatatatgttcctcataattggacgcaatctagttgccattgttttaatgagtgcatccaataggtgcgaaatgtgcaagacaaactagacaataagatttgggtatcatattttgattggtttctagcaagaatgaaacgattagaagaagatatttgttncnngtccaacaaaaagtacctcgaggtaccggtatctcataatgcccatcatgcccaggtagatccaacgatcggaaacgatttggtaccgtgagataccggtccctcgagatactttttgatggaccggaacaaatctcttagaagaaaacatgaatatttgagacagtcttttagtaatcaaactagactgcatgattcattttaaagttttcgatccactcaaggagaaattactttaatccattcatcgtataaacatgaatatttgagaagtctgttagtaatcaaactattcatcgatcagccctaaagttacagttcgtatcaaactagcctcccgtagggtccctcgctagtaagtactagccgtgagacgtttggaggctaggttgaagggaggagggactagaaccttcattgcttaactaaataaaatagaatactatcacttttagtgggatgattaaactcctgagaattaaaatctaacttaaagaaataaatttaccaagacaagcattcaaactaacaaaaccaatcgtatcactaataagaaaaccttccaaggccagtctttgtttacttattgataagattgctggcttgctgtttatttgcctgagaggaaagcatctctcatgaatcgggctggtcagctgtttatggtaaaggtggttcttacagctgcacgcccacacctgtatatcaaatgattgatatggatctcccaaaaaagggttctcaaagcaattgataaattacaaagttagttttctttggaagggccagagcaggtaagtggaagcaattgcctagttacttggccagagtagctcgcctatccaatatggtggtctaggtattcattatgtaatagttcttgaatgatccctaaggatgagatgactttggctccaaaagaccgatctgtcaagaccttgggatggtttacagtttgaagtacacctcaatgtcagggcaatgtttttaattaccactgttactcttgtcggggattgcagcaaccaatgttttggactgatcgctggttatatggctattctattgctgaattaagcccctcttttatttgctcttatcctatcacaaggtgtggagactggagagtattcaataaaatcagcctacaaggacatttttgtctaatcaattctttttgccccttggaagaaaatttagaaatgagtgaaatacatggccggtccctaaacttgtgtggtggtgtcacttaggtccgtgaatttgaaaattacacgtttaggtccgtgaacttggtttaatgtatcatccaggtccaatcgtcctttgactgcgtttgaccaccaacgtggcatgtcacgtaggcaacacttttgctctcagccccctccacatcataacacgtcacatatatcttcttgtaactatatagtgacaccagaatcccaaaaaaaaaaaaatcctcaaatcattcttctccttgcatgtatagaaaatgcgatcccgattagcaattgccattgctctgcattccaaaataaccttatccttacacaacgggcacttgatcaacaccaccttcttccagcgacttcaagacgaggacgagcttggagaatccatggggatgcctagcatgcaagccgtattacgctgcctcccgctactaatccgaccgcattgccccaccgctaaccctgctgcactgcgctgcctcctgccgctaatctcaccgcgaggccgccacagccgctacctctcagcctccttcccctaacctcaccgtcaaaaccctagccgatttagggatattttgagggatttgggttgaaatgcactggacagggcaagttatgtgtgaaggtgtatgtggagggggctgagcacaaaagtgttgcctacgtggcatgccacgttggtggtcaaaggacaattggaccgggggtggtacattaaaccaagttcacagacctaaacgtgcaattttcaagttcacggatctaagtgacaccacaccacaagtttaaggaccggccatgtatttcactctttagaaattatgtacaccacttcactgcaaattctttgtttgattagcaatccttagttgatgtcggacggtggacaggatgcccaaataagaccttcctcacccggctgcttgtcccctttgtgaccaagcggatgaaaccattcaacatctcttgatttcttgggtttttgctcatcatgtctggtttgattcttttctgaagagaggtcactacggtaccagtgggttccctacctggtggcgacattcattgaagttggttgacaagcaacaaacgaagggcctctaactgatcaggaagaaccgcaatgggtgtgtttctgatggagagtcccctagtgtcagtactattattagggctatatcagaggaggctgccctgtggagcacagccggagctaaggagcttaggctgttggcttgcgttaggagatcaggtttcttcttggtcatggttttagatcggttgtggcatgtcttatgtaatatttgtaagcttgaactggttatgtacacctatatattagaggggggaaaaagaaaagaaactgacactcacatcatcagtaaccactgtgccccgcatgacacccttccaggatcttaggctcataaacccataacattcagaattttaatgtgaataagctttaattactcctgcacaaatctatgtataagattaagaactactacaactgtaatgcttgactctccacttctgaactgttgctgacctctgctgctgaactattgctgaaccgtaatgcttgcttcatatttataatgtaaatgtaatgctgaacgattgttgcaataaaattaatgcatagaacattctacatttttcttcgtatatatgggccatttggccttttcatattcaaccaacatttctagatataagaagatatactaacgagagaattaggaagattcacaatatttaagttgcaaggatggattttcagtatctcaaacctggatagtgattttgtcaggagaaacgccacaggcattcaagatcttgaaaactttgtgaacccattcttcattccttaaacatcttactttgactctttcaaggttctgaaactggaccaattgtccaattgaactgctactttcttcaatttccaccatatcttcatggccctagagcagacaaaatatatcttggctcaatcaatcatggatgataaccgaggtaagtaatcactatgaaattagaatgcatataccttataaagttgaagagtgagcttctccagaattgatgtttgttggagaaagcaaccaagagcgcagaaattatgcccaacgacccatccatcaagaagcaaagtctttaacttgctgaatgtggggcaccatgtcaagtcttgcttcaaaatacaatgtacaaagtaagatggaacatatcattttaacatacaacacgacatgaaactgtacattggaatggatagaccttttaagtaaattcaggacgtaacaaaacaggcaataaggatctctcgagtctcgacagacatagacatattctagtcttaaaaatactgattgaagtcttgcaaaaattaccagagatctaaactatctagtgttccacctgataccagaagcataaaaaccataaaaatgcaattattcacccacccacccacacaaaccaacttgcagggatgtcctcaaataggtacaaggtaaggcaggacagaaatccatgataacatacaacaaattatgttttgagtataaagctaatgaatatgaacacacacgtaccatcccagcttcagctactaattccaaatttgcagcatttgacagacctctgaaaaacttatacttgacactgccatcaccgtcaggatcaccatcacaacaaacacatgtaccaggatcatatctgcatttccgacaaccccaagacaaagtcccaaacttcacagatgctgttactagcaatggcatgctttcaagcaaaggaatcgagccgtaattatcacccaatcgtagtgaaatgagacctgggacagaaatacgtgtgctcatctcgaagttacatttggtgacacagagatgctttagtgactgggacaccatcttgtcagtggaaattttgcatgattccgccgggcggagcggccgagcggagcagcgtcgccgctgccatcggcccttgcgccctcttccttttctcttctcctctccctccccttgagcccaacggctcaagggggccttgacccgcgccctgatcgggggcgcccagcccaatggctggtgggcccccgtcacactgtgccatataaagaggggtggaggacgggacggtacaacgacacaaggaacgaggttagtagcngccgccactccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcaatggtatcagagccaggttagcgtttagtttggttcggggatagacatccacagagaagaaagaaatccaaagagaaaagcaaacgatccaacggatcaaaaagatcgaaaccctaaccctaatcttacctcgtcgccggccgtcgatgacgccggccacggagggggggaggggcaaagaggcaccgccgaggagccactcgacggccgcgcgcgcacccgcgggtgcacgcgcgcgccggcgagggggcccgcggcggcgccgccatctccgtttttcggccgccgctctctctcacacggtgggggctagagacggtggagggagcggagaagagaaaaggaagagggtgcaagggccgatggcagcggcgacgctgctccgctcggccgctccacccggcggcgcgctagagaaaaagtgggcgcgcggcagcgcgaggtcgccggccatggcgcggcggtgcaagggtcgccggcgtagatgacgccactcggcgcggccgcacccgcccgcaagagagaagaggctagggtttcggccggccggcggctggggtcgggtttttgtccctccgatcttagcgcccggccgtccgatcgaaaccctagcgatcggacggccgacggcggccgggccgaaagcggcccaagtggggagcgcgcggcggcggctttcccggcccaggcccaggttgcggccttgggggaggggagggggcgctcgcccgcgcgcaaggtggccatggaccgaccggcaaaggccggaaaagttcaatttaggtccctcggggccgaaagaaaaagaaaagaagagtttaataataggtcctctcagaagctttttcaattatgtataattattgtgattatttctaagcaatttgaaccaacgtgaaaattgtttagagaatagataaatgtgagaaatgcttctgaacatgtattttgtatattttcatgcaaattacaatagaactttgaattgtttttgcatgttttacctctgtttaaatttgaaccaacgggagaattttacagagagtaaataacagagttttgttattgtttatacgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcaggtggctactccttgatgggttacattaaagatattccgaccctgaaaggagataactacgaagaatggaaaagagaactcgaccttgcctttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacaattgagccaaccatattgggctcaatcccagagtatgacactgtctctaaatacctcgaaagtataaagagccagtttactggttcttcaaagttttatgcgacacagctgataaagcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaaacaacagtttacagttgagacaagatcagtgtctacactgcaagaagacaagacattccaagaaagatcatcctgacttcctgacagtgatcatggcaaagaaaggtgagaacattattacatttgtaaagaatctcattatgattggttattctagatccacatggtggatttattctggagcaactattcatgtgtgtaattgtttaaagggattccgttcaatgaggactacgcaaagaagtgaaagatccattagagttgctaatggagttgaagcaaaagttgaagctgttggagattttcacctagaactcgcgaatggcttcacacttttacttccagatgtttttatgtccattctttgcaaagaaacttgataataagtgtatccaaattggattctgatagatatgaaatggcaaatgtgaactatggtataataatcaatgtattggtcttgtgttgcaagatcagctttatttgttatctctttctgagaatgtgaatgttgtgtcctcgttgacaaaagaaaagaaaagcgaacttctgatgtctcatcgaaattatggcactgttgtttatgccatatttcgagggggagaattgagagactggttaagaatgtagttcttcctccattggagttctcagttttagaacgatgcatacaatgtatagaatgcatcggtgcccaaaacaccgtatgagctatgaatcctccgtgtgtggggaagtcctgcaaaggataaagtatttaacccaaaacagtaagctgccattttattggctattctgaaagatcaaagggtcatcgtttctactgtctaaacagttatacaaagtttgtagaaacgagacacgccatcttcttggaagacgaaatgattagggggagctcagcaattcgagaaattgatcttgaggagaggcgggtgtctatacccgctccgtcgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagctgcaacagcctcaaacagataatgtgccagaataggaggcccctagaaggcctgaaagagtcgcatatggaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaagttttcacgcaaagagaaggcattgattacaatgagacttttctccagtctcttgtaaagattcctttatgattataatggcactagtggcacattatgatttggaattacatcagatggatgtaaaaacggaatttctaaatggtgatttgaagaaaaaaagtatacatggcacaaccgaaaggtttcgtcatgaaatgaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaataaagaaattcttgtcctcaaactttgacatgagagacctccgtgaggcttcatatgttttgggcatagagattcaccgaaatagaacaaagtatgcattgggattttctcaaaaggcatatatatagaaaaggtgttgaagaaattcaatatgtacatatgcagtgctacacctgctcctatagtcaaaggcgaaaagtatggggcatcacaatgtcctagaaatcagtatgagctcaatgaaatgaaaataaagccatatgcgtcaactgtaggaagcctacagtacgctcaagtgtgcacacgacctgacttggcatttgttaccgggttatttggcagattgcaaagtaatccaggcctagagcactggaattagtaaagattatttgcaaagaacaaaagcctcatgctgtcttacagaaaatcagaatcgctccacatagtggggtattcgaattctgactttgcaaaagataatacaaagttaacatcgggggatacatgtttaccctggcagtaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccgggatcaaacaatcagtctcgagcacataagaacagaaaggatgctcgcggatccgctcatgaaaggcctacctcccaacatgttcaaggaacatgtagcatgcatgggttttaagggaagccttatgaatcctggactatagggcccaaaagttaaagtatctgtttctgaatagagatgtgtatagtggctgtcgaatccatcggtaattaaccgtgacgatgaaacatgctctatatgtaaatctgtgatggaatagaaaaagctaaaggaaatagtgagatcaagggggagaatattagatggatctccctccccttgagcccaacggctcaagggggccttgacccgcgccctgatcgggggcgcccagcccaatggctggtgggcccccgtcacactgtgccatataaagaggggtggaggacgggacggtacaacgacacaaggaacgaggttcgtcgccgccgccactccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcacaaggtcctccaatgcaggtaagcttgacagatcgtcaatgaagttagtctcagtcctattacgtttggtgatgcaaagacgctttagtgactgggaaaaaatattgtagggggtggaaatcgtacagcaattcatctgaaggtcctccagtacaggacagtttgagaaatcaagagcatggttgtccagctttacagaccgaagctgtaaggtggtcaagtgtttagagatgagaggcatgctcaattccagcggggctaaatgttcagattgaacgaggaccctgagcacccgagccttgcacatgagcgcatgcctgatccatagttcagcatacttgacctcgtagatacaaggtctgggcatcatggtaggccagtatgtgtaggtctggaactcgagctcatcaagaggcaccgggtcgcgcaagagaagaagattgttgacaaacttgttgaacctctccacacccacccatctgtgtctgatgcgcagcacgggggcggacctccaaaggttgcgccagcggcgggagagcagacacgtccacacggcctcgtgcgctggtaggaaggagagaacattgtggaggatctcgtccgggagggtgctaagccagtcttcgccgctgttctcctcggccgtgagtccctcgcgtctcctgccgccgtcgcgcctcgtagccattccgtcgaacaggtggcgagcgcccttgctgcgcaagagcagagaaaggtgagacgtccaaaaaagccatcacggaacaaagagaacaaccgagaagacacactcgcctcacctcagtcgccggaagactcgctctccggtctccgctgccgccgccgccgcctggtagggctcgtcgcggcgtcgcccgccgccgctgatcgatggagcgccgagcggatggttgtgctgtgtgctgtgtgcagtgtaagcttcacctctcaagacttaactgtcaatataagcccaaggacagaatacggcccatgtgtgtcagcctcgagtggaggcccaagacctggatatggcccacgttagtaggcctagagtggacgcccagtttatctcgggcccaagacagtccgaccatgaacagcataagcaagacaggcctagaccagtagaaacccaagattgatttcagcccgtacgttctagtaaattgaaggtctatattgtattcctcaacatgttccatagtccgatttgctgttggctccctataccgtaaatccgtaatacaagcaacaacaccttcctcctccacatcagtacaagttcaatttgactccaatcatcttgggaatatatttgtggatggttttcattcgacgcggcacctagtgctgcttacgtgctactacaatcaggaaggaaaatataaaacaagttacacgcataggccgaaatgacaagagcacatgggcctgaattaccaggaggcgctgtttcaccgattaaatcaaaaatgttttactaaatctttactattataaaaattgaatatgttttttctggttctttgatatgccatctgtgtatgagtctgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaaatccagtcccccctctcagtgggcaaggtcctccttttatatcttaaggggataccacatgcaccatttctctcttttttgtggggacttaccccaccttttcataaacagacggagacttgtatggttgccgtccgaatgaccttctaatgggacggcccatacctacctccacttccgccggaagcaggcgcgacgtggaatcgtggctgtctgctgacgacatgaccggtattagaccagtcacgtcggtcattcttgtccaccacgtgtcagcttagcaatctacatgctcgcccttcttcacacaacatcttgcctgtaatggtttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacattcggcgtgacacgctcagccaaaccgcaataaatgtgggtaggtg

SEQ ID NO: 76285 - DNA, 14188 bp, Oryza sativa
  unsure (1)..(14188): unsure at all n locations
ggttaggtgagccccactgtgctcacctaacccatacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtacaaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctttgcaatggcagggctggttccaccattttcttctttcttcatggatgttctggagttctacgatctccagatggcgcacctcacccccaacgcggtgatgacattggccattttcgcgcatctgtgcgagatgttcattggggtgcgcccatctcttcggctgttccggtggttcttcactgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgatcgcctggcgggcctgcgatcccaggggctcacaggggccatggtgtacggcgactacctccgtcgtcggattgcaccgctccagcgacgcgctcggggcgcctgggagtacaccgggtccgaagacttcacgaggacccaccagggagtgagatgggactgggctcctgaggacttcaagatattggtccaatgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgagagggggtcgtgcttctgggcccgcgacaggggcccggggagcagccgccctgccgacgcccgggggaagaggaagcagggaggaacacctcccccatctcctccccgagggggcggggcggcgcgtgctagtaacaggcgcccggagggggccgcgccaacatcgcagcccgagggggagcacaagaagaagcggccccgtaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgtttgtcttctggttttttctttcgtttcagcgagatcccgtcgcgtctctcccgccattccaagtccggccagtctgaggccgaggatccggcggccgcagaggccctcaggcgggaatctgaccggcgagaggccgcggatcgcctacgggaagccgaggaggccgcccaggaggccgcccgggctcgccaggccgaggaaaccgcttgggaggaggccgcctgggcccgccaggccggggaagccgctcgggaggaggccggatttcgccaggacgaggcgatggcgacttctgaggcagctcgcgacgaggccgcgggcgcgtcgcttgggcccactccctcaggcgacactcaggcgacaacttccggggcagctggcgacgaggccgcgggcgcgtcgcttgggcctactccctcgggcgacgctcaggaccaaccgggtccgggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcgagggcgccgtcaccatccgggaagcaacgctggcggcgcacgaggctgcctgcgccgaagaagagttcacgctccgcctccgcgaggacgcgctcaccgaacgggagcgagctctcgagggggccgaggccgcggcgcaacagctggcggtcaacctgtccctccgcgaggcagcgcaggaggagcaggcgcaccgcaatctggaaggtgcccgcgccgagagggccgtattgaaccaacgggccgctgagcttgaggcgcgggcgaaggagctggacgcgagggcgcgcagcggcggggcggccacgggcgaaagcgacttagccgcccgcctcgcagctgccgaacgcaccatcgccgatctgcagggcgcgctggactcgtccgccggggaggtcgaagccctccgcttggcaggcgagatagggcccggcatgctttgggacgccgtctcccgcctagattgcgccggtcggcaagtgggcctctggagagggcggaccgtaaagtacgccgccaaccagggaggcctcgcccagcgcctctcgaagatggctggggctctccaacggctccccgaggagctcgagaagacaattaagtcatcctcgagggacctcgcccaaggagcggtggagctcgtcctggcgagttaccaggctagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagagaaataagaatatgcatatgttgtagcccccggccaaccctgcacgcccgaaggggggtgcggggttggcccgagcccgaaacctgactcccgacccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccggggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagtccccagacagcaaatggccacgaaagtggtatggtctgcagggcctgggccggctaatggatttgcttggcgtggaattgacacgctctacatcgccggaccaggttgaccgcatcattaagagctgtcggctaatagaaaccctggcgaaaagctttaccaaccaaggtgcgcgaggcggagtgggctccgcattcgccttcatggatatcggcaagaagcacaacgccttgttcccgaggaatgcacttcaagaggattccattagccgcgcgtcgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcaggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcactggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgcgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttatcttctgtgctgatgacctcggggtcggaggataacaggggtggccttcccacagtggcttcggggccgtcctgggggtcgggggctcctggcgtcgtcggaaaagcgggcaaagggccaactccggtcgtcaggggccttaggcctccgttaggctcgggggcctcttcttcctgctctttcccgggtcgggtcagcacagggttagcctcggggtcgaagggcgataggtgcggccttcccacagtggcctcagggccttctgggggtcgggggctcctagcactgtctgacaagcgggcagagggccaactccggtcgtcaggggccttgggccaccgttcggctcgggagcctctcctccctgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccatccaggtaaacggtccggagcgtttgagaagcttaaataagggtaacgccttctctcccagcctcgatatgaaccgacttagggcggccatgcaaccggtgacgcattgcacatccctaagtttgctggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgtgaggcagggggtaagaatccttaggacatgccttgttaaggtcggtgtagtcgatgcacatccgaagcttgccgttcgccttgggaacgaccaccgggttcgccagccactccggatggatgacctcacggatgaatccggcttccagaagtcgcgccacctcctcgcggatgaaggcttgacgttccagggcctgccgccgcactttctgccggaccggccttgcgcccggccgcacggtgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgttgcctcggggtggcgggggcggaagcgccaagcctctcgtcgccaccctcgggcttggatgcagcggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggctttgatggcgtcaaaggccgcaggggaaaggatgttgagggccgctcccccatcaatgaggacacgccccaacttcacgttgcaaacggtgggagaaaccaccatcgtgatctgccctccccgggcaacgcacggtgggtggtcggtctggtcgaaggtgagggcaacctccgaccaccgcgcccgacacgtcgcctcatgagtaggggccgtggccagaagctctcgcttcatggccttgaagctccggcgagaaacgtgagcacacgctcccccatcgacggtggcaatggtggccccaggctcttggaaacctaggtcatcatcgccgtcatcgatgtcctcgtcgggggccttctgcttggcctcacttcgccgattaccggaaggaaccgccggggatttgccctctcggcgctcctgcctcctctcctcctcccacttcctcgtccgctcagccaaacttttgactgcacggcagtccgcaaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtttggggctccttggaggcgatcttttcaagcatgcggttgtgccgcacaccccccctgaacgcgtaaatcaccgcgtgcgcagggatgcatggtatggtgttgcggacttgacagaaccgctgaatgtacaagcgaagtgactcatcatcccttcgctgtactgcgtgcaagtccgcttcctcacctgggcgcggatatgtgccttggaaagttcatggtgaactgttggcacaaatcctcccaagagtggacaaacgcgggtggcaagttcattagccaaccccgcgcttgtcctttcagggccatgggaaagaaattcgccatgaccctgtcgtcaccccgggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaactgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcccgggtcggaggcgttgacgaaggagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggtgtcgaagtcacggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagccccctacctggcgcgccagatgacggagcgtggggctcctcaccgggagaccgcgcaggcccccctttgccggttcggccgggggccctgggtgaggttctaagctcttggtctgtggaaagttcgcgagagtgaaatcacacaagacacgggcgatgtatacaggttcgggccgctgagaagcgtaataccctactcctgtgttttgggagatctgtgtatgaaggagctacaaagtatcagccagcctctcccttgttttgggtttctaatctggaaaagtccaatcccccctctcagtgggcaaggtcctccttttatatcttaaggggataccacatgcaccatttctctctttttttgtggggacttacccccccccttttcataaatggacggagatttgtatagttgccgtccgagtcaccttctgatgagacggcccacaactacctccactttcgccgggagcaggtgcgacgtggaatcgtggctgtctgctgacgacatgaccagtatcagactagtcacgtcggtcattcttgtccaccacgtgtcagcttagcaatctacatgctcgcccttcttcacacaacatcttgcctataatggtttaggatgaagcctggcatatatctgaccaggactaacgtgccatctctgggaggtaacacgctagctccagctggggacgagcgcctagaagccctcgtcctgacgggatggggcgaggcgtgcatcagatcgcctgtcgccacctaacccacgatctgaccggtctgtgactggtcacagaccggataaacgagtgcactgcactgcgttacatgcggcgtgacacgcttagccaaaccgcaataaatgtggttaggtggggccggctgtnctgacctaccccatacccggagcaaaaacccacaaggggtcggggcccctgggccggcggggccaaggggggtgcggcccaaccccctcggggggactaagaggagggcgaatgcatcaccctcgggcccgacgtccctcgggggtaccaggccacgtatgcgattgtgtctgcctcaaacctctagtcatgatactcctgatcccatgtcaccgacaacatgcatatagaagttaatatgaatgtggatgcatattaatatgttaagtcattcataacgtgtgtttcatatgaatgtagccaatactagaatgatttacattatgaaatagagggagctaataattaattaataatgtactaaaggattgctctattttccgtgtgtaccgttccggttatcaataccagcgcctcgccgcctacagagcgtctgggggaagccccccgtttcacccctttctcctcctcctcccccaaccccaaatcatatcatatatcccagccggagttgtattgacaatcgacactttttttttccaattttccttaaaaacacacacatgcatgcactgtaacaattattaaaattcttaataaaagtgcactggcatatgtgtttttttaggaaaacattggcatatatgttgactacggaagaagttcagatttgaaccctaacgcttgaagtcatgcaccatctaatatgatatcacatcagagatgttcaccgcatcatattaactttctgtggacgtatctcataatcactggtgctagcctccaaacaaagaacagaacgcacagcggagtgcaaaggggcccaccgaagatgaccaagtagacaagattggacttcaccaggtcgacggtgatggggaccccaatcttcgcgagcaccgtgatccccatcctcctctgcagcacgtacgcgcagatcagcatccgcaccacctccctgttcctgaacagcagcgtgccggtggtgaagacgcagacgcccaccgccgtggcgcgggacaccggggccagcaccaggtacaccccgagcgcgaaggccaccagcaagctcctcgtcgacttgcgcatccacgacagggagtgcttgaagtacctgtgccggatcttccagtccaccgccgccgtcccggcgtagatcaggctgaacgtggcgagcatggagcaggtgaaggccaccgtcacggcgtacatgaacgcgtcgaaggcgtacctccccgacagcgccggagagcccgcgacgacgacgacgttgccacggccattgttattattaccatcgccagccgcgtagccaccgggcggcgagaaagccgccgcgaacgcgacagtggcgacgaggacggagccgacgcccaggatctgcgtcgactccgtcattttcttggactcggcgatctcgtctagcttgggtacgtactgctgctggaagtgatcgcgccggatgttgccgctgagggctttcgctaccaccagggaccaaagtatccacgttcgtgcgttctgcatcaacaaattactaaattagatgcaaaatcatctctaattaaagggacttactatgtttcagttgattggttatatatgagttggtttagagactagagatgtctataacaagggtaattttaatatctctgagaaggtactaagaggtaccatatttctatggtaaatttaatacttctaggtattaagtaaggtactaaaattttgatatctcaactgtaaaattccccctatataacaattaaaaaagaaaaaaaaatatccaaatactcctctaaactttagatagaaatacttctacaccctaaactttaaaatcagatctttgcaaaaccattcatattactccctaaggtggttttgtatagttatttttatctaatttttatataaattggatgagtttgatcacatggcatacatattggacacacatgtgtgtgtatgtgtatgtatgtaggtacaatggtacatacgtatgtagacagctctattaaatggagaggcaagtaacattagaatttagaaattaccagtcaagcgaaagtgatttaccgttttgtagttaagcccagcgggaatggtacaccttgagaggtcagccggagtgaggccgtcgttgttggcaagatccaagcaaaccctgcgattccgcagcaggtagcagaacacgttgaggacaccgctcgcgaccgccaggtgcagcgcggtgttgccgtcgtcgtcctgcgcgttgaggatgggcgtcgccagctgagagccgtcccgcctccgcctgtcgtcggtggcgaatcccacgatctcctccctcccccggtcgacggcgacgtggaggaaggtcctc

SEQ ID NO: 76286 - DNA, 7722 bp, Oryza sativa
cacccccacccccctttccacataaactccccccaccccatctcctctcccccctgaataacatcggcgcctcccaaaagcgaaacctcgacgccacacgcgcgcgcgccatcatgcctgtagcctccgtcgtgctcctcctccacctcctctccatggcggcggcggctacggcggcgctggccatggaccccgccgagagggagacgctgctgctcgtcatggaggccgtctcctccgaccgcgagtggcgctccgtcggccctgacccgtgcggctccccgtggcccggcctcgagtgcaagcctgtgccggccgccgggaacgtgtcgtcggcggcgggaggctgcacgtcacgcggctggacttcggggtggcgccgaacccgacgtgcaaggacggcgcggcgttcccgcacctcgcgttcgcgcatgccgcacctccagtcgctgttcctcgtcgactgcttcaagaacccggcggccaccacggcgttcacgctgccgccgtcggccaacctcacctcctcccgcctgcagcagctcagcgtccggtccaacccgtcgctgtccggcacgctgccgccgcagctgtccagcatccggtcgctgcaggtgctgaccgtgtcccagaacgcgctcatccgcggcgaggtcccgcagggcatcggcgagctcaagagcctcgtgcacctcgacctcagctacaactcgctcaccggcacgatcccgagccgcatcggcgagctccggagcttggtcggcctcgacctcagctacaactccttctccggctccatcccgggccagctcggcgacctcgccatgcttcagaagctggacctgagctccaacaacctcaccggcggcgtcccggccaccatcaccgggctgacatctctcaccttcttggcattgagcaacaatggcctaagcggccacctcccggccggcctctccgacctccttgacctccagtacctgatcatggagaacaacccgatgggcgtcccgttgccgtcggagctcggcgacattgcgcggctgcaggagctccggctggccaactccggctactcggggtcgatcccggagacgctcggccggctggcgagcctgacgacgctgtcgctggagaacaacaacctcaccgggaggatccccgccgggctgagccggctcaagcggatgtaccacctcaacctgagcaagaacgggctggacggcgtcgtgccgttcgacggcgcgttcctcaggcgcctcggccggaacctcgacctcagcggcaacccggggctgtgcgtcgacggccgcgccgtcttgcaggccgacgtcggcgtcggcgtctgccgccgcgccggcgacggcggggacatcgcctccgtgtccgccgccaccgacgtactatcagttggcacattgttcaggcgagatggacaactctggctcgccggcggccgctggtcagcgctgctgctcatccggccggtcgccgtggcgctgtgctgcagctgctgccttctgctctgagctcgcggcacgcgcgcgcgtggtggtttgatctgtatgtaactctgctatgttagtggtagtataacttgtcacgttaattgcgagaattccgaggcaagggaaaagagtttggtagtgttggggtacttctacacttctacagtacttgggtgtggattggattggattggcacgttggtttcaaatcgtcgcgccggttgttgggttggggcccggatttgtgatcggtcaaagttagcgtccgggtcccaggggagttaggctgtgtttagattcaagtttagatccaaactttagtccttttttatcacatcaacctgtcatacatatataacttttcagtcatatcatctctaatttcaactaaaatttaaactttgcgctgaactaaacacagccttatggtaactggctgtgatttgtgcgtggccgatctggccataaatccggctgcgcctgcaatttgcaagcagttttcaggcactctgcagcctgagctctgccctgcttttcattgcttgccgctgtataatccaatgagtgttatgcccctcattgccttaagtaagggaaccagatgcagtggtcaggtgatcatgtactccagcgttgatgtctgaactgtttgtactaactgacagtatggcttgtctatagggatgcatgaacaaagtaggagtatgtgttaaccggactatttctcatctgcactggaattttatcatctctttggttctttctttaactataaccacggttcgggcttgatgtccgggaagatggaagagttttgaagtcctttgggaggtgctgagagttgcaacgttttttgagctagggagtactccacgtagtactccaagtagtactagtgcatcacattaccggctactggacttcaccgtaaagatctcaagcaaggcttggtttagtttccaactttttcttcaaacttctaatttttctatcacatcaaaactttcttatacacataaacttccaacttttccgtcacattattttaatttcaatcaaacttttaattttagcgtgaactaaacacacccgaagaaagaaaaccgtgtgacgagaaaatacggcagtactgtttgtactgtacggagtaagagtagtacagtactgtactcctaccaaggaggaaagagaagtcccgtgtcctgtgacgggaaaatacatgctgaggagtacctggcaatgtacaaaatcattggtgtctatgttcagcgtgcatggacatgaactgttgaaaaggacagtgataggataagtgattgacatgataaatgtacatcctgccggggctatacaacaagcttgcggtagctaggggcatggcgtaaacctgaaagattgttttttaaaaaaacaagagtaaacatcaaagcgatcgattgatcgaagtgataatatgaaaagaagaaagaaaatcggttccctgcaggcagtaggatcgatcctgaccatgttagcactactgccggctggatactcctagatcgatagataccctccatggctccatgtaccgaaagcgagcgagcgggagagagagagagagcagagagcagagagcagaaaccagttgtcattagctgaaaatgacgaggggaaaatggacgagtgattaacgcacaattaattactccctccatcccctaatatagtaaactagataggattccagataattatcctaggatgggtctagattgttatagtctggacgaagatagtagtaagtagtattaattattttaaattcagaaaataaatttatttgattgcttaagaaaactttgatataaaaagtctctaaaaagaacgtactaccgtatactccatccgtttcacaatgtaagtcattatagtatttctcatattcatattgatgttaattaatttagacatatatgtctagatttattaatattaatatgaatgtgggaatgtttataataattgacaagagttgctcccaaacagctcaaacaaaagtagcctaaaccgtcccattcttataaagtatgtacacatatcttaactactttaaaagtacgattgtttctcttcctcttcttaaaaaaaaaactgctccctttatttcgaataaaaatcactaaaattgtggtaaaaaaaaagccagtgcagccattctccttgttccctgaaaaacccactcaccatcataaaaaactccctatagaaaccggtaaaaaaactacccttaaaaaaaatctcataatcccgttactacttcaccgtaccgcatcgtatgtgtagcgtgtggcttggggcctctcctctcttacgccgtgtaacggtgtaagctcgctcgctcgctcgctcgggacatcgccggtgaaacatggcgtcgattgtagaatatgcatgcacggtgatgctacattctctactcgcgaaagaccaccactcacccatcgcccatcggcgcgcacacgcacacggcacacctggtgcgcccgtgcgggcgcgggtgagccgcacaggaaaagagagcagcagagcgcggcacagtgcctcactgtgccgcctgcgcgcggtgcgtgcgcgcgtgtcgtgcacttgtgctgtgccctggtcaaagcgccgcgccggggaacagcaacgcaagcaaagcgagcgagcgcgcggtggtgggcacaccaaggaaaggagtagtacgtactgtacgcgcgcggcggccgggccgtgcgcacgggcgcgcacctggctctggctggctggctggctggggttctctgcccgcctcacgtggggaggagtcgcgagcatgcagcgacgccctgtagcgatggatggatggccaggacggctcgtctctatccgagacctgggaaagggatggggtattggggtgtcgtcgtcttgttgtgtgtgccttttttgatgctacgcgccacgcatcttgcggtggttttgggagcctcggccggccggccctggcgcctggcggcctgggcttttgcaggaaatgggcggcacctgagtcgtcgtctcacctgccgctgttttggagtacatttgtgctacttgcacaagaaaattagccgtactattttgtgcacgtgatgtgtttgcgcgtgcccagtggctggcggtgaacgaactggtcacttgtacaggccactcaggcgaagttgcagagtacagtgagccattctacatctacctgtctactctcattgggcctaaaagatatcgcaacaagaaagagagcccacagcaaatcacgcctagtggaccttaggagttaggagcccgttcagcccagaggaggaagcagatcataacgcaccggggccttccaaaggtagcgactggctttccgtttgtcgttacaccatcgtcatgggccttatggcaatggcacagtactgtactccctctctcctctctgtctcttacaaatttaagatttgattttgctatatctcactcgaaagattttttcttatctctcactcgattttctcactcaaatttacagtgtattttcttgtaagttacagtgtaatttataaaacttatgctgtaacttttgtaagttacactgtaatttttgaatcttcgcatgtaaattttaaattttgtattggatttggtctttttcttgaggatatggtaatttagtgttcattatggtgtttcttaattgctttttgctttttattatatctatcggattttaatccaaatattaaaaatctgtgtgatacgatcataaaaatctttcgaaagatgtataggtactccctttaagattaacatgatatattctaatacaacgaatctggatatgtcaaattcattgtactgtagtactaaatcatattcagttatatattcattttcttagaatggaggaagtagtactactctgtccctaaaaaaataaactctagctaaaaatctgggcacgcatgtgtcatctgtccagattcataggtatgattttttttttgcgacagagggctacttctctagttttttttttatggttgtcctagcctattcttctctagaagatctgcgtgatctaaacaaggagtgcaaagacaagtgcaggtagactcagatcagacgtctttgcacgctggtacttgtagctggattgctggaagcttgctcagggcacccgcaattcgacccctacttgagtggcaactgagaaaccttgatctcagcttttcttgttaatattttcctgtacaatgcattttttgtggtggttagcagtgtagtattaatataagagagaaaaatcttggatttgtcaccttattaaggctgtgtttagttggggaaaagaaattttttgggtgtcacatcagacgtttgaccggatgtcggaaggggtttttggacacgaatgaaaaaactaatttcagaactcgcctggaaaccgcgagacgaatcttttgagtctacttaagccgtcattagcacatgtgggttactgtagcacttatggctaatcatggtctaattaggctcaaaagattcgtctcgcgatttatagctaaactgtgcaattggtttttctttttgtccacatttaatgctccatgcatgtgtccaaagattcgatgtgataggtgaaggggaaaatttttgggaactaaactagccctaaggtagtactactagcattgtaaagtgttttgatattattgaacgtgtgaaggatggatcttgctatagttctgcagccttttcccaacagtatatgcctgtgctgtccaatcatgggaagggaataattggggcgggacaagccgttggttttgcacgaggccaatcgcgttgctctccccgcccgttgaaagctcatcacggagaaaacttgcgagttactctcctctcgagctactcgcaacttgcaatgttgcaacagattgtgcgcgccggcaaagccatcagcccatgccccatgcccgttaccgtgccgtgtcaccaacaaatcaaaccgagcgccaggtgatagccagaggccgccgacctggcctgacaccggtgggtgggtgtgtgacagtgtgagaggaacaagaggaattcgcgtgaaacatcgccaaaaaacgcccaaatttctcgtgggattcgtgtgaaatccgagcaaaactcgcaaaaaccggtcgactcgtgcgtgcgtgccctaccccgtgtcggcgtgtctcgcggtgtcccaatgggaccatctctggtcgttgcctgtcgtccgtctctggttaccatgcgacgcgacgcgatgcgaagcgacggctcgcgtcgcgagtcgcgcgacccaccaccgacccggcccaccgcgagcgagcgcatctccgcgcgccacgaggccgccgctggcaggtgggacccacgtggcccaccaccaccacctcctcgtcctcttcctccacctccccccctctctctctctctctctccctctcctcctcctcctcctctcctctctcccgtcacgggcgcatctctctctctctctctctctctctctctctctccccgcacagccgcgccgcgccgccgtcgccttctcgggcgagggcgaagagcgagggctcctgctcgccgccgcccctccccctcgtccgcggcgcgccggaggtcaggtaggagccccccccccctccgccatccctctctcgcatacactctcactcctccctcctcttcatcatcctccaccacgttgccggcgcgaattggcccgagcgtttgggattggggacgtgggaattcctcccatcccgtcctgcttctcgtggagagagatttcgcctgcggatggattccgtacgggctctctctccgcgccgccagatccaggaggggagttcgtgcccgcgatacgctccagtgggcaatccggtttcgctttctgtaggttagctgggcaggcaattttcccatgaattgatttctgggattggggggcgagtttcagtcatctttttccgcgggataaattgatgtttgtttttgtgttcctaccgcagtaagttaaactatgcatcggtaactcgtcgagatccattgatgtgctgtaatatcgtacttaatactcctgatttgataatagctatgaagattttgtgtctcctaaagagcacaaaaatgttaatatgcttcgactgggacttaggtagaa

SEQ ID NO: 76287 - DNA, 14654 bp, Oryza sativa
cgagatcgaggtacgaggtgtgtggagggactacgtgatttgcttggtggtggagtttgtggcttgcggggtggccattttatagggggtggatgcatatatgcatggttgaattgaaccgttccaactttgaaaaactagatggcaatttttgcagtgtactttctagccaggaaagtttggcgcacagtacaacgaagacttgaaaccatgcattgacttgtctatttcaattgtgcttgcagaaaccatgcattaattattcgaagtggactctaatttcctttagtctttatatactttgtactacctctctctctgtctttggttctaaaacacggccgggtggttgtttcagacttgtgcgcaatagtaataactagctcccggctagcacctaaataaaatcatatatttttagtatgattttacttaaaatttattaaatagctatctcattgtcttaagagtttgaaagaccaaaccttatcatccccgtgtttttaattatatagttttttaaaagtcacaccagttgctaccccttatgtcatctccttctttatttgcttgctcgatctaccactatttttattcattctccttagaaactttaaaaattggatcttatagtttttagagttttttttgtcacgttgggtttcgtttttataatttctaggcgtcccgtcaaacattgccattatactcctctatagtccgtccactatctcttctctttattgtcattgagattttaaaaatcgaacataattatcgtttgggttcatttttactttctagaagtcccgccaaaccgtcagcggctttgccattgtacttctctacgcctcgcccgctgcctcccttctttattgtcattgagattttaaaatcgaacatgattatcattattttcttttactttttagaaattccgaacctttaaaaattgaaccttgtagtttttagagttgattgtcttgttgggttttattttttataatttttagaagtcttgtcaaacgatgccactatgcttctctacggcccgtacgccgcctactttttattgtcattgtggttctaaaaatcgaacataactatcgttggaattcatttttttatttcctagaagtcccgtcaaccgtcggcggctctgcaactatactcctatacaccccgcccgctgcttttcctttttattgtcattgagattttaaaaatcgaatataattatcattggatttttttttactttttagaagtcccggcaatcgtcttgttcatttgcttcacggccttcctatcgtctctccttttaatcgttattaggattctattttgtgttttattaacagtttttatatgtcgtatcaaccgccaccactctactccattataggcatgttacttaatttatctcgtcatatgttttaaatggtcttttcgttcaatagtctttatttttatcataaattttagttatttataaattgtattccaaattgaaatcttatttttcgttttgtaatttcagaatttttttttcaattttaattaatatcgtattgtgttcttttaatatttttattttttattttcaagagaaaagcccatgcgctacaacgggtgacaactattttagtcttattattgttatatggcttagttatgatgattcatcactgtgagaatttgcttggatctatatatttctagaaaatcataagctgtggttaggagtctgttcgtctaaagttagcatgcgaattttcttatacgactcctatatttccaaaagcggacgaacttaaaaccaactcaaaggatatatattttttcaaaagcgaacaaatttataaaccgactcatacacggatgacgtaccggcaaaaatatcttaaattttttataatagtagagattttttttaaaaaaatagtagaagtagaagagaagattacggacaaaaagtcctttttttgagggaatcgtacttttttaaggaattggacgtttttatttttttttatacggtagaagttttttttctctttttttattttttcttgcctttttttctccgcagatagtcggactttttttatggagtcggacgttttttttacgtagaagtttttttttctcttatttttttctgttttttttccaccggaggagtcagtcgtttttttttttgggtagaagttgttttttctcctttctttgttttttcttgatttttttcccgtcgtctctcttttttttttccaccggaggagtcggagtcggacgttttttttacaatagaagttttattttctatttttttaattttttctcacttttttttcaccggatgacggatatgtcttttcaaaaacaaaagaacttaaaaaccaacttatacacggatgacgtaacaaaataccggtaaaaacatattcaatttatataatagtacagatttcagttgtttcaaaattgtattcctacttgaactctcttttaatttttctaattttggatattattttattttttattctgaattttaattaatcacgtattgggttgttatatggattcttctttcaatatttcttatttttaattctgaatttcagctattttaaaattgtattcctactaggactatccttttcttttctaattttagattttagtttatttttatttcaaattttgattaatctcgtattgggttcttatatggaaacttttttcactattgcttatttttaattccgaatttcagctatttttaaattatatttctacttagattctcctttccttttctaattttggattttattttatttttattttgaattttaattaatctcgtattgggttcttatatggaaacttctttcaatattgcttatttttaattccgaatttcagctattttaagattgtacttctacttggactctccttttctttctttttttttactttttctccgattaatgtaggacgtggtgcctcctttcaaagctgttttaataatttaatagattaagaaagtgagttgtaatttgagtcctattttatcgttaaagttttgctttgaattatatttaaactatttgttttttatttggatcgaataataatattactccgtgtttagttacaaaataattcttcaaacttccaacttttccatcacatcaaaactttcccacacacacaaacttccaacttttccatcacattgttccaatttcaaccaaacttccaattttagtgtgaactaaacacatccttattattgtagtttggatcatcataaataaacttttctatgtatatatatcaacaacctcaaacaaatcggctccagcacaccgccgaactcctccatctatgtgcagtctatatatttgctagagtggaggctagacatagttagaaaaaatatttgggtgatccatatttaaaaaatagcaaaaattacctagtacaaagtagaaaaaagaaaagttgatttaagggtgtgtaaagtaacattttgacaataaaagatggctcaaattacaatttactcttaagtaaacctccttactcatatttggtgtttcagacatattaacacaatcatttaaatgtaactttgacatataattaatattatcaaaaatatctaacaaagttatgcttttatgatttatgttacttcaattttggcaaaattttacacttttgaagtttacttatccaatgtaaataataagtgtcttatgttattacactatataatcagaagctcatcttcaaggaagtaaaaccataccatctaaatgtttacaaagatcatcaagattatttgcatacgaaattctgatgatcaccacgtaaaagggcttccatggattaaaaaaaaaaggcagaaatgatgtagaaatgaccgtttgagggaagcacataaggaacacatgaataagaagatatatcgataaatgattttttacgagactagatctcatgttaaaattcatccgaaattccttctctctccgttttatattataagtcgtttgattttttttagagtaaagcttcttttaagtttaaataaatttatagaaaaatataataatattttcaatataaaacaaacatattattaaaatatattcaatagtatatttaatgaactagtttggtgttataaatattgctaattttttcctataaacttgatcaaacctaaaaactttgactaaaaaagttaaacgacttacggagtataatattaaagagagggagtatgtcctaagccaattcaaaggaactttgtagaattttggatagcgatgactttcgccccttttcccttttctcatcgaagtccgtattgtgttagtttcatcgtcttatctttgcaagcaatcgattggattggaagttattttcgaacgtcctaagctcctagctgtgcactatccctctatatgatctcttattaacttgtctactcagttaagtaatccatgtatgagcaacaaggacagttctaattaagaacagaagccatattcgtcattttctccgaaggagaaaacacggcctcaatacattgttgcctacactgctaagtaatccctccatgagaacaacctgttgactgaagttccatcgctggcttaccggttactactacgcaatgtcaattttcacacaagacaaaacgggtgaaaatcctctgcaagagatgaacagaacaggtccagccttttgtgtggccacaacttgtaccatcacgaactgcatgcgagaattcacgtgtaagtagaccattaggtccagttctgcagagatgtcgacttctaatttgtggatagaaactttcctccaccagttaatcgcaacccgctaatcagggatgactttgacatgatccattgatcagtgatttcattagctttcagctatagaatcaatgtatcattggctcatgtcagttgataattaagtagcaacgcggctgcatctgctttggacgcggtgaagttttttatggaatacgtaattacgtatgtacgaggcaaatgcttggtctgaacttaagaaatgttaggcgggacacgtaggtcacgtcccagtcaacttgttcaggccatggagcaaaccatacgtcgaagaagttgtagtgatccagacatagtcacatgatggagattggagagtctacttaagtagaaactgactggccagtctccaactggtgatactctgctcttagttttatttttttccgaaacaacccgcacaaggtaatgcgttgatatatcaggaaaaaagaataagtctgtagttctagaagactagaaaaaaaaagaaaaaaatagccacaccacgcatcaacgtctaatcctgctactgaaaacaaaacaagcacacgacacgccagaggaatagttcttctgaacaacgtctaaaaataagggaacaacgctaagagcgccgccgccgcccgtcctaaagaaccaggacatggttaatacttaaagaaaccattagaataggagaaatgtaacaacgtcccgagaggaatgcggtgacgcaggcgtcgccgttatcggcccgaaggctaggctttcgcctgtagtttcctactttctcatgtcaatgtgtgcatgtcaagttcaacagacactactagctaatcctcttcaacacgcagccaccgtgtcgacgcctcaccaccggccggccatcgaagaagcatctcgacctctggcgtgctccagattcatccacatgggtgggctggagaggaagagggtcagagagaagatgaatcccctctccccgcactagtccatccagtgtggccatcttgcgatggcaaatcgccgccgcaagaggaccaacacctagagaggagcttgtcgcagtcctcaacgcccctcttatgatgctaccgttgttgccgccatctcgaccaggctgcccgtgtctcctacgggccgcctggtcgcatcaccttcgcctccgtcctcccactgtgacagtctcgtcaccgcaccacctcaccttgccgtgctccaccatagcaggctcgccaccacgccggccatgttccactaatcgtgctccttcatgccagggccatcatcatggtcttccctctggagccccacaacaggtgtcgcactctccacgcgcttcgccggccacacgtcgtcgtgtcggccggcgccgtgcgcttcctcctgtcacagcgccactgtcgaactggatctgggagctctagatccggcaccaccgccactgccgccaccaccttctctccagctgccaacctccaccgccgtctgcgcccctgcattgggaatgccaaatccacttccgagagcgtcggatccattgcgcccttgccgatcgactctagccgctgtggacctgcaacgccatgcgccgctccgtcctctcgtgccaagggcgagcttcgctgggtcacgactcacgatgtcctcaccaccgccttcccagttggccgctcgcctttgcagcagcgagctccggcgacggcgaggcgttgagggtggatggaaggtggcgacgcaggcggctagggtttcgcccccgagaaatctgtgcaagagcgacgcggggagcggttagtcttagttttattattagcctgaaactctgaatgagctctaagtggtccaatgaacactgatcatacgtcagaattcatttttactgcatggtagatatgcatgcaaataagtgctttgatcattattcagagtagtgagtgcactgggttaaggcccagttgtctctgttcattcaatcatcattcatcagcctgtgtttttcgacaggcctgagttttagtacttatagcctcctgtaaactcgtttctgtattataaatacctatttgccttctcaatccgacggtagcaatcctgcctttcgttgagaaaggagaaaaaacacagttgcagctgtttctaaccctctcaaccaaaccatttcttagaagaaaaattaaggactgaatttcatctgaatatggaaaactgtccacacatctagaactcagcttaaaacaataatgttctgctacccattttctactgaagggaactcgcagattttttttccctctttggatgaaataatccttgtactagtaaaccacacattcagaatttccatctttcccggacaaggcaacacacggcacacatggcacatcttgaaccaagttaaattcgtcgacaccagcggcgtgatctacggtgcgtagaccaacgcaactgtgcgtggccacttgcaacccgtagaggacaagggcaagttggatggccagccaagatagactagagtgcacatcaaaatctcgattaatccccacgaagttgcagtaattcggtggctacaaagttggacacgaagcacgagcctaaagggctcaaatggccaaatggtacgatgaaactggaaagtgcaggagaagattcaaacacaatgaaatcgggtacttcatccctttcttcttctttttttcttccctatttgtatttcgtttctgtgtaagcatccagaaaaggaaacaccatgccattaacaatctaagagataaaaataattccatgactgcatacgcagtgtttcccattgtgttcatctaaaaacactcacctcatatattatctggtctggataaaagtgaacaaggttaagagggtgagaagccaaagggtttgtctgtgacagctgataagagcagcaagcaacaggcgattactgctttcttaaccaacaaaaaggattccaaacctgtaagataggacacatctgtcaagcaatatctatctatctatctatctattatattattaaaacaactttgaaatgacgcaccatgttcgttgtgggggttagaaattcccacattaatcggagaaaaagaaaaagaaaagaaaaaggagagtccaagtagaagtacaatttaaaaatagctgaaattcaaaattaaaaataagcaatattgaaagaagtttctatataagaacccaatacgagattaatcaaaattcgaaataaaaatataaaaatccaaaatcagaaaaggaaaggagagtccaagtaaaaaaaacaatttaaaaatagctgaaattcggaattaaaaataaggaatattaaaataagtttccatataagaacccaatacgagattaatcaaaaatcgaaataaaaataaaataaaatccaaaattaaaaaagaaaatgagagtccaagtaggaatacaatttaaaaatatctgaaattcggaattaaaaataagaaatattaaaataagagtctatataataactcaatacaagattaattaaaattcggaataaaaataattcccacattaattggagaaaaataaaaaaagaaaaaggagagtccaagtagaagtataatttaaaaataactgaaattcgaaattaaaaataagcaatattgaaagaagaatccaatacgagattaattaaaaattagaataaaaataaaataatatctaaaactagaaaaaataaaagagagttcaaataggaatacaattttgaaacaactgaaattgaaaataaaaaataaaaacattaaaataacacaatacgatattaactaaaattttttaaaaaaattctgaaattagaaaatgaaaaataagatatcaattaggaatacaatttataaataactaaaatttgtgataaaaataaagattattgaaagaaaagaccatctaaaacacatgacaaaataaattaagtaacatgcctataaagaagtagagtggtggcggttgatatgagatataaaaattgttaataaaacaccaaatagaatcctaatgacgattaaaaggagagacgtcaggcaggccgtgaagcaaatgagtaagacgattccgggacttctagaaagtaaaaaaaaatcaattgataatcatattcaatttttaaaatttcaatgataataaaaaggagaagcagcaggcggggcgtataagagtatagttgcagagccgccgacggttgacaggacttctagaaaataaaaaatgaattccaacgacagttatgtttgatttttagaatcacaacaataaagagttggcggcggacgggctgtagaggggcattgtagcatcgtttgatgggacttctaaaaattataaaaaataaaactacaagtccaatttttaaaggttttgaacttctaaaaagtaaaaaaaaaaccaatgataatcatgttcgattttaaaatctcaatgccaataaagaagggaggcagcgggcgagccgtagaggagtacaatagcaaagccattgatggtttagcgggacttctagaaagtaaaaaatgaacccaaacaataattatgttcgatttttaaaatctcaatgacaacaatgagaagagacagtggacgggccgtagagtagtataatgtcaacgtttgatgggacatctagaaatgaaacccaatatgacaataaactctaaaaactataaaatccaatttttaaaggttccaagaagaatgaatgaaaatagtggtagatcaagcaagcaaatagagaaggagatgacataagaggtagcaactggtgtgacttttaaaaactatataattagaaacacgaggatgataaggtttggtctttcaaagtcttaagacaatgaaatagctagatagctatttaataaattttaagtaaaatcatacttaaaaaatatatgattttgtttgggtgctagccgcgcaattgcgaattgagcgggccacccagctagttctgattaaaacagcacgcagaactggtaacaaatcagagacacggtaaagattaacaaagaaaaacagcagacgaattggccccatatcatggtgccatacctagagtgagctaaccagctaaaacgtacggccaaaagaaaagagagagagaacattgcaatctgcaaggcaacaaaacaaaatcatatgcagagcatgagcgcgtgacaccattctgagaaacgctgagacggctgaactattaatgtcacaactgagcactacatacagaggagctgtgatgacgagctggaatctcatcaatggcacctctggctcacacttgcatcacgatgcagagtcacggcggtttcagggatgggccagctcctacaagaggaaacctggatttggcccatgatgattctacaaaatcagctagtagtgactggtcagtgtacagacaaacgactttcaatcgccttgtacatccagtgtgcaaactgttccggagcagcaaacatcagtggtaggcccatcactgatgaagtatcacaagaaacaaaacgcatacagttgaacttgtcccttgagaccgcaaaggacaaaaatttagatatcacatacaggaagttgcgcgatgaaaagacatgtaacttatggcgctgcaaaatttatctgtctagacatgctgtaaggacaatagctcattcagtttatatggacaggttctaaggcctgcatcaagcaaagacattgtatgcaggttttgtcgaggcagtacatggctgaacttgagaattcagataaatgtgataaatagcatagatctatgcattgtttttaaagaaaatagaggtacatttgtaaacaggcattattatagagagagagagagagatcaacattctaaagattaattaatccaatgaaaagaggcaaaggaaattgcatccatcaggacgaatgtgggatgataagcaaaggagagcacattgcatgtgacgcaacaatctaatgaagcatgcatatattcacaaagaccaggactgccaacctgattccattggaaggcattacaattaagtggtaatatcaagccgaggttcaaagcaaaagccagtgaaaagctggagaggaaatcttttgctcacagggcattttgcggaccacttccactgcttctgcttcgtatcgaaagcaagcaaagcagttgcaccatagctttggatgtagacaaggtcgtctgtgccactgctagcaaatacatcatcaaactcaccaaatccttgaaataatttatgaggcattcgacctacctcttgccattgttttttgtgaagttcccatattccaattcctttgatgatgtcaggtctgttctgttttgcaatcccaccaaccagaaccagcttctccctcaagttaagcagacgtccacaggtgagagagcaaggtgctgggatcgacgattgcattagtgacgccttagaaggcccagcaataaggtcatacatgataatgctatgacgcggttcaatattaccaagaatgcctgtggagtgaattaaacagtacaatactccatcacatatcacgctgtcatcaccccctctccaaccaatgaacacctcctcaaccgcagtcacccatgaactactctgtgagtcatacttgtataaagagaaatcccatcggacgtaatcctctggaacttgcttgcattttgccaatgtaatggtgtaattatgagaggaacgatctacctttatggcaattgtgctgtagtctggaaactttgcaccagggggctccaaaattctcttacaatcttttgtgataggattagatacagaaatggcattcctgctgtcattgtccatgaaacaaactaatccgcaagaagaagagacaaagcaactgctcttatctatgcatggaagctctaaatcataccatttgcggagaatcgggtcatatgcatacccagcagcactttcattagaagtgaacataaagtaccatggcctctgaggcaacatgtgggtccaaagaaacctgcttgagtagataatgtcatgccatcttttgcaaactgctgttgaccttatcatgcttactataggtaaaaacgtgaaaattctctccaggatatcatcaggaacaacagtgtccaatgaaagcaaaaattctttgccttcatcgttatcctcggagacaattccgaaattgaatgcagaaattctaatgtgatcaatagaaagagctgtccatgaagaattatcttccatgacatcagtcatcaagtgtgctagcatagatgacctgaataaaaaaaagttatatttataggacagttgcaaagatcatttacctataaataaataaatggaaaataaaacgaacatgggatcataagctaattacatcagtatattatttcaagaaaagctcggttaatgtttaaccacaggaacaggaagttaccattgcctattgcagacatactaacacatgatatgtaagtacatgatatcctaaaccattttatttcgaaagcgctcaagctatgtcagttactattgcagcagaactcaattaccataatgttagttcatcaatcttctgtgctatctgtaaatggtttgcatgccgtggcacagttggagcacattatgttcctcctagtctcctacccaaatgttataaggaacagatcatataaaatatttccacgggccaccgtttcttcaaaaaaaatttccagttcagcggtattttccgtgcggtttaatccgtacaaaaaatcgttttcatatcaatccaccgaataaactctgaaataagatcatgctgaaccgaacagaacaagccgcagctactccagttagtgatggtacaccgaaatattgctggtttgcttttccaagcagaggctcgcagaatgtgcagcgacgaagcaatacattatcaacaaataccaaacgcaccgccgtcacccacagttacagcgcattagaacagcacgagcaaggccatatcttatcgaatcccacatttctcacaaagaaataaagtaaccgagttttttttttcttcttcttctaattttctcaaatggaaaaggaatagagtaggggagaatattaagtgctcgtacttgcacaagcctccgccggcgacgtctccggcccctcatcctagagggcagaggcgctccgtgcccgtcgccgcgccgtccatcggaagcgagctccgagcagaacctccgacggcgccgacagacgatgctaacgcggcgcaggaagatgccggaggagggcacgaggatgctgcgagggggcggcgcgaagggagaaggctcgtcggcgggcggcgccgtcggtatttggttgcgtaaccggggcggcggagggaggcgaggcgaggctacaggccgggcttcgagaagcagaggccgttcggatttatttatagtgcaaaaggaaaggtggtgagatggcgattggtacacaatgtgtgatgttgacatccacggttaagattaacaaaccgagagaaaacggcgggggcaggattaattagccctatctataccaatctttttcacttggctatatgtatgaatcattgaatcgttctctctctaaaaatagtcttactagtgttactcagtatatatagtcggtcgttactagcgattggaaatttggaattggagataaggttggaatgtggttattagaaacaattgtccttgtagagaaacgtttagagtttttcgcctagctccacagggtggtaggctagctggcctaaattcgaaatctcaccccttttaattatttgatattaggttctttcctaatattcgtgttttttttaacattgtccttttgaaatgtttgtcacttgatttgggttttactcgtattagctttgaattttgactatataagcaaaatggctggaatggctcatttcctaaggctgcattcgttattttagattggaagagattttcagccacacgcaaaataagaaaaacttattgtcaaatgattaattaaatagtattaactattacaaacatgaaagattagatttaattaatgtttaaaaacttttatataaacttgttcaagaaaaatacgtatcatttaaccttttaaaagtgtgtttacgaaaaaaatgagaaagttgtaattgaaatttgaataaaataacaagccataagtctagtttatttttttttcaaaaaaatcctcttttctcatatactcactctgtcttctaatataagagattttaacattttacttgcaaaaaattggaattatttttttgacttactttattatccaaattattttaagcaaaacttttcgtttttttaatatctgtacaaatattttaaataaaacgaataatcaaatagtgcaagcaaaatgtcagaatctcttatattatggaatgggtggagggagtatgtggtcagaaccgattagataactcgttccgtcccctctagctcatccccgcaatgcatcgcactcctcgtcgataccgtactccctcgtacccggcaacaccaacggacaatgtacccgagcgtacacgactcggtccccctcccccggcccggccgtgcccccgcgcaccgatcgatgcgccgagtcgaacacgtcgcgactcacgagcgagcgactccccccgccgcagcccgcaactgcacaccgcaaccacacctcccgcgcgcgcgacccggcgacccgagccgcgcgtcgatctgcatctgcatgtgctgccgctgcg

SEQ ID NO: 76288 - DNA, 9297 bp, Oryza sativa
tcaagatacttagattatttatgcacccacatatcattcgcctttatgaggtgatagacaccccagctgatatttatgttgttatggagtatgtcaaatctggagagttgtttgattacatcgttgagaagggaagactgcaagaggaagaagctcgacgctttttccagcaggtaggctttgtaccattttcctggattggtttttaaggaatacactcagtaatcccatctctagttagggtttgcacaagttctaaatgcagcaagtcactgtcaatttttcattttctgttgttgcttccgcattacagatttggtaattttttatatgcattgtactgatatgcttcagttagcatccgaggataattttcttttgtttgatctttgaattagatcatatctggtgttgaatattgccatagaaacatggtggttcatcgtgatcttaagccagagaaccttcttttggactccaaatgcaatgttaagattgcagactttggcttgagtaatgttatgcgtgatggtcactttctgaagacaagttgtggtagcccaaattatgcagcacctgaggtatttatcttgaatgatttgcattattactccttcttcatgattgcataattgcttctatctttctttacctttttcaattccttttccatttgactaggtgatatctggtaaactatatgctggccctgaagttgatgtgtggagttgtggtgttattctttatgctcttctttgtggtacccttccatttgatgacgagaatattcccaacctttttaagaaaataaaggttagcaaagatgtgatatatcctactgataaaggtgctgcctcatctccttttatatgttaaagtaaaactctgtccgttttgatgttctagggtggcatatatacccttcccagtcatttgtcacctttggcaagggatttgattcccagaatgcttgttgttgatcccatgaagaggatcaccatacgtgaaatccgtgaacatcagtggttcacagttggtcttccgcgttatttagctgtgccacctcctgacactgcacaacaggttaaaaaggtaacatgctgccattatgcatctaactatttaaagccgtattctgcttttgaaactttcagtgtttgatttgatcaatgtgagttttgtagctcgacgatgaaactctgaatgatgttatcaatatggggtttgacaagaatcagctaatcgaatcacttcacaagagactgcaaaacgaggtgtttgcttcactccattgctcctctttgttgtttcttggggaatgcatgacaaagtttctgaataatgtgcaggcgacagttgcctactatttactattggacaataggctgcgcacaaccagtggctaccttggagctgagttccatgaatctatggtatgtcaactcatctctctctctcatttattgctttctattgattccaaattcctggcaaatgtgctgttccctgtagcactacaaagtttatgataatttggtgctttgctttctgtgatccaggaatcttctctcgctcaagtaactccagctgagacaccaaactcagccactgatcatcggcagcatgggcatatggaatctcctgggtttggcttgaggcatcatttcgcagctgacaggaaatgggcccttggtcttcaggttttatgctgttactataaggttcttatttattcactttatttattataagttatcctaattcatttgtctgtatttatttaacagtctcgagcacatccacgagaaataataactgaagttcttaaagctctgcaagagctaaatgtttgctggaagaagattggacattataacatgaaatgcagatggagtcctagttttcccagtcatgagagtatgatgcataacaaccatggctttggtgcagaatctgctataattgaaactgatgacagtgagaaatcaacccacactgtgaaatttgaaattcaggtatcattttgaacttgacatatgattattaaccctgggatcatgtatcggttagaacctttgaaatgtagatctgtgcacgatctagttaagtcttacatagttacgcatgcctttactctatatgtgatgattaagctgcagagtatttatgaactgttaccatattcatattccttaaggctatttatgattgaggaagtccatataccgcatctttttttgacgtgtaaagtgtaatgtttggaatattcaatttatgctgatatacttctaattgctgcagctttacaaaacaagggatgaaaaataccttcttgacttgcaaagggtcagtggaccacagcttctctttctggacctgtgctctgcctttctaactcagctgagagtcctttaattatgccgttgtctgcttcccaactgaacttcctgcagcataccgtggattgtcacgtttcatttaagatatgtacataatgaccataatcctccagtagataatatttcctggagtgtgtagacgttagaggctgccagtgatgtattttgacggtaattggccaaaccagaggtaacaggcaggaggcaaacctttctctgtttttttatttgccgttgttgttgttatatgacggtttagacttatctagagtccttgaaccactttgcttgtttacggtgatctttactagcctgattgcccagcctgagaatcacctctgtcgttatgaaagttgagcagttggcatactattgttgatcctgcattccttgacagatgaccgttggatacatgcagagctgttatctttttttttttcacatcataattactcagattggttacccatttgcttctgtatgtgttgactggaatgttaaataagaatagttccctcttgattatactagactgtgcaacggttcatctgagatctgtgctaccattcataaatcaagctggaaatcagatcatgaaatagtcaggtgttaagttattgagaaattcgagcatagatctgagattttaacgaggaatcttagaagggcaatggagtacaaaaatggatatggtctactaaaaaaaatttatgcacagtagtcagcggatagaacagaatcataaattgtgaaagacctattgtaatctaataaaaggttgaaatctgtaaagtaacacgcaagcctctaatccgatctaagctataatttacatcttcgctaatttacacacgaactatgaatccgcgcaaatggtattactgcatcaggtatgcagagtctgctcggctgaagcaaggtgccccatttgctcggtgatctgatcaaccttctcccggtgatggaagccattgcagcctaattctgcttttacatcgtccttgggagactcttgtctttctgactcatccaaacatgaccgtggagtctctgtgaggaaccgctcccaaaacacatcgttggtcggtccatgcgaagcttcagtttctgacgtgccatcttgtgaagtatcagtggaggaggcaatctcagaatttacatcagcttgtgttgggtatcttgtcacatggatatcttcacgaatctctgccattggcagctctggactctgcacaaaacctggagactctgtgagttcagtggataaatggagatgggcattccctgtgttgggtgagctgggatggaggctagctggtaactgaagatcgatgcctgtctccattggagcagtgttcatctcttcaggacatatagcagtgctgggttcagtaccaccatgaccatgggagtacatttcttcagcagctgtgcaagcatcatttgctctctggaagagtttctccagggagaccaggctcagctcaaccctgtcaaaagcctcaccattggtcacaggaagcacgggaggcatggccggtgcatccgtcccaattccctggaactggaacaccttctgttcttcgcccgccgcgcaatcgtcgacgaagagatccatcttcgggaccctcctcttcttgctgaaatggtcggactccagcagcgagctcgacacggcgccaccgcgtctctgcagcatctcgcacagggaggccacgatgttcttctgccgttgctccatcgccactagcctgccttccatcgcctgcatctgccagttgatcacgtactgctgctggttctgcctctggaggtccgcgacgaggatgctcttctcgtacttgagccggttgatctcttcttcgagctcgcgcctctccgattcggcgagtggtccgtttatctggttctggagggagtggctgtgcacgggcttgcgtcgatggatgttcttcagaaggtgcgtgtgccctcttatgaaatcctcgtttgcgaactcccatctctcaggatcgatttttcggaaaccctgaaaggaagatgccaattgaagtcaaaattcagctacggtcaaaccaaccaagaataaagaactattttacagaaaatcaaataggctatataaaaccggctgctgtgtcaatggtaaaatcatccaaacaaaccaagaacaaggaactactaatttacaagcaaacagtagcacatgattgttgcaatgtttgtttcgtttcaagaagcaaaggggattgtgtttgtgactcacgtaggtgttgagctgcctgatgaagctggagaagttgttgtgcttgaagtacttgggcaacaggtcacgggagaagtcgagcgggttccacacgacgaagctggcgccgccggggccccacgacacgacgtggttggtcgccgcgtcctccaccatctcgtacgtcttgatcaagaacggcggcggcccaccgccgccgcctccgccgccgccgccgcccaggttggaactctccatgtcaaccgcgcctctcaattctcaaaccagcagctgctctgcacgatgcaagaacggagcccggtcttaacgcgcgcagcttcgctctcccacgaacaagtcttaaccacctgaatggactcggcgccaaatccaactcgccacgggccaaaatttttcacattgaaccgcggcgcaaattctcaccgagtcgccaaaagacagcgactttccgatcgaacgccaactagttctgcaaaaagaaatgaccagagcatcacatacaagcacgtgtatacacaaaggcgccgcctgaacagttcaagcaaccatagccgtcgaagcaaagaatgcaaagaaattaagaaaaagaaagcccagtgtatgttttttcattatctcctgatacaatcttgcctgccatgccaaggcgcgccggcacgatcgaatcaaccagacaaccacgcgaaaactcacaacctttctcaattctcacctgatcagccacggccacggagacggcagcagctcgcccgacgacgcgcgccctgcacgagcgggagacgcgagaggaggcggcgcggcggagaaggcggtggtggtggcaacgggtgcagggcgtgcagccgtgctagtgcagtggcgcgcgcgcgtcggcgataatatagaggagagaacgggaggcgtgcgctgcgcgccagcgcgagcgagcgtgcggatttctcctctctccggggcgtttggtcgctgcgtgagacggttgactgaccggggaacgaacgagagagagagagagagagagagagagcgcaatcaggagcgcgagggcttctagaaatggaccggcagcgcagcgcgcggttcgctcggcgcggccgcccggcgcgacagtggtacaccggtggtggtccggtccgaccggaatcgatcgtcgctggtgtgcctggctggcaggctggcatcagaccggtactggtagtatttgattcaaccattcaaataccgcaacaggatttcgggatactgtgcgtgttttcctgcatgctttttccatggccatagttaactcatagtagtactaagtaattaataacgttagtacctggtacctatcaaaagctactactaccttcgtcccaaaataagtgcagccatgagtttcagcacccaattttgatcgtccgtcttatttaatttttttttataattagcaattttgttgttataagatgataaaacatgaatactactttacttgtgacttatgtttttaatttttttcaaataagatgagtggtcaaagttgggcatggaaaactatagctgcacttattttgggacggagggagtagtactccatttatcccataatataagggatcttgagtttttatttgcactgtttgaccaatcgtcttattaaaaaaatttaaaattattatttatcttttttgacttactttattatctaaagtactttaagcacaacttttcgttttttatatttgcacaaattctttgaataagacgagtggtcaaacagtacaagcaaaaactcaaaatcacttatattatgggacgaagtactagtttttctgtcctaagatataataaattttaaagaaggtccaacgaatattattgatgagcgccgaatttaaaaaaataccatcgacaagagcaagtttcatgaaatactattatacatgtgactttgtcctaaaaatactgtcatcgttatggttgctaaggagggttctgttagcaacccctccgttaagtggtataggatggaaactttatttaacatcacggaataaggtgaatcctaacgataatagcatttctgggataaagtcgtttatacgagagtatttttggaactcgcactcatcaatgacatttcttaaggttggacgtttgtcaagatattttttagattttctctaaattttacttatgaatattgataaatggggtagtagcttgtactactaggttttgttcgtctattacttttcccaactcatctctctcgtttttccgcatgcacgtttttcaaactactaaacggtttattttttttaaaaaatacgaaagttgctttaaaaaatcatattaatctatttataaaaaagataatacttaattaatcatgtgctaatgagtcgctccgttttacgtacgccgaacattaggtcccaactactccctccgtcacacaaaaaatccattcttagcatccgaaggtggaattaatagatagtgagaatgactaaaatatccttaatcattgaaaaaagtaataagagtgataggtaggtaaaagggtattgcaggaataaaacttctcgttttatgtgttgatggtaggtaagatggtagtgttgatgaaaaaatcgaacacaccggcctgggagatctgcttaactccagtgcaggtccaaaggttggtgagatgcgggcgtgccagtcagtttgatcctgcaactgacaaaatatgcaaataatagataaaacagccgatcggctgacaagctgatggagtagttccagccgatagccgataatagccgatgccgataacagcggatagcgatagggtttaaacaatcggctatatgtccaatgtagataatgatataaaggcaatcggctgatgatgatgtaatatagaaatataatctagtagaaaccaatcggctagcattgatatgatagaattagcattaatccgaaggttaaagcatacatcggctggaggtccgatgtcatgaaatccacaagattagattaaacagtgaaacctttgttgtcatcggctaaatccaatttatatgtatgtgcaatccttatgagccgatgcaacgtccagataactcaccggctgaaaccccgataaaaccctaattggcaatcaagaagcaggctagagattatggttctaagcacgacttagtagatcaaacttaactaatgcagcactaagtatgaaaagaaacatgatatctagacaatcaagctattgactgagttttcagggtggtagatgtctaagataatctaatctagcaacacgatttagccgataccggcagaaaccctaaaacgagaagcagccgatagagctaaattgatatgctaaaactagattaacagagacatatgataaataggtaggcaaatatatcatccaaactagagcaatgcaagaggtcgaatgtactgatgcagccttgaacaacgccgacgtaaacgatacaattgcctggccggcggaacattggacttaccccttagccggagatcgaacaccgatgcagccccgtgtcaggtgccaagttccgccggacgataaaataaagtagaaaaggtaaaaggtggcgatgcgctgaattgtattgatcatgaagatagattacatagaccccgggtgtacatatttatacccatgggttgatacaagtccttgttagacaagaaagaaacttttctaaagataaaaggaaaagataaagttcttatagaacactaaacacactttcctaaagataaaaagaaactaacaaactattcctaattaatagataactttccatgccgcattctctttgaactcggtctcttctgtataagcttcctttagtagatcaatttccttaactgaatatagaaagaatccgacaactgacgacttgataactctcatcggctaatctcaggacttcgaaaccgatgtttactctaagccgatgactactctgagcttatgttgttttttagacaaaattcaaattctggaagttgatttttttttttttgcacgaagggagtgcatactacatacgaactcagcctagcagtactacgatgcacttgacaccgtgtcttgctcttgtatctccaccatttccacacgggaaaaaaactactactccagccgtttcaagttataaggctttttatcttggttaaagttaaactttttcaagtttaactatgtttataaaaaaatatagtaatatttataatactaaattagttccatcaaatcaataattgaatatattttcataataaatttgtcttggactgaaaatgttactacttttttttataaacttgatcaaacttaaagcggtttgatattgaccaaagtcaagacgtcttataacctgaaatggatggagtatttcacaaatcttattatttcatactgcttctaaaaaccaacagcagtgcacagctaggcagactggcaattagcatgtgcctcttcggctcatccttcttttttttcccccatagagaagatatgaaactactgaccgctgaataatgtcagtgttcatggattggaaaaataactttccccctagcatgcaagtaggctgattatgccctccctgcaacctg

SEQ ID NO: 76289 - DNA, 9553 bp, Oryza sativa
catcagatgtctgacaggatgtcagaggggtttttggacacgaatgaaaaaactaatttcataactcgcctggaaaccgcgagacgaatcttttgagcctaattaatccgtcattagcacatgtggattactgtagcacttatggctaatcgtgtagtactaattaggcttaaaagattcgtctcgcgatttcctgcataactgtgcaattattttttaaatctatatttaatgctctatgcatgtgtccaaagattcaatgtgatgtttttgagaaaaaaatttgggaaactaaactaggccttagtattccttttcatttggaacagtggcaactaccaagttgtccttctagtcaaaacggtttaattgtgttgttttgtgaaacttcaagactataatatctggttgtatatcaagttatcaaccaatgtggaccttgacgtttagtttccttaaactggatgtttatttactgcaaaagaaatcatttacatcagccttacaacgtagaccctgtttagttccccaaaaactttttaaaaaatatcacatcgaatctttggacgcatgtatggagcattaaaccgtttgcactgtttgcatgtaaatcgcgagacgaatcttttgagactaattagtccataattagccataagtgctacagtaacccacatgtgctaatgatggtttaattaggcttaaaagatttgtctcgcggtttccagacgagttatgatattagtttttttatttgtgtcggaaaaccccttccaacattcggttaaacgtcctatctgacacccaaaaattttcttatcaacaactgggtgtgtttagttcacgcaaaaattaaaaatttggttgaaattagaacgatgcgatgaaacagttgaaagtttatgtgtgtaggaaagttttgatgtgatggaaaagttgaaagtttggaaataaataaggcctaacggcccgtagcaaaacaaggcagcacatgcagcaaagtatgcagctggccgaaacatcacaagagaagattacgtgtatggaacagaacaccatttccctcaacaacaaaaaagaaaaagaaaaacaggagtgcaccaaaacacctgaaagaatgcaactgacatgacaggggaacaaaacaacgaccctcaaccctgaacctgaaccccggtgtttttccttttttttttttttggcgatgaagtgagtgcaccatgattgcattgcgcagtgcacaaacggcatattatttccagccagttcatccacagattgtgccggatccatcttcatttgaaaaaggaccattttatgctctaattcgatctaaagtgaaaaggttaattgcaagcagaggaatcaagaaacggcaacagagttctcctacaatggtgtccatgtcagaaagtccagaaccagaagaagctagtgcccaacaccaggagtcggcactggtcgcattaaccgctcggctctgccgccgctcgccgagaatcccctcggcctcggcggcggcggcggcgccagacggctaccctgagctccaagccgccctcgaagtgcatcacctcatcaccgcctcgctcctccgccgccagcataagcttccgcccttcgcaccgcgagcagcggagcaggagcacgacgaggaacgcggcgaggcacgcctccgcgaacctagtgacaccgtagccgcccatggtttggatggtcgagctgcttgatgctactctgctcagtgagtgacagagtgagcgagtgagtgaagctgcttgctcgagttagctaacgaagacgagagggtttctattgctctatttatagcgatcggcaagacgattgattcctcgtggccggcttagagctcttcatgcaaactacagacaagaacagcatagtggaaatgtatacgtgcgacggcataaatacttgattactcagtgatttagtcatagattgttctcaagaaaccggctgactaatccgttgtttagacaagaaaccggggctgtttttagctttacagtacctgcttaatttgttatgtcaagcgtctcgagaaaagaacatttggcagcataaagcatgtttcactgcaaatttcgtttcttctatcttcttattccatctccttccgcaaccgtcggccgatgcggtggcgatggcgcggacgcaggggagtgcgcgcggcctggtgcaggcgcggtggcgcggccatgcggttgtggcctcaacggccggcgggtggtagccaggacggcgcgaccctcgcggccatggcgcggccggtggccgatgcgagtacggtcgtggctggggccggcgtcgtgcgtagcggctggtggtgtaactccatcaaccggcgttcaccggcgactcccagtcggcagcgacggaatccaacaaaaacaacaaaaacggaatcgggaggatgcgaggaattctttttcgcaattcaatgtccaagatgcaaaaggattcaagagatttctctaccttcttctttttcggtctccgttagaacatcgtgctgataacgtattatgtaactcctttgctacatccgtagtctagaggggttgcataatgtaaagtgaagatacaagatataagggtgtggcttattctcatttattcttctagcaccaaatgtacaatatgagcatccatctccttcttatacagccttccttcatatatggaaggtttggaatggacccaattagtgtatatgggctgggtcttcataggcccaagcccataggtttcctaatagttttgtgaaacttcaagacaataatgatccctccgtttctaaatgtttgacaccgttgactttttagtatatgtttgatcgttcgtcttattcaaaaaaaattgtgaaatatataaaactatatgtatacataaaagtatatttaacaatgattcaaatgataggaaaatcattaataattacttattttttttaataagatgaatggttaaacatgtttaaaaaatttaacggcgtcaaatatttagaaacggagaggtagctggttatatatcaaccaatgtggaccttgacgtttagtttccttaaactggatgtttatttactgcaaaagaaatcatttgcatcagcattacaatgtagcaaaacaaggctttcatttgccgaaacatcacaagagaagattacgtgtatggaacagaacaccatttccctcaccaacaaaaaagaaaaagaaaaacaggagtgcaccaaaacacctgaaagaatgcaactgacatgacaggggaacaaaacaacgaccctgaacctgaaccccggtgtttttcctttttattttggcgatgaagtgagtgcactacggttgcattgcgcagtgcacaaactgcatattatttccagccagttcatccacagattgtgcccgatccatcttcatttttttgaacgaatagatccatcttcatttgaaaaaggatcattttatgctctaattcgatctaaagtgaaacaagcagaggaatcaagaaacggcaccagagtcctcctgcaatgctgtccatgtcagaaagtccagaaccagaagaagcatatatagcctgttcactttgatgtcattttcaagcttatcaaattttagtaaaattgctaaaaaagtggctatatttagtttgctgctaaatttttgtaactatataagaaatcatgccaaaattttagcttgccaaaatatggtaaggttttttttttgacatcaaagtgaacaggcttttagtgcccaacaccaggactcggcactgatcgcattaaccgctcggttctgccgccgctcgccgagaatccccgcggcctcggcggaggcaacactgccacgccgctgccaccgccgcggcggcggcgccagacggctaccctgagctccaagccgccctcgaagtgcataacctcatcaccgcctcgctcctccgccgccagcataagcttacgcccttcgcaccacgagcagcggagcaggagcacgacgaggctcgcggcgaggcacgccgccacgaacctagtgacaccgtagccgcccatggttaggatcgagggtgcaagcgactacccgcgaaaacccacttatagacttatctaaactacgaaatcgtttattttgatctataagtgggtttgcgggtgacccacttgcacccctagttaggatggtcgagctgcttgctgctactctgctcggtgagtgagtgagagaagctgcttgctcgagttagctgacactgctctattgactatttatagcgatcggcaagatgattgattcctcgtgatcggcttagagctcttcatgcaaactgccggcttgaaaagcgtatctttttttctgaaatagcagtacaggttttgttccgttgttctctttgaaaggactagcagaagcagaatgtctatattgtatacaagagcggcatagtggaaatgtatacgtgtgacggcataaatacttgatttcccagtgatttagttatagattgttctcaagaacatgtcaaccagctgactaatccgttgtttagacaagaaaccggggctgtttttagctttacagtacctgcttaatttgttatgtcaagcgtctcgagaaaagaacatttggcagcataaagcatgtttcactgcaaatttcaaacctccttgatgaagttgaacgaatcataaattaagtattctactggcttctcctaatcgagaggctttatatagtatattaaattgtataaaaatcgtagcatggcgcgtcatcatcctggccataggggcttcttgacctatcagaaattcagaattaactgtttcagcatccgaatgtcggcctggtagtggttagccgctggtttagagtctgaaaacgaaaagaatcaatggcggaaacggtcggtcttcagatgggggagctttggacgaacggctaagagccaaagggaggctaaatctgactcgagaacgcattgcagccggccaggatctcaacatctggtgaaagctgcgtcgcggaaagtttatgtttctttctgaaccatttctttctcccatcttctcgcgtcgtttcttcatgcagccaatcaggttagcttgtcaaaattggcatattcgtcgcttcaccggctaagaaaaactactacctataagagtatatcacgattgaaaaaaaaaactgccctttcttttaactgaagaatgtctatgaacatgcaaatattcagagttatcatggccgaccatgatagttttgcaaaaggggacggcaaaaaactactagcacacagaatgtttgcagagaggcctttctgtgttgtaggttaggtctttaaataattccgtaaactacaaggatgatgacataaactgctctgcggagaatatgcttaggagataaacacactcagttatactcgatcaagatcccctgctcgctgctttctgaaagcataactccaaactgaaatagagctctacgtagcaactttgtcagtggagaatgtagcccatcatttcaagtactggacagcaaatatgatactgaacagcagcatgattcttcgggtttctttctttgattagcgagacccaaaccacgtccattatccacaaaaccaagtgctccatcggtttgactactactatttccaatttttaatagatgataccattgattttgaaaatatgtttgatcattcatctaaaaataattacataaatattatttattttattgtgacttacttatcattaagtgtaatttaaaagtaataacttacattctttttatatttatacaaaatattttataagacgaatgataaaatgtatatatacaaaatatcttcgtgaatctcaagatatataggttaggatgtatatatgtgtgttataggtgagtgtaacgcatgtttatatgatctcctcctccgttccaaaaaaaaaaacttaatcctagatttgaacctgaacacccaagtttggttttttttttatggagagagtaagcgcttaaaaaaaaaaggaagtatacatcccacggacaccgcagtggctccaatgctccatcaacgccgtccatccgcaacagtcggctcatcccagccaccggagagctgaacggcggagaagacgaccaacccagccgtacgccgtcgtcgtcgtccttgtcaccgtcacccccagcttgcatccgcccactgtcaccgtgtcagcgtcgcgcgcgtcgctgccagctcgtgggcgaaaaggcctcgtgccgcacagcacagcgcgcgattggacgtacggtttcgacgagcaaagtagacgcgcgcggcgacggcggagaggagcggagctccctcgcgcgacgtggcgcagcgcgtggaggagaggagtcgcccgcgttttcactcctccgcctttgtagcgttcgcggggatggggacagaaacgaaggacgatacggatcccatcccatgccgcaatcgccgtcgccttcgatcttctcagaggaaaggaaggaggaaagaaggagacgatctccctgcgtgattggatccaaccaaaaacataagacataatatacgtcctaggttgtgattggatctagtgtgctcgcgtgttcttgttctgattagggggcgtgatgtgactacgaatttgattgagttttgattattattaaatttttttcattttctttctttagatgagtacatcaggatccgagagcgattcggtggccgcaaagcgatccatgaagcccaagtgtacgtgcccattcttgcccctgtctctttaattgttctctgattttcttttgtttggtttggttacatgtctaagatgaaatgtcgcaatgtgtttggaaattgatgagagtttcagttcagggttctttctttgtttcttttttctttctcctgcagattctaagttcacgcagcaggagcttccggcatggaaaccactatatactcctggaattgtatttactcccaatctctacattctgttcttaatttcttcctgcgctatcaaattatttttatcccaaaaatggagtgctagattttagcaatctctgaataatgtaacctggctccatgaataggtcatcggggccttctcgctcatcggcatcatcttcataccgatagggctcgtttcaattgcagcatcacaggaggtaattgcacagatatgcaacatgtattcttgaattctgattatttgactattccggcactacgtgaaatacatttctgcttatatttattaactagctaaatgtctgtactttgctacggttaaatgaaaatgtattaatgtggtgtccatctttttctatagagaatattcatcttaatctcaatttttatgtatctatctatttagatttgattttttaataatattaagaagtttaagggataacttaataaaatttacaatggaagtaggtggggtggctgattcacggccaccaccattaacttcttttaatggtaatttttatcattcttaagaaaatactggcaagtactttttcaaagacaatagaatttctcttcttttaaagaagtatagaagtatagatagtctggcttgcaacggtgggttaaatttgtatttaaactcatttcttttaatacagtgacgttgcaaagttcttacgcgtttgtcaaaaagaataatctggcttgccatgcaggttgttgaattggtggataaatatgatggggagtgtgtgacggctaacgacaaggtcgggttcattcaggacaccaagactgacaaagcgtgcaccagaacgattactgtaagtttatgcccgttcgtttccttgtttgacagttgcaacttccttgtttttcattaacttacatcttaatactaaacgtgtgttttttatagtagaagtttctttagaaaatcaataaatatatatttcaagtttataatcatttaatttcaattaactatgcattaatggcttgcctcgttttacgtcaagagaaaaactaacagctactatggtggtgtttggatccagggacttaactttagtctatgtatttagacactaatttagagtattaaatatagactacttacaaaactaattacataaatgaaagctaatttgcgagataaatttttttaagcctaattaatccataattagataatgtttactgtagcatcacataggctaatcatggattaattaggcttaatagattcatctcgcgaattagtccaagattatggatgagttttattaatagtctacgtttaatatttataattagtgtccaaacatccgatgtgatagggacttaaagttttagtcccatctaaacaggtctatgttcactagaattgagccttagatgacacaactacacaacatggttgcccttagctcttaccagatttatagtatccagtaaataatgatttttctttactcatttttcaggtgccaaaacctatgaaaggccccatacaagtttactaccagctggaaaacttctaccaaaaccatcggcggtatatatacgctagacctggatgagtgatttcaacttaattaactggccattgtggtaccgaaatgaacactaacgtacaacaatcttaattcttagatatgtcaagagccggagcgataaacagctgcggtccaaggagttctcaagtgtgataaaaacttgtgatcctgaagccatcagtgaaggcggagcccctattgttccgtgtggcctcatagcatggagcctgttcaatgacaccttcacattttctgtcaacaagaagactgtccaagtgaacaagaagaacatagcttggagcagtgacaggaccattaagtttggcagtgatgttttccccgaaaatttccagaagggtgggctcataggtggtggtcagctaaatgagaaattaccagtaagtgcagtcaaatcaatcatctttatcacactagactgctcttttcgtgctaacgcgaatattagggaataacataatatcgaataattagaaggagtgaggcttcgaactcaggtcgcctagcccaccaccttattgagctagccggaaaacccctaggcgtttctcgtgctttcttttttcttgaactgaattgtcctccatattcagttgagcaagctttctctgcagttaaataggtggctctccattgttcgctcttcatcttatcggtcatagctaaaatttaaattttcaaacttaattttaaagtttattaaaaattttttatcgtagtttattttctatattgattttttaagtcgctaaacacacataaggaaaagttttgccctataaattatatttttatcgttaataagcattatggcctataatcggctgctggaagtaaatttagttacagctttatcacactagactggtcattttcatcattctttttttttctgaattctccttcatgtttcagttgagtgagcaagaggatctcattgtctggatgagaacagctgc

SEQ ID NO: 76290 - DNA, 2147 bp, Oryza sativa
tactggtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaaagagagaaatggtgcatgtggtatccccttaagatataaaaggaggaccttgcccactgagaggggggactggacttttccagattagaaacccaaaacaagggagaggctggctgatactttgtagctccttcatacacagatctcccaaaacacaggagtagggtattacgcttctcagcggcccgaacctgtatacatcgcccgtgtcttgtgtgatttcactctcgcgaactttccacagaccaagagcttagaacctcacccagggcccccggccaaaccggcaaaggggggcctgcgcggtctcccggtgaggagccccacgctccgtcacatgtggacaataataaaatgatttacattatgaaacggtggaagtattttttttttcaaaaatgaattaatttgatttttttaagcaacttttgtatagaaacttttttaaaaaaaacacaccgtttagcagttttaaaagcgtgcgcgtggaaaacgagggagatgggattgggaagggggggtgccgaacacacccttagtagcatcagagccacaaggtggacagtggtcccgtgctagtggtaggggcaaacgacccaactatatcgactagttaggatgacggtgaatccgaaagcgggcagccgcagagataggaaaatcagcggggcaagggcaccataccgccgcctgcttaaggaggagatgcgggaaagggtggaggtcggctaggagtagagatggcaatagagacccataacccgagacccgacaggtttttactctattagaagctaattgttctaactcttatacacatgggtctactaacgggcgaaaactcttatctattgggtacatggctatgggtccgttctttacccacccgtacccaccaacctgtgggtgaaaaaaaaccgttgattgagtcaaactatgagcaatataagtatcgatgactactaaatcatagcataaaactcatttcacatcttaagtattgttctagtctagttatatgaaattgttatttgatttcttgattatgtaatgtggttgtataattttttttcctcacctttgaacgctaatgttaattaatagtattgttgctaaagaaaatattgatggtttacaactctaatatggctaattatagtacaaaattataaatgctgcaagtcaattatatgggtatgggtatctatacccgttacccacacgggtgtgggtatagggacgattttgtatccacgatggatatggatatttaagtgagaatatttaaacatcacgggtgtgagtatggggcaagctaagagaacccgatggtatgcacccattgccatctctagttaggaggcctcgttgacatcattcgcgccttccggctagctggcggggccagattgacggtattggtggggcagattatggctagacgaggggagttagggtgtgtttagttgggaaaagaaaatttttgggtgtcacatcgaacgtttgaccggatgtcgaaaggggttttcggacacgaatgaaaaaactaatttcagaacttgcctggaaaccgcgagacgaatcttttaagactaattaaaccgtcattagcatatgtgagttactgtagcacttatagctaatcacggactaattaggcttaaaagattcgtctcgtgatttccttcataactgtgtaattagtttttctttttatctatatttaatacttcatgcatgtgtctaaagattcgatgtggtgtttttgagaaaaaattttgaagaactaaacgggcccttattacatggaacaaagaaatttgatggccaggcactggtgtcggcatcagagccacgaggtttggagtgggcaggagcagacgacctgactagttaggatgcagcagtagatctggaggcgaggagccgcaccgagacggggaagctggcctgaggaggagggcgggggttggggggggaggggggg

SEQ ID NO: 76291 - DNA, 19842 bp, Oryza sativa
  unsure (1)..(19842): unsure at all n locations
ttttttgttccatgtcactctcatcgttgagctgtcaatctgccccaccgccgctgtctatctagcctcaccagttagccggtangcacgcgaagggcgcccggaggaggccggctaggcctccttagcgcgccatccgcgtgcattccggctaactgttgaggctagattgacagcggcggtggggcagattgacagccaaacgatgagagtgacatggaacaaaaaaattcgtggcaaaatccaaaagatttctgaatggaatgcaatttatattaaaaaacctatgaattagatggcaaatagtgaaatttctcacctgatcatgacaccctgtttagaaatatgactatgtttagatgggactaaaacttttaagtccctatcatatcggatgtttggacactaattataaatattaaacgtagattattaataaaacatattcataatcttggactaatttgcgagacgaatctattgagcctaattaatccatgattagcctatgtgatgctacagtaaacattctctaattatggaataattagacttaaaaaatttatctcgcgaattagtttttatttatgtaattagttttgtatatgtaattagttttgtaagtagtctatatttaatactctaaattagtgtctaaatgtagagactaaaattaagtccctagatccaaacaccaccgtagacacgaatcaactaataccgtagcacacctagatgcagatgcacctagtcatattctctttctcaacacatatctgagcacctctgttggcgctaccctccaaaagagaattagaacgcacagcggagtgcagaagggtgcaccgaagatgatcaagtagacaatgttggagatgagcaggtcgatgccgatcggggctccaatcctgagcacgaccctgatccccatcctcctgcgcaccacgtgcgcgcagctcaccatcagcaccagctccctgttcctgaacagcatcgtgccggcggcgagggcgcagacgccggcggcggtggcgcgggacaccggagccagcaccaggtacacccccagcgcgaaggccaccagcaggctcctcatcgacaagcgcatccaccacacggaattcttgaagtacctgtgccggacattcatctccaccgccgccgtgccggcgtacatcaggctgagcgtggcgagcatggagcaggtgaaggccagcgccacggcgtacatgaacgcgtcgaaggcgtaccgccccgccagcgccggcgcgccggctgcgacgtagcctcccgggggggagaaggccacggcgaaagccacggtggcgacgagcacggagccgacgcccaggacctgggccgactccgtcattttcttggactcggcgctctcgtcgagcttgggtacgtgccgctgcaggaagtgatcgcgcctgatgtttccgccgctgagggcgttggctattgttagacaccaaagtatccacgttcgcgcgttctgcagcaacacgagcaaagttttacccaattttgattagcttaacgatgtagttctctccttccggtgctaaataatatttgacgctcttttaagattcgattaaactacttttaaaactttggacatcagtttcatacaccaacaaatttataaaatctagagtataattcataaaatccctgtatatttggtctaaattgtacgaaaccgtatgagttttatactgtgttgcgcataacagcatgtattatggtgctatagtttcatacacttttttctaatctactatgcatatgaattttatgggttcgtttatccatcaaagttaattatattttattgtgctataatattaatagttaagttagttgacggtgtggttttctaagaactagtttaaattctagatttgataaaggggctcgtatttaccgctatttatttttttagtggtaggtggcgtttccatcaatagagaggacttcatcaatctcaagatataccgactcagtcctgaagatgctcacaaaaatagtgtgtgcgcgtgctatgggtgcctatgttcgttccatgtttctaacaaaaatacaatactacaagtatattcgtactatttttttttcaaaatgcagatttacatgatttgatataaaatagtttaattgttgtgaatttatttttaaaagaaaaacattattaaaaagggcctgatctaagggcacgtacaaacgtgtataatagcggtctctctttattgccatgtaagtaaatttgataacgtggaagagagagaggagagaaaaaaaaagcatggttgctatacatgacaacaggtaagagtcaactcttaacttttattaaagaaaattttgttgtatgagggtggagaaaagaaaagaagggtagtaaaaaaatattttggtacgttaatgattaagagttcttgttgtctcaactattgtaacagtatattctttaaataatatgtcttacttaaaagaccatatcggacactatttttgtacatgccctagtgaggtaaaagtgatgtaccgttctgttggagtaaagacccgctggaatggtactcctggccaggtcagccggtgtgaggccgtcgttgttggcaagatccaagcaaaccctgcgattccgaaacaagcaccagaacactctcagcaccccggccacgaccgccaggtgcagcgcggtgttgccgtcgtcgtcccgcgcgttgaggatcgccgccgccggaaaccccgtccatcgacgtcggaggcgaatcccacgacctcctgcctcctccggtcgacggcgacgtggaggaaggtcctcccgcgggcgtcgcggaggccggcgcactcggggcacttgtcgagcaagagggcgacgagcctcaggttgccggcggacgcggcgacgtggatggggtagtcgccgtcgccgtccggctggcaggccaaggacgggtcggtctccaggagaagttcggttggtgtccggcggcattggaacgggcacggcaagaggagccaccggaggagtgagctgttctcgatgtcgatctttggtccgtccgccgaggcggcgaagtggagcgctgtgctgccggacgcgtcggcttcgccggagagcccggcgttccattgcattatcttttctgtcatttcttcaatttatggagaaaagcgtgagaaaaactattactccctccgtcccaaaataagtgcagttttatactattcacattcaatgtttgatcgttcgtcttatttcaaaattttttatgattagtatttttattgctattagatgataaaatatgaatagtactttatatgtgactaaatatttttaattttttcataaattttttaaataagacgaacggtcaaacgttagacacgaatatccatggctgcacttattttgggacggatgtagtattaaggtactactgctaccgtgctctctatgagatgatatgatgttaaaattaattacaggagcagttaatttactactagtctctaacccgtacattgcacaagttacgtttggatatttctttaagtgggaaatctaaatggagagcattcttgattttgtcttatggcacgacgctccgccagccatccatccgcgtcttcatgttgtcggagagataggcttgcttccattgcaatggcatcaaagcgaggaaccttcgtggcgtcaggtatcgctatacaccaccaaccatcgaaactaaatattggttacacgagtctattctttttctaatgatgacttatatattttaaatcatatattattttcatttttgtttgtaccatcgtgctctactcaaaatatacgataaaacaaatttaatatttaatatattcaaacatttaaagtaatttacttaatttcaaaagtaatttagtaaaatcgtagaagtaacttagctctgcaatagaggtaactatctaagcattgaaagttgttatattgatcaatcaattgatgttgactgagacacggacacgtaaatattatattgacgaagagtcaaagaaatgagaccacttgacaggaaaagaggacaacatactatctgctagttatcatgtcgattcacgtgcatgctactgaggctaacatgtcattacactagtataatgtttttttatagaatctttgatgacctatatatttttagaccttatattacttttaagatccattttgctcaaaatatgtgataaaatgagtctaatattgagtatatttaaattatttatttattttcttaactcctttagaagtgtagttacttccaataatgtgcactatgtagtcgtgtccttttcaaatgtattgctagattttaagctcttgaaaatacaaatttccagtcacctaaaattcaagccctctacaaatcgagcgtctgatttcctaaaaaaaaaaaatcagacggtctaacgtttcaattgaccgatgactgaaatgttgagtagtacatggtgaaacatttaagaatttgtgaagcatagtaagaacacatgttgaaataggtcgctattacgtatgaaacaatgtgttttattggtttgaaacatattttttattaaaatataatcatgcgatatcttgttataaagatttaattataatgaatattatattatgtttggattatatattggataagtaatttagttgaaaaatatttcaaagattgctacaagcctatatgcatgaatggaatgaagagagagcaagtatatggtagaagagagagtaggggtagttatgtccgatactttaccagccacatctgaaacgtcatgctatacaaggtgaaaaaaaagacattgaaatatttatttttcatgtgtaatacattaaaaatatatgttgaaacatgtcgcattacgtatgaaacatttagtattaacggttataaacatatgattatattttagcaaaataatcatgtgatctcttattataaaaaaaattaattgtaacaaatataatagtacgatcggatcgaaaatccgataagtaatttaggaggaaaaaaattttgaagatagccacatgtatacatatatggataaagtggtgaaaaagcaaagtagtatactaatatggcagccatatagtagcttagttgcgcccgattttctttcctccaatcgggttaccgataggaatcattctcatctaaaattgcatatactcttaagcctaaaattatggtggcacgtgcggaacattatttctttttaactatagttttattgttatattttttttcctattttcttgtctaagtttgaatgttttttttaaaaaattgtatttttttgaaattgtaagttcatgtaatgcaattttgtaatttttggagtatgccttgtttaagtaagtaatagtggagtgatgagaagaattacatcgaaaactcactttgattattcgaaagagtgtaggtcaattttttatgctacaaggcaagaccacctatctaaatataaggctaaagccaaattatttttcgtcatttattgatctcttcgacggaagagggtgtcctaaggcgcactaacgtgtgctttgccctgtcataccagaacttctgaatcacttaccaagacttctggtattcctgtagtggcacgtcattaggtatcgttgagggttgcaaacgtagtgctagatgtgttttgggatggacacatttttatgtcaacaatagggaaacacatggagtcatggttgtataatttgacttatcatggagccgaccacctatattagaacgcctatagaaatacaatatttatagaaactgttgtcttaacttggctgcacgtagaacaggtgcctgcatatgagccccccccccccccccccaaccaaaagtatagaagcagattttataatgcactatatcaagtaaaatgagagagtgtcttctaaaatcgttttatatagtgtaaatcatgttaatcacacttcacacgtgcacatacgtttttaatatgactttagtgaagccaagaggcacgccaaagtcaacctcttggcttgagcttatgccaagaggtgcatttgtcgatgtgcttctgtttctttgatcgtgcctcatcagagtgtatttgtcgatgtatacgtgtgggtctttcatatgatctaaattgatcgtgcggagaaaatgttttcatccctaaatagttataaaaaacaataagatagccaagtatgaaatatattactttacaaatatgtaaataaaaaaatcaacttttgaaaattataaagaaacaaatataaccaggaatgtgtgttaactatttaagttgaatttgtttcttttggtattagttgtaagagtccaatttgatattacgagtgacatagttcatatcaatctatgttaatatatgctgttaatttttttaagaaaaataataactatttagatgatatataagaaatatatcccatcgagaaatgaaaaaaaaatcaatcttcacttgtaggcacgtacctgcgccgcgtaggacagcagcgtgcagggcagtttggccggccggtccagaatacgagagctcgtcgcccccttgctgatgcaggagctccgcgatgcggtcgtgccccagtgagatcgcctggtacaacggcgacatcccgtcgccgccggggagacaggcgagccgcggatgcacggccatcaggtggccgacgaggcgctcgtcgccgagcctgacggcgtcgtgcagggccgtctcacgccggccgttctgcttctccagcacgtcggccaccctgaacctcgcgccgccgggctcctcgtcctcctccatcgccatgtcgaggaggcacctgaccatcgccgcgttccccgccctggcggcgcagtgcagcggcgtgtcgcccctcgcgttggcgcgatccaggagggccatggcgctgcggtagatggtgcgcgcgcagctcaggaacgcttcgctgtcgccggaggccgccacgacgtgcagcgcggagtctccctgcggcgtcgtcgccacgtccaggagcagcgccgccgcggtgggtggctgtggctccccggccgcggcgacgtggacggtgacgtggtttggcgccggagcggcccccagaagtacagcctccagccactcgcggtggccgccgcgtgcggctctgagcagcctgcgatccatcgatacggggtctgaatcaaatgatgattaggatagaacattatattgcagagtggctgtgatctagacccgtttggtatgttgcgattacttataattaacatgtcagagatacttagtcagatgctttaaacaacatacgagacttgctggaagcggctagcactagcacacggtcatgcgtgcaaaaaccatggacgtacgaaccagcggatcagatcaccttgtcttgcattgcatcccgtgtgccgggtgtgaccggccggtggcagagccagcatcgccatcaagtctgtgtgactgtgtgtgtacgactataaccttcttctcttttagatatattaacatgttatttatagtaataagtttgaatttataatgataattacaatgtaaataagtgtgtgtacgacatcattaatttcacaagaagtgtagctataaagtgctatatatctaagccgtaatatatggtaatgatattatacttcaaatttatttatttatgtttttttgtaaaatcataggaccctaaaccctgcacatacatttaaattaggggaacgaaagatctaaatgaggattatgctgaaagagacttggaaatgggcatgagcctaaattaaccaaacaactcgtatgaggagcaaataaaaaattaaggcgtgactcaaggagagatggtacactgaaaagaaattttttgatgcaaacaaaaggtaaattagaaagcttaaggtattgcgttcttcattgatggaaatattacagatttcatggatgccaaactcaataagttttgtattttgatcgtgatgcgaagccaggaaagaactcaagaacgttcagctgataatgcaaagttcttctgttgaacactgccactactacagatttgattttttcgtacgatcaaaatagattttctcatacggagatcccacccgtttatattcagatgtttgcgaaaatcaacatttgcccctcggaggggtgagggggaaccgcaacgcggcaaagccacggtctccacaacgcggccacggcgttctcccgcatgccgcacgccctcaagttgtcagagagctattaggccatttacaatgcaaagacgtggagttcagcctccacatgctagctcggagattcctctccacctaggcacttttcactccctcactaggaacggggagccaaagtaagcattagaataactaacagccacgattcatcaccgttattagatcagcataaaccaaacaaaacaagcagatgtgatgcgaccgaggcagctttattcaacttgtccagaaccacttctctaccgactatcacttttgcatgggtaaaattaactaggtaccacgggttgattgtacagtatttctcaatgggacagacatgccgaaacatcaactatttcccccactctcactactctccatctcaccgtctttcagaaccttggcaaaatctggcgttggagctgtcaaacatgttagccgtcaggtcccgtctcctccatgtctacagccacaagcatccatgccctctcctactcactgcacatcaataacagtttaagaatagtaatattgtggtgaaaaggatgctcactgctcaggcgatcagtgtacaaaccttgtttagagctcatccttgagaggctcggctggggccgactctgccttctccttcgcctgaccagcggtttccttgttcttcttaatgaagtcgacgatctcgtcggctgtcctgccgctttcatagggaaccatctttccactgggggtgacgaagtacagggtggggtaaccttgcacatcgaactcgcttggcacatcgttcgcagttgcatcctgcatacaaggtagcaaaatagtagttagatgaactgtacttgtgataggaaagaatggatgaataatgcactcaaaactaatggcaccacccagatagaaaggaaattaccatcttagcgatgacaacatccttgtcgcttttaagcgtcgtagctgcctcatccaagattggagccagcttcttgcagtgtccgcaccatggtgcatagaattcaacaaggactgaaacagaaaacagcaaataaatgagagctgcaaatcaaatagaggctttgccagcactgataattgaagaagctacaaaaaaatagcaaacttgcttttgaccagggaggaatcagtcgctcacaatactaatataagaactaaaaatcatctcactgaaaagattacgggggacaacagtatgtaccgtttttgccagacttgaagacaaaatcatggacgttatcagcgaccacaaccttaacaggctcgtcgttgacctcaggaataggttcagacttcctgaatggagacaatttaccatcctaaaaatagaggttttgtgagcattgtgcaggtaaacaaatatcctaaaattacataaatagtaacaaataatcacaattatattttacaagtataaaagactacttacaaagtattccttcaaccaagaaacaatttggtcaggctcaacgtgtgccttcaaaaatttcttggactcaccatcctggatgatgatgagtggtacctgatcctccctcagcccaaagtactgtacagtgacagatttaaagttagcatcaagtacattaataattgtttgaaaaaaattataagaaagtgaggtaacaaacctggaaggcaccttgactggcctcaatgtcaccaatgaggaacttaatttccttgtccttgaactcctcagcagcaccataataaactgacttgaaagactcaaacggtccagtggagaagttcaaaaatagcatagcctgcatataatttggtaacgtttagtgtcagtcatcaacaactgcaaattactggcataatgatatacggagtattaaagaacaatatttgaatcactgcgtttaatagtgagaacttgcaaatatatgaatggagaagggtatcagatattacagtctaagcaaagtctatttgaaacacgagaaataaacatttaaattgactattaatatacagtatcaatcaactactgccagctgttattaaaagaatggagcttttcagagagcaaggaatgccaagcgcttaccttggcagctgagctttggaaaaatttcagaaggtaaggatggttgtcagggttcttgtcaaaagtaacaactttaggggtgctgctagcatcaatgaacttctccaaagcagtaacatcaaaatcctgaagagatatgcaaacaacacattattgacaattaaccaaaataatgccagccaataaaggctgtgacaagttgtaggaaacatagtggccaaatgaatagttaaaacaatgaagtttgatatttgaggagttatataccttgctgtcaacaacaagctcatcaaagggcttgaatagcctaaccaatggtctctcaactgcagcatcaccgcgtggaaggtggttggcatgcaaggtgtggccaaagtcataatcagatctcagcttctcagcaacctctatgaagtttgtatactcagtgccacttaattctgagaagattccaacctatttcaattgctcattcaagtcagcagtcaattttaaagcatgaacagtcggaacagaaaatataagttggagaatgtgtcatattgaatcgaggtcttacaatgtagattttcttgtcatcaataaggttggttgcgtcttctggtgacttgatctccttggaagcaggaccaacctgcttcttcaagtattcaacaatgccctcagcctccctcgggcccttgtattcctgaatgttcttgccctggttcctgaatatcttgagtgtcgggaaaccctggatctcatacttggtagcaagaggcttgttcttctcgtcgttggcatcaaccttggcaagaacaatcggtggatcgtgcttgcttagctcttgtgcagctttctcatactgaaacagatcaagcaaagaaaattaatacatgggatcaaaccatttaatccaaaatgtgaaaatgtgctgttaaggaagtgatccaactgtacagaagcatacctctggagcgagcttcttgcagtgtccacacctgcgaatagggtttatccaattagacacatttagaacaagcattggttaaattttgattcagataacacaatagcacgatgcacaagcataatttcataaagaatcaacattgaagtacaaaaacaaaataatagtgaataattgaaccaagactacaaagctatctggatttaaaacctgtgtaagtgaaagaacacccgaaattctcagttgcaaccctgatacagacaccttataactcgaaaaaccaagtaaccaactcactcaatctaaaccactgaaatctgactaggagaccaggcatacacatcacaaacaaggtaaatctactacaatttacagaatcggctcatccgcagtcacaggtccacgcacaatcgaatcggcgaatcctatccgaatctaagactggatcaccaagatcgagaccaacaaacgcatcaattcggcaaacaccgagcctcacacgcatcgccagcttccccaattcccgcatctgaactgaagtcctaaaccctccccaaacctcgcgatctaaatcccccccccccccaaaaacccacctcgcgagatctaacccaacacgcacagctcatcaacaggggggccgtagcagagcagagcagagcacactcaccacggggcgtagaactcgacgaccatgaacgggtgcttggcgacggcctcatcgaagccgtccgcgtcaagcgtcagcacggcctccgccgccgcatcgcccccctcctccgcagccgccgcctcctccgccctcgccgccggcgccgacagcaccacggcgagcgcgagcagcagcgagatccaagccttcgagatcgccatgaggaggagacggagagtgtgggtggctttcggaatttttccctgagacgacacgcttctcacacgggttttaatagggcggagtacgcgaggggggggtttaccggatcacgtggaccaagtccacatcgaccctgaaactgcccaccgggccccaccccgcggactccctcgtggacgcggcgcaccggagtcacgagatatttacaggtaacatttgcgatgaaccccctgtacttatcatcgtcaaatcatccctccacgaggctgagatgtgctaaaactagaggtaataaattactaatatgcccctgatgaggagtgatgtgtaattaagtggaattaggggggcgaaagtggggtggtcccgagggataaatccaatcctgtgacttcaaaaaaggcaggggaattaacgacggccaacgccacgtcaccgcgcgccccgactacgtacacgtacctgtacagccctcggccaatgggagggcgccacgtcagctctatgacatgtcccggagccctgatttgctccgcgcccccaccagcgccacgcaacgcacacgcttccaaaatccggatccgggtaaattaggcggcgtttttactgctctcggatacgataaaagctgtgtagtaaaataattctaatattggcctcgtgtcgcgcgtgattgctgacgcggcgctggatcgagctcgtttgcgttgcggcagtggtgacgtggcactgttgaactccgccacgtttcaccgggtggtcccgatcggatggctactgtttttctttttctttttttcaaatcgatgactgttttttttgctgcgacttattttaaacttgtcgatcacgagaatgtgttcacgttcacggtcatatagataagagacacattttattgtttcgagagacatttatagtcacagatggcagatccggcgatgggcgaatttatttcgcatcccacctcaaaattttacaccatatcacatcaaacgtttaaacacatatgtccacgagtgatactcgtagaccgaatatagagggtattggggtacgttggtacaaggatctacgtaatacgacatcaagcaaacagagaacgaggattatactggttcagaccccttgatagataatagccctaatccagttgatatgggattatatgatggaaaagacaggttataaagggaacgatggaactcgatgaaaccgacgggatcgtaatcgagttggttcgactagatctcccggcgatttggctcctgcaggctccgacttcgtaggctgtgggggttgtgttggctccgagattcgatgccttaggtcctccagggggtcccttttatatcgcaggtcaggcggtttccaagtagaactcggagacatcggaccctacacgatacattgacgacccagtctgtccgagtaggattctttccatctgtaaactccgtgaaggatttacttagttatgcgcagaatgtccatatacgcgcagacatgccatatcgatatgtgacgtatatcgaagggtaaagggtatacctaacccgtaaccttgacagtagcccccgacttctgcttaaatgaactcgtgtaaccaatcgcgacttctggtgtcgaggctgttgttgttctcggtgtgagaactgtggagacaggacatagccgagaacaccatgtgaagcccaacggtcatgagcgaatttaaactgaagtgagaaagactgccgcgcgtaacggaccaagaaatttccggcggtcatctctctcctttccttgaaatttgcaccgtcggaagtgcgtttatttaagagagttttggggatccattttgaagtctgcctgttgtgaagaaaccctccaacctccaagcgcttctcgtcttttccgctcccgcaaaaccctagctcatcaatctcagtcctttctccggcgatctccagtcagcgatggatctcggcaagtcctcctccaccagcgcgtcgctgaataagctacaggaggatggcgcccctcccggtcgtgggaccatggagagagaagaaggaggtactgaaccccagcttgtcctaggtcgcatggttgcgatcgaggactacattctctgcggttttctccctccgccttctgaatttcttctcttggttttgaacttctacggtctttctttgctccatttgaaccccaattctattgccttccttagtatttttttgcatctttgtgaggcctacattggggtagagccttttcttgatctctttcgcttctactacgagttgcgttggatgtagtccaacagggtatctggatgcgtcggattccgactccgggatggcctgaagtcgcgttatatccccttccagtgcccttcctctcatagcaaatggcggacgaggtggttctatcttcagatagaaaattcggatcctgtctttgttgttcctgaggaacaaccagacaagatttcgtcttggaccgcaaagcccaccttgaccccttcccttcagtccttcatcgatgttatcgacgatctccgagtacgaggtttgtcggggtatgaagtcgctgctgacttcgttggtagacggatccagtcgctccaggctcgagcccatctagcctttgactattctggaccggaggacacgacccaggtttctcctcggggtatctttcttgcatttaccctgacttgcttgtgtgcgcgttcctcctgacttatcgaactttggttctcgattcacaggtctgagcagcgaagccgtgggacgtcgtgtcggccaggtgatgatcagtggcccaacgatggcgagcaatgtccccgttctcctttgcgagaagggggcggccgaacgcgacgctgccatcaatgtaagtgtactcagtaggccttctgtgtttttcttccgggatcgccttatgacttcataaagcgtaggctctccctctgactgatatcatcgggccgctcatggaccatcaggtggcggtgtcactaaaagagaaggtcgccaaggaggcgtccgatgctgctgctgtcgctgccacaacaagtggtggcgacgttccaaaaaaggggaggaaattctcctctgtaatcggacatcgtcgaaaggcacctaccccctcggtaagttctcctgtcatttgatcacgtagtcagaatacttccaccccacatcatatcgattgtactccaagccttggacgcgtctcccctgcctccacgacggcagcggcttgtgacactcggcgagaagtgagtgaatgaatttgaggtttcgtgatttcgtcgaactttgtctgaaccacagccttcttgtagggcggcgcgggccaaggcggcgcaggacgggtctggagggacttccagcgcgtctcctgctgtagcctcgacggatgtcgtggtcgtgcccgggagccacgaggcgacaccaagcggcccagccagcgatctcgtggctggtcatggttcgccggctgccgtcctcacctgggaggagctccaggttgagatgtggcgcctcctcgaggctggtgctcgcggcattggccgcgagatcatggaggtgagagcggcggcggcgtcgtcgtcggcgaacgagcgcgccgaccggctggcacacgacttggcggaggctcgtgaggacctcaagaagatgaggaaactggtggccgggaatgagcgacaacggcaggggctcgagcaccgtatgtcggagctcgagaacaacttatcggaaatccgtggctcgttgcgggtcacctatactggtctgcaccagctcgccggggaatgcggtatcaagtctaccatccccgcgaatcccaatgagttctcgctgacgtcttctcttgcggagctggcggcggcgatggaggagattccctccaagcatgcggccaggatcggagaggagacgtccaacgggaactacaccggggcatgccacgtccttgcgtgtgtgaggctggcgcaccctgaactcgatctgcgggagatcttggaatagggggcggctagcgacgcgcataaggatgtgatggaagaagtcggtgatctgggggagtctgttctccccctttttgaagagtaggattttgactctcttgtactccttagacatgctgtataaaactccaattggctccaaccgcctttgtgcgtgcagtcatcaccttagtttgctttagcattttgatcttgagtactttttttgtcccttgtagagatgttgatgtcgaggatgtccagcagcgtgggcagcctgagtcgccagcgatcattccggctcttgcgtttgagccacacgcgtcgccggacgatgtagatcagattttacccgcgagaatggggatggcgatgacttccttaggttagtggtctcttcatccctttttgctcctccgacttgatcaaccgtgttctcgaaagaggagtgcagcttgacttagtcgtttccatattgaacagatctcgagagtgcgcttgctggcaagatcgtcgtatccaatattggaagatgaaatttgaagtagcggagctcgagagaactatgctggaagtaaagaaagagcaagctgtggaaacgctttgaggttgtgaggtatggttcaacttgtacttgaagagttgctgcacgtccatggccaaggtttgtagagagctccgagtaccccgtggagatcctgaggagtcggcggccggatacatatcgtggatgaatggggcgtgtactcagctcgaaggcgtcggcaaacgcattgacgaagccttgaagcaggaatgtcgtcgatcgagccgatatgccggagggcacgtgttggcttgcctacgagatcatcgtccgcgacaggacctcgagtttctccatgaaggttttgctcgttctcggagaactacggcggagatagaccacctggcaaagtcgatggcgccgttggcggagaaggtcttctagtctatggactggagttggccttcttggtagtctttgtaccctgtgatggatatcttagggaaaagtgtaatatagctttgaacttgtgtaaaattgtaaggggtattttgtgaaatagaaaagaaatctatcttaacaaatccttcttactctggatatcgtgtgtaagggtgtgttctcagttcacgactttagttagtcgtttgagtcgtacactctctctagcccccagccttgtcatcggaggatttttctcggaggataagcctcttggacctttgacctgccttggttgaataagcactgatcctagcccccagccgtgaagttggaaagtgaatttccgattacgcggcttggttaatacgcacggcgagaactcttacacgaccaggtcttacatggtctttcgtctctacaggatctgacaaggccttatcggctctgggcgtccccagtagaagatcccttaggttcatcggaggccttctcaagatgacgtaaagggacatggggataggtttcaacgctaggtgtcatcttgttaacaaccaaatttggtaacatcggcatcaggaaagaagattagatcgaagcaaagtcggaggcagagattgagttcggaaacaaagcaggaatcggctggagtccaaatcggatgcgattggcatcggctaggtctgagtcggactaggtaagccgatacagccgattccgacaatgcagcttgatgtatgatatcgggttggattgaggtgcttcaaggtgattgccgcacatggatagagtcctgagaagtcaattgtatctattaattagggtgttttatgtaatctccttagagatacgattgggcaaaagtctgccgcaaagacttgtggtatcctagagtttgataagatagtagtcgtgtctgttatggacatatcttgtgattctcgggtataaatagacccgagccctatgtaacttttaacacacacacacgttcaatacaatttcggcgcatcgccacccttttgctttagttttgtttcgatgagttcttgctttcaggttgagctgcatcggtttcgatcttcaacgagaggtaaaacttgttatgacggcttgtattctcgggattagtgcttccatctttatgacactctgatctcgtttatgtaattcatcgagttatcatatatcttacataatctccggcaataccgctatctaatctacaatcggctaacatctgtctgtagagggtagccgattaggttagatatcgatgttgacttagattatataaggtatccaccactctatgaaacttccagcgacttgattgtctagatattgttcttcttttcatacttaatgttgcatcagtcgagtttgatctattaagtcgtgcttagaatatcaatctctaacatgccttctggttgccaattagggtagcatcggagtttcagccgatcttatctgatctaactatatttgctctatatgcttcattgacatattaaatctgtcctttatgtcaagatattgctgtatctaagtatattagtcctttgtttaatatattatgtctgttttaatatcctgatatagagtagtattggagtattagccgatacatgctagatctatctgatcggctatgctataaacatatatagccctgttattaatatatatttcgatctaagtgatttatactgtctcggcatggcgaccgatctatcccaatcactcgatttaagtatatatcgatataagaactatatattggaaatatctacagccgatcgaatagatttagttctttattgtctatttacaactgccgatcgattcacatatgacatcggctcaaagataaatgttatgtcatcggcacctagccgatcggctatcatttatagatttaaccacggtttctttgcctttatttcttgttgattacgggatcaaatcaactggcacgctagtacacccgaaggcgagctttggacctacactggagttaagcagatctcccaggcctcgtgttttctgtcaacacatctgggtaagggatcatcgggtaggaacactttgattgtaatatgcgcctaaaaataggctccattgatactgtaaggtgtcttacaggtgtggatgacattgactcatacatagaatttacgtagttggtcaatattccaagagtttgccaactcgcgaccatcaccgtctgcaatttttaatgcgcctggccgcaaaacttgtgtgatcgtgtaaggtccttcccatttgggtgagagcttgtttcgccctacttggcattgaacccgtcggaggacatagtcgccgattgaaagtatgcgtgctcggatgcgctcctcgtggtagcggcggagagcctgttggtaactggctactcggacggcaactcgttcgcgatgttcctcgagtagattcacatcgacgtttcgctattcctcctgatcctcgtcggaatacttctgtactcgtgtactctgatgtcgtagctcgctggggagcatggcctcggagccgtacatgaggaagaagggtgtttccttgttagacgttgtcggtgtggtgcgtacggcccatagtactgatgggagttcttcgacccattttttgtcatgtgacatgaatctgttgtagacgcgggtcttgatccc

SEQ ID NO: 76292 - DNA, 7597 bp, Oryza sativa
tgcggttatcagtctgaatggcatcttaacatagcaaaacaccccgaacggcgtgatgaatgctgtcttctctccgtcctctttcgccatgctgattcggtggtagccagagtaagcgtcgaggaagctcaacagctcacagccggctgttgagtccaccagttgatctattcgaggaagagggaagtgatctttgggacacgccttgttgaggtcggtgaaatcgacgcacattctccatttctcgttggccttccgcaccatgactggattggctagccactctggatgaagtacctctctgatgaagccagctttgagaagtttgtcgagctcttctcgtatggcttgtttttggtctggtgcaaatcttcgcagtttttgctttactggcttggcatcgggtcgcaccatgagtttgtgctcaatcacctccctggggaccctcggcatgtcggacggttgccaagcgaacacgtcagcattgtcgcggaggaaggtgatgagcacgaattcctatttctcgcttagtgttgccccgatcttgacggtcttgtcagggttggcactagagagtggaacggtcttgatcgcgccgtccggtttcggcgtcttgtttgtcttgctcactttcttgggtggctcagttgtggcgggtgggctgggcatttgctcgaccatgtcgaggctccacttgtcgcattgtaccgccagctttgtgttcccttgaatagtgattgttcccttcggtcccggcatcttgagcacttgatacgcgtagtgggatgtggccatgaacttcgcaagtgcagttctcccgatgatggcattatacgctgtatcgaattcagcgacatcaaaggtgatctgctccattcggaagttgtttgcttggccgaaagtcacaggcaacgtaattttgcccaatggtttggacgaggattggggagtaattccatggaaggattgatcggtgggtgtcaactcgcttcgcgaaattcccatcgcgtccaaagcactggcgaagagaaggttgattgagctaccaccgtcgatgagaacccacgcaaccttgatgttccgaatagtgggttcgaccacgatcggatagcgtcctgggatgacggcagtcttgggatggtcttcttctgaaaattctatcttctgttcagaccacttcatcttgtgtgcagccccctgccatgtcgaacagacttcacgttccactttcttgtattctcgctttgaggagtacgctgtggaacctccgaaaatgtgtgaaacgtggaggttagagtctggatatgctgtgtccgattcctgaggagccacctccgcatccttctcgaccacgcgtactcgcttgcctttttcaaatgccatgtgcttctcgagcgactttttgaaaacaaggcaatcttccaaagaatgtctgtctatcttgtgtatggggcaccatgctttcttcgtgtcgctaccttgtgggtctgggcgcttgggagggttcgcgtattctgctgcgagaacttccgcttgagctttcattttcccacttttgcgatttttcttcttgcttgactcaggtgcgtccgtggctggtttcttctctcccccggtcttcggcttatcgttcttgcgtctcagtgcatcatctgcgtgggcgcatcgctcaacaatctcgaacaatctccgagtagttgtgatgcgtcttgcacaactcctgggtagtatagcgatctctgacaccagacttgaaggcgcaaattacagaagcatcggtgatttcggggattgtatttctgcactcgttgaagcgccgaacatattccctcaaggattcacccgagttctgtgtcaacgcatgtaggtcgtcttcgatcgcgtggcgcttgtaagttccttggaagttggcaatgaactgctggcacaggtctgcacacgaagagatcgagtagggcgggagatgcatcagccatgaacgtgcagagccttttaacgcagttggtaaataattcgccaatgcattgtcgtctgctctggcggcgtagagtactgtggagtagacttgaaggaactcttctgggtcggtgctcccatcgtacttctctattgctccgggtcggaatctctcaggccattggacatcacgcagggaacgactgaaagctctacacccagcgctgggggcggtgggttgtcggcgatcgtgtgtccttcatggatgtctgtctgatgatgaggatgaagaagaagacgacgatgacgatggatcgcttggttccggtgtaggattacgaggacgtcggctaggttctcgagaatcctttcgccgccctcggttgttgtcccggcgtcgatctccgtcgtcctcgtcattatggcggtgtccttgaccagtgtcaccctgcgtccgcctctcgcaatcatcgtgatcgtggcgatcgtggcgattaacacggtctcggtcttcgctcgagcggccctcccgtctttcattatcgcgatgtcgtgaagagacgcgatgccgggagcgatccccgttgtctcgtgtgcgtcgtgcctctcagcggccattgaggtggtcacggagatcgccggtgccgcgaggtggaggggtagctcgatggggtgactcccactattcgggattttcgccattggcaccgccagttggtggctattccgggtgtgctgcatcagcggcttcttcgaacgcgttgctgaggttggttactgattcccgtagctgttctgtccactgtgcgagatcatcgtttagaacgggatcgtaaggggtctccctcagtattgcgttgatggtcctgatgtgctaggccggtgtagccacttgattttgtgcttccgcattagcgtgtgctgacgtgctggtcccgtcgatagctaatacctcgcgcggcgtactcgctttgatgagccatagtcctcgagtagatgcaggactgatggttcgggtgaactgatgtcgattatgccaacgaatcgatctgaaaccagcgtcgttccttgttccttgtcttcatctctaagggatatgcctaactgctggaccttaggggatgacgtcatcgtggcgctgagaaagaccttgcagcttgagaggtcgtgattctttgtcttgtgaataggacaatagacatcacaggttggagaaatacgctgaattccacgctctttgcaggcgcgaatttcggcgcggacgttgagaaaaacccaacaggcgtgcaaagtgtgtttcctggttttgtggataggacaccaggaccttgtcgcttcggaagttattctcgtcggctcgtggctcttgtctgaacgacaaggtttggccgcattagaatccttctcgagctcggatgtcgtcaatgttctgttctccgcttcggcgggaggatccttcgacagggagtcgtcctgggttgtatccactgcgttctcatttccggtcattgatggaccagctgagatcggcatcgtggtataaaccgggaagacgatttcgccgacttgagtccacaccagcattgttgaagtaggaaatccctggtggaggttggtgttgacgccgttgtcaacgaaactggatgacatagtagtagaaccttgagcaccaagtccccctacctggcgcgccactgtcgacgagtgatacccgtagaccggatatagagggtattggggtacgttggtacaaggatctatgtaatacgacatcaagcaaacagagaacgaggattatactggttcaggccccttgataggtaatagccctaatccagttgatatgagattatatgatggaaaacacaggttacaaagggtacgatggaactcgatgaaaccgacgggatcgtaatcgagttggttcgactagatctcccggcgatttggctcctgcaggctccgacttcgtaggctgtgggggttgtgttggctccgagattcgatgccttaggtcctccagggggtcccttttatatcgcaggtcaggtggtttccaagtagaactcggagacatcgaaacctacacgatacattgacgacccagtcttgtccgagtaggattcttttcatctgtaaactccgtgaaggatttccttagttatgcggagaatgtccatatacgcgcagacatgccatatcgatatgtgacgtatatcgaaaggtaaagggtatacctaacccgtaaccctgacaacatacatgaaatattaaatatatgctaaaataataactaattgcacagattgcgactaatttgcgagatgaatctttttatcctaattactacattatttgacaatgtggtgctacagtaaacatttgctaataacggatttattaggcttaataaattcgtctcacaccctatataatactcaatgtgacacgccaaaactttacacccctggatctaaacaccccctcaaatttgaacaatgtaagagtagtactccttcccaaaatataagaatttagaactggatcggacattttctaatactacgaatttggacagcacgtcccatccagttctaggtttttatattttgggacggagggagtacatggcatgaagcatgatgcgtgtgaaatggaagaaaaaggatttggtacaattgctttcagaaagaattgttgcacagagttgatcttgcacatggtaagtcaatctttgcacggacgttgcttctatggaagaaccttgtgtgtacttcttacttggagaaaacaacttcttcaaaccaatcctgacttgtacgtagttcttcaaaccttacaacgtgcaggtccattcgattagggatgagctaagaggttaggcatatgatgtgaaaaaaaatcggatgtacacattgcgcgcgcagtagaaggaggggatggaaaaaagacgattgcacttttacaacagtagagactagagaaaatacgaagtatcacttaaacactttcaagacatgtgaaatcattctattgtcctcttctagcttcaattcatgttttcaaaaaaacttttagtcaggtcgccttgtccaattgttttcggtacaagaaatgacgacatatttatgtgcaaaccacatatacaattcagacgaacacagggatgattcatcttttgttctcttccccaacgacttcacatgaatcatatgcctttgtaccagctatatatgacttgctttttatattgagaataagcattattctcatatctccttttccttttctttttcaggtttgtcctcgtacaattgtaatgtccaaaggactggaaaagtgcagtaacagaaaggtgcttcacaaactgaaaagttgaaagccatgtcactgcactacgtctgacaaaagaacaacagctataggtatttggcatttttattggctactctataaaaaaagcacattaatatttgtgtcaaagaatttaatttctacccaagatttataggcagagggcatgtagctccacataatggagctcagatgatcaaatacataattacatagtccttactacatggagtctaaagaaatatatatatatccaagtagtgcagcatcatgcacggccactacttattagaaataaaatgaagtgaataaagatatgcttctgatgatgccaccggcgtgaaccgagcaatctttcatgcagattttcgcctccacctactcccacgcacgcacgcaatgagcaatagttggttgctgacttgatccgagctttgacaaattcagtttggaactttggatgaatctgcaattctgacgacaaaagggaagggaaggacaaaaaggttttactttaatcttctttcactcaatgtctaaagtgattttcagagacatacaatgggctttatatctttcttttactcaacatctaaaatgatattcagagacaacacaatgggcgaagacctgtatttatctctgctctgaaagactgaaacagtctctgctccagctacgaagactgtatacttgctggtcatacagatccaggatgtgtattatttgcaaattcatcagaaagcatgactcaaccatcacacacactcacacgtaccatctgtcatctctttcgatgatatcattcaacagggtgacaaactgaaaacaaagaattgcaagaaagattggaatgaacacaacaggatgacccaggtatgatgatgattacagaaaactttcaggaagataagcgagccaaacatagaaattgggagataaaacattgttgcatgattcacaggttctcaaaatgattaacggcatacaaacaacacgaagatctagagcttcaaatactacttcattgtagaatggaaaaaagaacagtactcgccctgacctgagttgaggatagaaattgttacaatcgaggatagaacagtactcgccctgcacctaaattgttacatgcttgtcggaggatgcctggtacatgcatctacgattttgacgagaagaaatgatatttagacatagtactatatcatcgtaattgatgtccttgttgcctgctccagttcttcaaactcagcgcctagcgcttcgcttcctgctcttctttcggctgcccttgtcatcagaatcactgtcagatgcagatgcagattcggagtcagattcagacgatgctgatgatgaggtttcccttctgtgcctcctcttctgctgcttcctttgggtcgccgcttcttgtcctccgagtctgaggagctgtagcttgagctacttccagaagaatattcagagccggtaactgatgattcactgtcagagtcaaatacagaagcctcactactatctgaatcactccgtgaacggtattttctcttgcttttccgtttgcttttctcagacttctccttcttcaactttgctttcatcagcttcctttcctcttccttttccttctcaagatcaggattctggaactgataggaaacaggagcagccgtcttcttcagcttggggttcttgagctgctgtgtcctcgagggccgcgaaatgtagacccgttcgttcttgcactcgtatgtccagtgcccaggctgaaaacacttctggcactgggtatatgcgccaccagaagaagaagaagtttgcgcagcttttggtttcactcccagtatcacagccttctctgtactcatcagatacatctgtctcttggcctccttcctctcctgccagcgcgaaggtccctcttctttctgcccataagcattgacattgcgggcagcggctgcagcagctcgctcggcttgagttctgctcaatcccttggcagcagataaggcctgtgcttttattctctcagctgcagcctgagacttatcgtcatttccagacatcttgggctcacccaacaagaatcaaatcatacaaaatcagcaatattatgatcctgtaaggaaaccaaaatacatcaatagagtaatttgggtaatgaaaaataacgcaaacaataaataagctttctgctataccaaaatcaacacattgatgcaggaaaaaaaatctggcacataatatttttcgttgctataagaacaacatctacttatca

SEQ ID NO: 76293 - DNA, 15243 bp, Oryza sativa
ctggaccccccccccccccccaaaactttattccgtaacaaactgctgctattagtgctagggttagggcaaattaagagaaaagcttccagatctaggagaagagaagctagggtttaggcgaagacagatggtgcgggggtaggaaggtgcgtgtgggttggtgctcaccggcggcgaggatgcttgcggcggaaggaggcagcaggtccgcctcggctgctcgccgagttcgatggagatcggcgcaggcgaggcggcgggcgaactcacgaggaaaagagagagagagagagagagagaggagcgggtcagaatcgggagaggtgaacgggtcgggatgtgggggcgagcgatgatacgtgggccgttaatgggccgatcactatgtcggtcagtgatgggctgatctttatgtgggccggtgatgggcccatgaagtaaataatgatttgtactgatcctaacagggtaaatttacggtgatattagacaaccatgcaaagttttattgtgagatataaaacgaagaaaattagaaaaaagaaaaaacagaaacaatgtttttattttaagattctttaattttattatgcataaacggagttgaggttgtttatttacatcctacctacatgctctgtgtgattctttcagaacttctatataaaaaaatttccacaagttcctgatttttgaacatgcgtgcaaattagagtataataaaattattatttcttgatatcatatgatatagaagtaccccgcaaaaaaaaatgatatagaagtatatttatttgagatccattgccataaatggtcccaatacggaacccatttctgtttctcagaagcatgagcccttaccccaccctagcagaaaacacatacaccattctcagttttgtcaagattttggaggtctattacctgcagcgagactgaattctacccgggaaatacttttttttttatttattaaacacgcgaaactactataaccataaaactgacagctttcaaaggccatgtacagttttctccacactgaaaaaacagtaaagttacaccacttcaaattgcaacctgaactatgaatattgctgccaaatggagtaatatatacagcaaaggaaagtaggagcatgaatggaaaaggaaaaaaaatgtggcaaaggttccaaaaaaaaaaacatcctgactacacaacacacaacccattatgatcatgactgaatgtatctgatatctgtgaattctaactgtcgaatgcacaataacaccttgcacaccaagtaattcccaaggtaatgaaatccagactgaaactcttatttgatggtatatatcatctctaaagccgctaaacctgtaaagccaaatagcttggcaactcctcaaagtgcttccctagcacccattggtcagcgagtcctgcggctgttggctggtttagatggagaagacggtttgttcttagcgaaatcgacaagatccttgaaaagagaatcttcaggtttggtctgccgtgatgcggtcggaactgatgaacctctctcattctcggtattcctctgattaagcgaaaggccttctgtttggctcaccagtccattgtacccggcaccgttgttaccactaggaaggccgtgctgttgctcgaagtactgctgtctttggccataccttgctggaggtggcggtaaggaacctggagcttgcgcttcccatggagcttttggaagatcttcaccggagtctccatacttgttagcatttgaagacgaagaaaaaccagggatagctgttgggtttataaaatcatcatcaggtagactctcctgcctattgacagcaggacgatttgactcgctcataggacgagaaggcatagagaagctgggtgctgcagttgggtttatgaagtcatcagacacactttctgaccggctatcataacttggcggcggattcgtttctgtttttgaatgagacggcgcaggtatattggctggggcagttggattaataaagtcatctgatactttttctgtcttgtaggagtcgccactaagatagtcaacactgcttgcctccgtgaaaactggcctctttgatgatggtggcggaggaagaagtgggcttgggtaaggcctttcactttttggagcagaaggtagattgccctgtgctgctgtgccatcccttgcagacctacagaacatatatttgtacatcagatgacaaacctaaccagaccgggaatcttggtatcataacatgatccgcatcaccaaaacattttcttaaaagcagtcagctgatgttgccacaaccatccaaagcttaaaatagcaatagcatgtatgaaaaataattagtaaagggtactaatagggaaaactaatatagcttgcctgcgggaaagaacagagaactcgtcttctggctcatcgtcttcatggtgcacattaagaagtggggaaaatgaaaccccagtaggcctaggaggggctgttcctcggtttacattagcagcagcaggagctgggcctgaaccgggaggcactccctttgcgatgtcatcatgacgctgaagaacacgctgcagttcatcatttaaaccgagagcttgaaatagaaggctctcatcactgcagaggatacaagacaatatgtcacatgacaatgtgaaaaggacatggaaccaaaatttcagagtaaaagaatagaacatacccagtattgctaacaaggtccatgactcgaccttgataagatcggcactgcccaacaaggtcaacaatgacctcctccctcacaccctacaacatgaagcgcaattagacagaaatttagagaaaaagagcataggtgggtggaatggtggattcaatagttaaatacagagacgcatagagacatcacactagtgcaagtttggtcataataaattaaaatattagggcacattatttttagccagataccagagcaagttctagaaaatacaaaagcttagaaatccctctttaattattcttatgccctcagtctcctatgctgctaaacatgattccctctgaacaaatggaccaagtaaaatagttcgcacattcctgtaagctgatgaggtaacatggatgaacaaagatataaatggatattggataatatactagacttcaaagcctagcaagaaactactttgtcatccattacacatagatctgatcaatgatgggacatgtaatagttacatcctcttctgtgcacaattcacagatacagctcagctcactacatgtgaaatatgctgtagtatgatcatatgaaataaaacacatgatttatgcataatttttttcatgggaaaaacaaaggtctagaagacatgacaatcatattaaagctcttaaaagtaaaagaaactacagaagagatacaaggattatacaacactgcactaaattttgatgcttaaaaaagtcacctcagggtgcctgtggtccaaagcatttaacatctcatccaacacatccacaattcctcgagcactctgaatctcacttagactgtaatgcacaaggagcaagaattaaaggtggattataactaaagaatttcttctgcaaagatggtgaaataaattgataaacacaattgaagtattcaggtattgtttagcatgattatgaaactaaactgtcacaaggcaataagtagaatctattttggcacactgacaccgccatattttgttgttagaaataccactataagtatgaaattcttggaaagttgcatggccctagttctatgaatgtcttgcctgtaaggctgtaacagggagacaaacaaaattactattaatgtaatgcatcataattactttctagtatgctttagagttcaggaatgaggacaaccaaggatagcggcaactgcaaccatcagtaccgaaggttccaactttagatcagagatggcgtacttcaagaaagcaattaatcactgaccacttttttcccccaaaatacttgacactccatagttgctaccaggtatttttccaatatcacacctggtgggcccaaccggaggttcagcttttttttttttttttttgcccctcaaaactactaatgtgttctcagtgactaggaaaaaacaagaaagatctggagcctgatagcctatatgcaccgtgaaccttctttccgtactctccagttgtgctgagcggcaagtcctcagggttggagccttggaggcacacaaatcgtccagaagcaacttggacactgctttctgctgtctgatgcacaatttcagcagaatagagatactttaatccaggagcattttcgaaatttaactaggaaacattttatagccttgggaagtttgcttggctaatgggtgtcatctatagaggaacagagggagcagaacatattgtgagtacgattccactcctaaaacatgcctagccatttaatgtggttgtaggctgatcagtatttctgataggaacatgtgtttgaaacttttcccccacaagtgtgaatttacaaaccaggccatgcttgttccaaccaaagtaggttattctaaagagaatgggaaaaatagaacaaagcaaggcataaagaaacagcaaaagtaaatggcattaagaaactatggatgaatatgacagtactgcttgaagtgaacaagtaaataaggaacaaattttgcattagaacaaaagaacacctcaaggcaggtgcagaaggggcgctagattgaagagaagcttgtatcgctgcatcttcatagctttgacctggaggtggatatagatgtggttgcctcaatggttgagtttgaggaggtgtaaacagtggaaccgtgttctcctcacgaggtggaaaatcaacaccagcattctgcacacaagggcaggatatcttgttcatggtttggacagaaacagaagcaattgaatattaactcaaaagtaaaaacgttgaagatctaagtttacattgaaacaaagtgcagaacagattgaagttgagtggaacagtagtcaagtatgagctgtgatagcacaggataaataacagatgagaaaactggaatgaacacaagtagacagtaccctgagttcttggtaagcagcgtgatactggggatatctgccagatgcacctccaaaagccacttgccatgtgtcaatcaaactcaatattttctcccgaacatttaaatctggctgaaatcataaattggcaatcaaatacagaagcataagaatgtaggaactataggaataagtcttggctggttggtcttggtcttgtggtgccttttcctgcttttcagctttctaggacagcatctctactttcagtttggatgctctaggacagttaggacagcagtttgttgagatgctctaggacaatatgttgagatgctctaggacagtttgttgggatgctctaggacagtatgttgagatgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatcctcttctcaatgagagtagccattgaagttctaacatctggtatcagagccacactttcctgtaggctaaacatctcttgttccaccccttcccaagctcggttgagctctcagccaccaccagcagcagcaacaccggctgctcctccttcccctttcccttccccctctccacgcagcagccccccggaggtgcgccatgtccgacgttcggtctcggcgttcggtcgtctcgagcactcggcgtcagcaggacgccgagctcgccgcagcagaagagcgcaggcgagcaacggctcagaccgctgcagcagcagcgagggcggccagactggcggcagcagagttggcagcagccagggcggaggcagaagcagaggcggcggaagatgcggcacgtgcggcggaggtagaggttgagaccttgcgcagcagcatcaacggctccatcgccggcgacatcaccgccgacagggagcttgaggagcttgcaagaggtagggcacgggagcgggcagagcggtgggcagcagcccacctccacggcggcggcggcggcccaagggaccgcgcgcccgccgacgggaacccagacgggcgcgggcgtgccggcggcagcccggagcccgcgcgcggccctcgcaggcagcgtggctctccctcccctgaccggcaccatggccaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacggcgacgtcgactacgacgaggatcggcgggcactggatgccctcatcgctgcagtcccgcccgagatgcagttctcgctttcccagaagcggactgccaaggaggcctgggacgccatcgctgcggcacgcatcggcagcgatcgcgcccacaagtcaacactgcaggcactccgcaaggagtgggagaacctggccttcaagccaggtgaggatgttgatgactttgccctccgtctccacactcttttgcagaagatggtgcagtacggcgacgacacctacgacgaggagagagctgtcgagaagctctttcgctgcgtcccagagaagtacaagcagatcgctcgctcgattgagtctttgctggacctctccacgatgtcgatcgaggaggcgttaggtcgcctaaaggtcgtcgacggcgatgagccacagcctctctcggggcctatcaccattggcgggaagctccatctcactcgggagcagtgggaggccagccagagtaacgggaggaagggggagtcccctccctcgacaggcggccgcaagccgcgcaaggcgcgcggaggcgtccagctgcggtgggcgcgaagacgcgccgagggtggcgctcgcagaggtgcccagggcgacgccgctggcaaccacaagccggcacgagacgacgcctgccgcaactgtggcaagcttggccattgggccaaagactgtcgacagccacgacgcggccaggcccacgtcgcacaggtggaggaaaagccggctctgctcctagcacacgccagcatcgagctatcttcagcggcaccggccgcaacggctttcctccacctcgaggagccgaaggtacacgccttcctcggcaacagctccagcaacgacaaggctgatgggtggtacctcgacaccggcgccacccatcatatgactggccggcgggagttcttcaccgagcttgactccagcgtccgaggctccgtcaagtttggggatgcctccggcgtggagatcaagggcgtcggctccgtcaccttcaccaccaagtccggtgagcacaggctgctcaccggagtctactacatccccgcgttgagaaactctatcatcagcgtgggacagctggatgagaacggctcaagcgtgttggtcgagcacggagtcatgaggatttgggatcgccgccgtcgccttcttgccaaggtaaccagaggcactaatcgactctacatcctcagcgcgcaggtcgcacaaccagtttgcctcgccgctcgtcgagacggcgaggcgtggcagtggcacgagcgtttcgggcaccttcactttgaggccctgaagcggctcagcgccaaggagatggtgcgaggcctgccgtgccttgaccacgtggagcagctctgcgacgtctgcgtcctaacgaagcagaggcggctcccctttccccagcagacgagtttccgagccaaggagcggctcgagctcatgcacggggacttgtgtggcccagtgacaccggccacaccaggaggacgacgttacttcctgctgctcgtcgacgacctctcccgctacatgtgggtgatggtcctcggcagcaagggagaggctgcggacaccatccggcgcgcgcaggctgctgcagaggcggagtgcggccgcaagctacgcgtactgcgcaccgacaacggcggcgaattcacggcggctgaattcgcgtcgtactgcgctgatgagggcattcagcgccactacaccgcgccgtacagcccgcagcagaacggcgtcgtcgagcggcgcaaccagacggttgtggggatggctcgggctctcctcaagcagagggggatgccggccatcttctggggagaggcggtggtgacggccgtctacatcctcaaccgctcgcctaccaaggccctcgatggcaggacaccgtacgaggcttggcatgggcgcaagccaggggtctcccacctgcgggtcttcggctgcctcgcgttcgtcaaggagcttggccccatcagcaagctcgatgacaggagcaccccaggggtgttcatcggctacgcggagggctcgaaggcctatcgcatcctcgacccggagacacagcgtgtgcgcacagcgcacgacgtagtgttcgactaagggcgagggtgggtatgggacaagacggtggacgatggttcgactctgacgtacgacgacttcaccgtcgagtatgtccacttcgagagagctgggggagtaggcagctcttcttcaccaagcgtgtctaccccagtccccgagcctccatcgactccgacaccaacacaccctcgggccacggcttcgactgcgacgagctcttcgccgacaccaccacagccggcaaccccacgcgccccagcaccaacagccactcctccgagcacgtctactccgacgccagctcgtgttgagcgcagcccggtggagttcgctactccgctctcccacgacggggagcgcatcgacgcgtaccacgacggcgagcagctacggtaccgtacgatggaggatcttctcggtgaccagcccgtgccaggaatggtgcctcgcgacctggaggcgcagttgcaccttgcgtgcgacgacggtgagcctcggtctttcgcagaggccgagaaacacgcggcatggcgtgccgcgatgcagtcggagatggacgcggttcaggagaaccgcacctgggagcttgttgatctccctcgtggtcaccgcgcgatcacccttaagtgggtgttcaagttgaagagggataaagccggagccatcgtcaagcacaaggctcgcttggtggcacgcggtttcgtgcagcaggaggggatcgactacgacgatgccttcgctcccgtggcacggatggagtccgtgcgactccttgcgctggctgctcaggaaggctggggcgtccatcacatggacgtcaagtcggcgtttctgaacggcgacttgaaggaggaggtctacgtgtaccagccgccgggattcgtgatccccggcaaggagggaaggtgctacgcctgcacaaggcactctatggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgcggaggtcgcggcgttcaaggaggagatgaaggccaccttccagatgagtgatctgggcctctctccttctacctggggatccaggtgtaccaggacgactccggaatcacgcttcggcagaccgcctacgccaagcgcgtcgttgagctggctgggctcaccgattgcaacccagctctcactccgatggaggagagactgaagctgagccgcgacagcacggcggaggaagtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacattgacaccagcaagagcacgagcgggattctcttcttcctcggcgagtgcctcgttagctggcagtcaatcaagcagcaggtggtggccctgtccagctgcgaggccgagtacatggtggcatccgccgcttcgacccaggcgctctggcttgctcgactgcttagtgatctcctcggcagagatactggagcggtggagctcagggtggatagccagtccgctctggccctggcaaagaaccccgtttttcacgaacggagcaagcacatccgggtgaggtaccatttcatccgaagctacttggaggaagggagcatcaaggcgagctacatcaacaccaaggaccagcttgcggatttgctcaccaaaccccttgggaggatcaagttccttgagctttgctcccggatcgggatggctcaactttcccacaagacgacgcacaagacttagggggagaatgtaggaataagtcttggctggttggtcttggtcttgtggtgccttttcctgcttttcagctttctaggacagcatctctactttcagtttgaatgctctaggacagttaggacagcagtttgttgagatgctctaggacagtttgttgggatgctctgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatcctcttctcaatgagagtaaccattgaagttctaacaggaactaggaaagcaatagttggccactgaatgtgagtataatcctcacctttttctttactatcttaaccatttcacttaatatgtctcgctcaatgatttgctggtaaacaacatccccacagtttttgcttagagtctctagcacctgaaaaggaagacaaacaaacagaacaaatcagcacattaaacaagacatgactgtgcacatagaaactatgctctttgtttcctaaatctggaggaagcacaagaagtttccaaaatctggaagaagaacaagaaataacttctaaatttgtgtagctagtgaagacaggtgaattcttaaatttaggaatgaatcgacctaaaactcacattgttaaaacaaaaaaatcagaagataacacactgagtatcaatatacaaggactcttgaaatactcacataaagcgtcagaatttgcacttttgaattcttgtttcccaggcgtttctttaggagcttgagtgtatccttggcttgtctgtacttcagcaaacatttatgagcatgctataaaacatgacaaaccaaaagttgtatggggacattgaaaataaatcccagaaagtatttaagacgaaacaattatgtcaacaattcaatatacaaaactcattatgcaatgtgcatcactcaaccatgaaccgaattatcaacaaattatagcaaaatgtcttaaattagtgtggcatcacatacacagattttaatgttagcaaatgccacagattataaaatgtaatcactgcctggagagacatataaaccatattggaagttggaagactaaaagttattgaagctatatatcacaccaacgtacagcagagtagagaaacaaagttttttttttctctcgaacacgcaggagagttgcatatcattatattaagataaaagagttaaaaaggactcatgcatgcccataacgggaacaaaggctataagaactttccaaagaaacaacaaaaaactacaccatgacttagcttcatctctaacatcctgcatgacggaattgaaattagctgaaacctctccaaagacacatccacctatgtttccaaatcaaccaagccaccaacacaactaatgagttaaaacccttgcgatgttgcttagccactttctgcaaagcttaaagccaccacatggtgaaaacagtgtcatcgggaccttatctaaggtgctgcaagccaaccaaggacaaaactgagaaccatacacttcttgtgaacacacataaagtgagcaagtgctgcacattctcctccttttgattacacaatggatattgccaagatggtcaacactgcgatgggccaatcggtcagcagtccaacaacgatttagcgaggctaaccacacaaaaaaattgccaaaaggccaaagctcaagttttccaaacttccttccacggctcaaataacatgcccctgatgagttttttttttggtgtgtgtgctctcattgctgatatcatcatggcaaaaagtgatgtcatacctaaactgcacctcaacaacaaatgacaccaactcatcaccaaaatcaggggcctccatgagattatagctcaactaaccaatcacaaactatcatcaattattgagttattctgctctccaaaccaacaaccgtacaacctaagattccaaattcctaataaatttggaagaaaaagactgaatatgcttttccaaaaaaatacaaaacatatagcaatagacacagaacaaactagccaaaatcacagattcaatgccttatagaagcagcactaaaaccctgctaaatttaacgattttataaacaagcctaggttaaacgagatacaacaagcaagcaagatcacaacacataaaatgtcagagatgccacgataaccctactaaatcactcacgggttgaacaacatagagaactacctaggaattctccatcctaccatatgatagcaataacaattacaaacaaatcaaagaacctaaacaaaaagtctcgaacagaggcatcatcgagagagagaagccagacccgggatccatgttgatgatgtcgcagagctcgatgttcaccgcccaatccggcccgatcagcatgtcgctcgtcgccctctccgcgcacgccacggccgtcgccattttccccctctcaccaccaaaaaccctaaatcctgcaaacaacaacaaaaacaaaccacccaaatcagcccccaaattcccacctttccgcacctccccaacgcccccaacccgaatccgccccccaaaaacacatcttccaccccgcaagaacccgagcccctcaccgaatctgagcgacctcctccccaagattcggcgccaagaagcaccaaggcggcctcttttcaccgatccggaggtcctggccgcgcctgggacggggaggagagggagagatgcgagcgaactgtaggattggaggaatttcggtggctcggcttggaggaggagatgaggaggaaggagaaaggttggagaggagggtggtagactagactaggcaggcagcaggaaagaaggaaggaggaagagaagggaacgcggccgtagactttttctttgtttagttttcttggtgtgaaagtgagggcctgcaaaattatattttgtggtgctagtttggaattgtgagaaaagtgggatatcaaagtactccattcgtcctatattagattgtgagtttttacttgtaatgtttaactactcgtcttattcaaaaaaattttaaaattatttttattttatttgtgacttactttattatctacggtactttaagcataattttttgtcttttatatttgcaaaaaaaaattaaataagacaagtggtcaaacgttgcaagtaaaaactcaaaattccttatatagtgggacggagtaatactgtcatctagcagccccatcatttggaataagccaaacgacattttaacgaataaaacatgatttataaataaacttttatatatatgtgttcttaacaatttaaaagcaatggctgaaaaataaacttagatgaaaaaacctcaaaccaattataaattcaaggttgaaaatttgaattttagctactaagtattagtataagcgaaaaaatgagactatgatgactgatgaggataggatcgatttttctttatattagatcttgaattttttttacatgggtaaattatgtattttggaaaatatatagttatgttgtgaacttctttgatgtcatgaaaaatatctttttttagaaactctcaacggttgggggtacatactagatagatttctactatcggaaaaaatacattcttatcaacacaaagggtcattaagtaggatctttgcatgaatgcttactaagtaagcaagttctacattttggttgcgtatatggttgatatgaagttacataaaagtgcaatgtgaaaaccctggatgaaataattatataacatatcctatgtaagtcattttcactcattaattatattatccttgtgagtctattttctacacattcacttttttttcttccatttctcataaaaatatcaacacactatttaccattagcactaggcgactttgttcctcttgctacttctcttataaggagagataggggatatttacatgattaaatgtgcttgttaatatgtcatcgtatgaaatagttgcgacattttttgttttgcttgcagtgatagacttggggcattacttctctgttgcatacttttcacaaacaataggaacatttcaaacttttagagaaagtatctcatgttttttagagcatcaaattgttcattgtgtcaaatttatatattactcgaatacacaagccaaaacaattggttttatgtacatggctagaaaattatactccatccatttccaaataactgacaattggcactattcattttaaaccgtgaccattcgtctttctcatttaaaaagtataactgaaaaagcagaggaacaataatcggcaggaatgcaagtacaaaaataaaagattatagaacacagtaaatacaaaaaatgatagtttgattagaccgcgagaaaaactcaccaatcggataagagacgtaagctcaaaggaaatttttcaacaagtttgagttcttactaat

SEQ ID NO: 76294 - DNA, 1150 bp, Oryza sativa
agcatcctagactgttactttggaggttgccgcctcctagacggcttgtggaggtgttgcccggtgacctctccgaggagattgtggaggaggcccgtccccgtttgtgagtggtttggagttcaccaccctcggagtgaaggaagaactaccccgagtgatcgaggcttgggttgtcctctccgtgggccggctcccgccttgcccaccccttgacgaagggggcgtgaggtggcttcgtggttgaccggtgaagttgggctcccctcaacggggattaggaaaccggcgagtttccgaacctcgatgaaaaattccttgtctcttgtctcatttatttgttgtatttacatttgtgctatttatattcatagagacatatttgagcccatatcacttaggtttgcaaaacttaacttagttgcttagttaaccttgcacctcaccttgcctagcaacttaggttagttttgtttaagtgtcattaagttttaaaaccgcctattcaccccccctctagtcggcctccttatcctacgtgggtttaggaggctgattgtggggtcttgctggcacggttgaggtcttttggccagttgagtggtggcgtgctgggctggtggcaatggaggagacagcgatgacgagaaacatgcagtaggtgatagtttaggcgtgtcctgctaaggaaaaaagtggaaggaattagggtttgagtatacgaagcaattgttcaaaagttgttagattttgatgggtgttttttttcatcaaatgtataatagacagactcataaaaaaggaattgattacctgtattcgatggaaaattaaaccccaaatcttgcatattggactaaaaatcaaactccaaggacccgttcgttagtcatgcagatgaggatgtagacgtaggattcatgaaattcggatgagacttcctctggttcgggaacataacagtatcctctcgcgtcgtcctccctaggggcggcacgggaggtgacgacccggctgccccttctccctcacctccctcctccgcctcgctgccgcccgagtggctactggcgcacggccacaaggacagtggcggcggggcccctctctctcgcacgctcgggtgacctagggagtcacccagagaggc

SEQ ID NO: 76295 - DNA, 3003 bp, Oryza sativa
gagcggggatgttcatgtgttcatgtcccattgggttcgtctgcagcgttggattaaaattgtgtggtttgtagagagcaggatgaggagggggtaaatgaaggggaatataataaacgtttggcccggccaaacctggtccattatgttagcccggcccatttagggagcgacccaaaattcagtccctaaatgggcctaccaatttggccctgtggttcacgtggcaatttttttaattatttttagaactttaggggtatttttttaaaaaaaaacgaactctctcaatacgaatggttaaatgtttatatttatattttttaaataagaatggttaaattttatatgaaaagtaaattacatcatacattgggatgaagagagtgtttatgtatttatacaaaatctagatcttatcatcctgtctaccatggcaacacccccgtggcatgacatatgtagtggcgtagctaggatttaaagtaaaggtggttcatctatatgtagtatgtcaattaaaagggtgatccgctatacaatttttattatattaactagcacatatactataattttaaatttttaggtggtccattgaccacggtgccacctagctagctacgccactggacgtatgtattgttttgccacactatttaaactaggagtccaaaatatttaagttccaaagcaaattttgggttctatttttagaattttctattaaaatggttttcaaatttttaaaaatcctcaggaatgcagccgagcgtccgaagcttgtgcactgcatgagcgttactcacactgtgtcacactgtcccgggtcaaatgtgcaggcaggtggcggtggatgtgcaggtatcgtgtacgtatgcaacgctgcgacttgttagagcaagtttaatagtgtagccagctactagctccaatttatttagagcaagtataatagtgggttataagctggctaaatggtaaggtggaggagagaagagaggagagagaggagaagcgggctgtaaacttaccgccggtttggacacaagaaccaaaaaactctgtgagagagacaagtagaccatgtattaattataaagagctacactattatatgggtagactgagagaaggctatagaaaaccttatagccaacaggtcggctgtattattagccttgctcttatagccaatctaatagcttattcatataatagttatctatgaacatatactacatcattaatatatagtttcacctttcatacacacgatgtattagaatccgtgttacagctgattatatatctgtagcccgctttccttctatcttttatcttatcttctcttctcttctcttctctatgtgcttacagataactattatatgaataagctattagattggctataaataaattgaagttagtagctagctacactattaaacttgctctaacaagtcgtagcgttgcatacgtactcgctcgttccatacgtactcgcagcgtaacaaaatttgcttctcttctctatatgcttacaggtaactattatatgaataagctattagatataacaagtcacagcgttacatacgtactcgctcgttcaatacgtactcgcagcgtaacaaaatttgcttctctatgtacaatagtctgctattgtactcgctcgttacgtgcggccacaccgttagtcagaggaacagagggatcgaacgacgccaaatgagggggagaaaacgggaagcaacagcggcgtgaggcgagggatctcgggttctcgctggcttcacgcaattgccaacatcctcgagtagaagtgtaggcgtcactcgatccgtgtagaacaactgaactaccagacgttcgtccgtcctgggaccgaccgaaattaacggtcgccggcatgcaccagtagtcgttggtgtcggcttcaccagtggcccagaatcgcccaaccgggcagtttcgcgtccgcgacctgcaaattttccaatttcactaatccctccctgtgattgattaatctggagtattcggtattccacccacgtggccgtgagcacgagacggcacgagaactcgacgaggcatcgtgtgctgtgtgcgcgcgtttgtacgttgctcagcgagcgaatgctaccggcaagtgtcaagtggcaccgcgtttcgcgcggcgctcctcccgtttagcccacacaggcacacgcaccggcacgcgctccgcaggcggatccaatgtgggtacaaggggattagtctcacaaaacccatagataccccctaaaccctcctcttaatttttttatcatagttgataagatataggtgctaaaggtatcataataatattttagcatagtttaatactgagattatatgtttatatcggtgtactgggtatgttgagtcccctaactttttatttctgatctgcccctgcggacatacacgagcttttgcacgcacgcggtgtgccccggcaggccggcaccgtgctacattgccacgttggtgtgcctgaaaagcggctcaacttgagtgacatttgagctagcatagctatatcttgacacgtcatttttttccctctacgaggtcatgttcttttcagctgtgtcggatcggattatttgctcctatctctaaaacggcattttaaaagataactttattctacttcattgcttagactatttgttctagtttttcaaaatatatttctcaaaatatctaattcattttaataattttcacgaacgcgcaaaaggatcgcatgttaatatattagaataaaatagagtttgtttacccaacgcaatcagccagaccggcttataccaaggaaaggaagatatttcaataattaagtagtgggcaattcatggcaataattcacatagtaatctagataaaaaagaaataagaagacacgaaccaagtgatgggaaatgtaaaagtttttcaggtgggggggggggggtgaagctt

SEQ ID NO: 76296 - DNA, 1388 bp, Oryza sativa
gcgcgcgcgccaacgagaggataatgagatagagcgccgacgcacagaaaacggagcggtatattagcgcttgattaattaagtattagctatttttaaaaaaaaaattggatcaatatgattttttaagcaacttttgtatagaaactttttgcaaaaccgtttagaggtttgaaaagcatgcacgcggaatacgagagagaggggttggtaacatagagcaacaaacgtagactgagttcgtttcccagctttccaactacaaaattatgcgtttgttctcaaaaagtttctgcgggcggccgtcatcaccgctgctagctcgtccagcatcccaagcccagcatggctgtggtggtcgttggtgtgatgttgggacttgtatgtgttgtcacatagtgatggacatgcttttggacagaaattttatgttggatatgaatatcacttggatttgggatggacaaataggagaaaagttgtccaaattttgtatatctgccataattatgtcatttttttaaattaaagtcaaatttatcaaattgagccaaatctgtcaaattgaatccaaatttatcaaagttatctctaatatatcaaagttatgctcgttaaattatgttaaaaagtcaaaacaaacaaaaaaaactttgatacatttgggtcatatgagcaagggcaaccaggacaattcgccccttagttaacaccgttatcatgtcttcacgaaatagggtcgtcaaccttttatttttgattggaaaaaacgaggtcatataagcaaactaaaaaagtagggttaaattggaagttagactttaaaataggatcaaataaacaattgccccaagattacttcatacaaagaaagcattaatgaaatttttttgattggtcttatttacctaatttggattacaacacatgaaaaaaaggtgtttttatattcaacaacgtatccagcttatttgaatgaaaaaaattaaactctacgatcaaaatcccataaaattcaagttgtatattccaatgtaagaatccagatataattcaagttgtatattccaatgtaagaatccaaatataaaccaactaaagattcaactattttagatggtatcctctatctaggtgaggcggtacacccaatgagaaaggatcgccttttccatgatgaggaagcgataggcagaggacatgcgtgcaatgagaagcgtcgtagatgaggaaccgcgctatcgctaatcttctgctagcttcccattccttgcttctctgcagtggagctccaataggtttacctcaccaatatctgccagtagtttctcgcggcactactaccttctgatcacgtgcgagtattgccgcagagatgtgtatttcgt

SEQ ID NO: 76297 - DNA, 5939 bp, Oryza sativa
attcctgcagccctttgcctccctctatttttgtgggccgaattcctttccctcggcccatccctcctctcagcccgtttcccctccccttcgcacgtgctgagcacgcgcgtcgtgcccgagccaagagagagcaccgccctctctctctctcgccctctctgcttcctctctccccggcgccgattcccgccgccgccttttgaacccgccaccgcctttagttcccgcgcacgcgccggtcgtggccgaccgcccggtcgccgccgcagtcagcgcctgcgtcgtgctaccgctcggccccgctgcctgccgcgagctctgcagcgcgtgcccaagccgctccacccgcgtccatccaaatcctggaggcagagcactccctctcccacctccttctcccaaaccggcatggtaaagcccccctttccaccgtcctctcttctctttttccctcccaagcaacgacaccatgcctccactccttggccgctagtgctcggaggcagagacgcagacgccagcgccagctcgccgcccccaccttgaccgcgccagcccgcgctaatcctcccgctcccgcaatttgattctcgccgtccgatccaccgccttcaccgcgcccttgcatccacgccatcgctgtgttcgcaccgcccacgaactgcctttgttgctcgtcagccaagcgccaaccagctcgcccatgcctcccaaaccgacctcgctccactataaaaacccgagcccctcccatctccctcgttgtctcgcctcctctccccaccacaccattgccgccttgaccgccgttgtcgtcgtcgcgcgtgccgtgggagccggcgagtgagaggagccaaagaggagctccgggccgccccatcttcgcactccctctcatcttccctgacgcactcgccccgacgccgcgccgcctcggtgtcatccgccgtgcgccgcctctcggtcgcgtgccgccatcggccttccatccctttccatcctcaaatcgccgccgataccgtttccgcacgccgatgagctccttgcccaaattcttgccatttgcatcatcttggataagccccgagccgttcggttgctcgctcgtccccctaaacatgccgccccgccgttgctctacttcgccgccgccgccgcgcccgcctgtgcaccgccgtgggccccctcgccaatccctcgcgccaccaccgtccttgagctccctaggacctccccaaaccattccctagcgtcgtcgccgcccggcacggcctcgccgccattgccgcacgctcccggagaccgcctctcgtcgccggacctccacggcgcctccccatcccatccgacgccacaaacgagttccctgagtcctagagatgctcccacccctttgagtcaaaccctcatcgtctcatcgtgttgtccccttttgctcgccgccggtggccgccgtcgaaatccgccaccgacgggctcctcccggtgaatccgagctgacgaatcgctccctctcgcccctaccatcggtccggtgtgctccccttgagctgtagtcgctgcgccatgtcccggtgaagccgccgccgccagccgttcgtcctccggccggccttcttcctcctctcgccgcccacgtggccgccacataggcgccacgtcggcttgacccggtcaagccggtcagccatcccctcctccccgtgcgcgtggtccactgtgagccgagcggctgcacgtgggcccgccgctctcccgtccacccggtgcccccccgcatgagccgcatccaccgatccgctccgccgctctcgcgtgcacctcgctcacggtgagccgagccgccgacaagcgggtcccactcaggaccgcgcgaggtgagcccggtccacccggctccccttccccccctctctccccgcgcccctctcttgggccgcctccccgtagcccatgccagcccaataagctcggccgagccgcgcagatcctctcgggccacgccaagccgctcgggaaagtctgatttctctccctcgtccattttctttccaaaaagggtttaataaattattaaatcctttctcctttgattagaaaatccttagaccttagaaaatccatatcttcccaaccgctcatccgattgacgccgttctacttccagtaattccctaaaattgagatctatttaatggcactattaattgtgtaaataggatctttcttttggtcttttgtttaggtttttgattatttgcgtatagttgcggtaaccgagatattagtcaatcgtggttttctcgaagattcgtgaagctccgtgaagaccttgagcaaggcaagtcaccctttgatcaattgcccctataactggaaaatcattattattttgtttgcaacttgcattagtagaatcacacttaacttgcttggcctcggtttgcacgccaaaccgacggacctacccagtagtcgcactaattcctgtaggatgtactaccctgattccttgtcgctccacccttgtggtacttcggtatccgtgctctttgagcgtgtataccaattatcccacatacaccgttgattgtcgaaaattgggaaatgggtttgagaagccttgaaaacccgacctgaggtgtcggtgtgtttaaaaataaaatgaattgtgaaaactcgcgatgcgggagccgtgcctacgtggcgctgtcccgtattcgcatataagggccgattcctgtgggaaactcatcgagcataatcaaagtacaaccacaaggtggaatgggacaccctggctaagtaactagttggttcagggaaacctcgcatgccaatagttgggaacgccggggcggggtcggacaaaccgggttcctggtaaggcaaggacgagaagcttgcttacttaccgatcaaggtggttggagttgatttgtgaatgcctaaaatggcttatgtttatgtgaggatttgatccttctatgtggcatgaggtaaccctgggtcggcttgggaaaggctttgtcgcgcgcctctgacaccggccagtgtctggagtaagttcgtgtcttgtgggtaaagtgtacccctctgcagaggttaactaactgttcgaacagtcgtgcccacggtcatgggcggatgtgaggtagttcccgttgcgtagatttgtttaccagtgctttgtgaaaagttgttgtggtgtgggaatcgtaaccagaatcagcctatgtggcagatggatgacctgagtggtcagaaacgaatctgtgtgattcgggatatctgcgggcatcatagactaggcttcccgaggggaagcggattgctttgctgctgggcagctggactctgggagtccgagaaaatgaaaaaggctctgggagccgcctaatcaagtgaaatggctctgggagccgataagtaatgatctgacccgggaggtcggtacattaccattcgagttgttgaaaagcatctcttaaagtcgaatcaagacgcaagtctcttttcgacccaaacttaaaaaaaaaggaggtaaatcacttagtgattccaaaatgctttcaaacaaaagatttgcaaaacaaccttacctctcttccaagcttgcattaaacacctaaattcccgtgacttgctgagtacgaaagtactcacccttgctctatataaatatatatagttcctctgccttgaagtgaagatgaagtgaagtgaagattagggtttcgtcctggttcccagccgtcgcctgtggtgttgggtgttagttcgttggttccgctgccgctgttgctgttggtgtttcctcgtccgcgtcgtcggttgcattctcgggccgttctaagctgcaacctaagttaaggtaaataagtcctctatttattttaaggattgcaatgattcatatttgtcaccatgggtaccagcactatgtcctgggactggtactgagatcacggtttcgtaggaagcggttcacgtcgtttttcctacgacacgctcctgtcaggtgccgttgtacggcggtgccggattggggtgtgacaagaacactttcggttcaattggatcgataaatttctaagaaagataataatgcccctaaaaccacatgcttcaaactgcatgatgctatagtaaaaatttagaaattatacaactctaaatttaccatcacattatattccatcttagctctagtttcagctcaaaatattttgaccatagaggcatccttgtttttttgaaaaatttctctctccaattgagtcgaaagtgtcatccaacaaattatcaatttttaagtatcttttagccgtgacatgtttttataatgtctactagtaaattgtacattttttaagtgtctgtagcaaattttgccataaaattatgtattgtatcgggacgaaagacatagagagagtagtgtgttagcaagctctgttgctgtctgatttactatgtttttcattttgctttttctgtcacccttagtgattatgtataatttctctggtacttaaaataaaaccagcaacgtttggcttaggtttaaaaatacttgtaaatcaattctaaaaccttaatttagctatgtcttatatgtcaacgagaagctagccaagccaggcaaagcatgtctctctcttttattttttggaatttccatggtagaatttattaagaatccctaatattgaaatatgaatagccgcaagtcccagcgtgtaaaaacagcttagttaggcagcctgaaccagaagaattagtggtgccccgacttaaaacgacgtagaccgccaagaaacgaaccaaccggcaaccgccgccgccgccgccttcgattcgattccgatcgagttggagaaggccgccgctgcccaatggctccgctaccctcgccaccgctgctggccgaatcgctcgcgacgctgcgcacagcctcgccgtcgccgcccatcccctgctctcctcgccgcacccggccgttggtttcagctaggttcgcaagaacggccggccgccggagccggagcacggggggaaggagagaccttaggagctgtgcctatgcggcggaagctgagtacggcagcgcggaggatgaggtcgccgacgacttctactccgttcttggcgtcgtgagtgttctggaacattctgttgaacaattcctttgcaataatttcggtttacagtttattaggttagtagggaagaactgtgcattttagactggaatcattagagatcaatttcttctctgtaaaaaaaaaaatcctacttttggtgagggaggaaagatgcttctttttttcagagtggactcagacaattgttctgaacttctgatgagtgatgagtgatactctgatagtggttttcctttgagacgacggatttgctgctaataatgacccctgatttttgcatctccagatgccagatgcaacccctgaggaaatcaagaaagcatactacagttgcatgaaagcgtgccatcccgacctcagtggggacaaccccgaagtaacaaacttctgcatgttcatcaacgaggtttacacggtaaaacccttcaatgaaaccttgggtccttgtgattgcatatggcaattgtcttggaagatgtgttttgcattgaattcttttttgttcaaaacgctaacatgaggtgttgaagagcaggtgctgagtgatccggtgcagcgtgcagtgtatgatgaaatccatgggtatacagcaaccgcgaccaaccctttcttcgatgacagtgcacccaaggatcaggtgttcgttgatgagtttacctgcataggtactgacattttttggtatgaatagagctataaaagatgctatttggttcttcataaagagatttgatatatttcaccttgttgatgtggggctgcaggaat

SEQ ID NO: 76298 - DNA, 2508 bp, Oryza sativa
acaaaacagaagttgcaaattgagttacgaattgcgctgcatgaatgcataggacaaaataaccatacttgtttgattaagaaaacataccagcaacaatagactttttaaatgtctctagcatgaagaaaccatgaagaaaacatcgtgcgtgtaaaatttatatgaccaagggccatcatcagtgctttagctttagtggcaggcctggaagaggaacatgagagaggacaagagaggcactatgccaaattgtcacttaataggatttaaatcctggttccaacaagtgttacacgtatatgtctgattaacaggaatttattaagacgaggaatttgtcactagacttcatctcttccattatcatgtgttataagaggtatactcacaggtatttgtgcacagcttccatgtaattaaaaaaaaggcactatatagtggcaaattcagagtaagggctcgtaactagcgcgattcaatgtcaatctccaacctcacaattacagtgctcatggtagtaagtttttgttatttacactgagatacacctaagagaggttttccattattgtacaacagtaacaacagctggatggcttgctatcaatttgagttttcactgatacgctagcattctgcagagaacaaaaaatatgtcaatagagcatgtgccaccggcccaccggccaccgccccacatgaaagtattgagttatgaatcgctagcataacagctggggctttcacttatgtgctgggatttctacagagatcaacaatgccaacagagccatgtgaaaactgtgagagttttaaactataaattgctaacagcaacgtccacaaatttccaccataaagcaggaccggttttatgccttccagacaggttcattgtttcgttgaagacgccatgctggagagcgaagaatgttttgtttaagaagctagagtagtggggagtgctttggagggttttctacctgtttatttttggttgcaaagtatgttgttgcaaggcacatgatctgtcttagactgtttcaccttttattttattttcctattttgactgggtacattttagtaggtgcagatcgagtttacctcacttcaaaaataatattctattctgtcaagagagattctgctggtgtcttccacggatgaaaagctgatgttaaaaaaaaaaggagttcctttaaacaggtaaacatgttcagatattcaggcaactttttgcgagtttgccaattatgcatgacttcaaatttgcccaccgtgtgtaagggtatgtactattagagaaaaacaagtacggttttttaatgattaaaaaccaatacttgacagtcttgcaataatgtggacggcaaatagaagaccctgaaaacatgggaatgcaataagaaaaatacttatatattttttctatttatttaatgtatagtgctcgtgtaagttttataacttttcttttgaagtgcttgagcctaaaatctaccaggcctagcaaatatatgtgaaggaaacatgaccacgatagtataactgacatgaaaccaaacagaagttcttaatctcacatcaaattcgtttgatcaaaataaagaagaaacttatatattggaggaacacaaaaggcactggagttgaattctatcttacatggccaacttatgttgaaaaggagaaaattacttcctcttgggtgatgttttgctctcgaattgttaaatttagatacaacacataattgaccagtaagttgatgtcctgctaaatgaaaggatcaatgctactgtgcaagaaatgcaagatgaattgggtggttcaccctctagatagtttcaacccacgagaaaatgaagaattataattaccagtttaaagagaaagatatttaggtgccaaacttccagagttaaacagattatttcacctgacaggactcctcctagcatgttgctggcaaaaaattgctcatgtagacttgtgcgagcatttcaccaagctttacttgtgattcagtggtaagatgcagatgatcttcatttaatgacagtccaaatgcgtccacagttacaacattgggcaggttgataccaagctgagctttcctcactttttcaatgttctttttattcccagatgcaagagcaacctgtttaatgcaaacaaatcttgatataaatgataccccatattacaaatgatatcgagtacaaataaagggtaaggttggttgacacataagatggcatcgtgtgtgtagaaagagtgaaaccagccatcttatattggtaactgaataaagaaaattcaaggttcaaaagaaagattacagagccatgcaaaataaaacatattagtttactagttaaaaccaatcagttatcttgtactgggggatgtaaaagagggcctgatgatgtattaaatcgaaactattaacttcaactttatacatcccttaaagcaacatctaggcacatgtataatcgt

SEQ ID NO: 76299 - DNA, 2917 bp, Oryza sativa
caggttttagtgggcaagtaattaattaaccaatcacgattgaccatcgtgaactatcattaagccatcattaaataatagtgaatcttaagttatcccaatagtgtgctaatgtttctaagcatggctaagcaatcatatctaatatctagttgaaccaatatatatatagcccaactagtcaagttgtaataacccaaggtatcaaggaataaagtgatcaagaacaaaaaaggctataacaaacaataggttaattccacccaatgacattcgaaaataaatgcaatagttgaatagaaacagtagctttaaacgggatcaacatgctcaaagggttgtttaggatctgtgtgacttgccttgctggccttggaactattcaaattcttctcctgcgaaaacggactctccggaaacgtcggaatctaaacaggaaagagcaaaatcaccaaaacagcacataaacaagcatgaacagtacatgtggatatttttaacatgtagatctcaattttagaaaaatttagagacttgaaccaactaaatccgagctaaaatgaattagttatgaatttttgaagattaaatcggattaaaacacttatatggattttaattgaattatgacgcaataatgaattatttttgaaaaggaaaaggggtttattgcgtcagcggctagggtttgcgggggaccgggcccccggcaacggttcacgggaacgaacggccgaaatcgatccatccaaaacggacggccgaaatcgatcgggtctacggcggctcacggcagacggcccccatgacgtcagcgggaacgtcacctccggcggcggttggggggttcaccggttcgggcgcgcttgctcgccggcgaacgacggcgcgacaacgcggacggagggcaccaggacgtagagcgcggggcggcgaactcaccgatgaccaaaacgtcggcggaagatgaacggacggcggcggcgacaaaaaagaagcggcggagaccttcggcttgacaacaacggcggtgctccggcggtctacagcgacggcaaaggggcggacaaggacggcggcgacttggcgaccacgatggcgacctccccgagcgatgacgacgaccggaacgacggcgaagcacggctggagcgacggcgacaactgcggctcgaggttacacggcgctagggcgcttccgacggcgagagacgaagacaatggtggtggcgggtagcggcgacaccggggatccttttataggggcaaggaggcagcggcgaaggcccacggcgaccggcgacgcgaaagaaacattggggttcggaggaaagagatcgatccgattcgacctcgaatccagaactttccaaagcgatttagccgatgattccaaaagagaaaaggtagaggagatcccgaagattgtttcccctctattgatttcaccggatcgggaaagacgcggccgaatttggaaagcgggcggcgggcgacttgccgctagggtttccggcggcggcggccggaggtaaacgaagactgacaggtgggccccacctgtcagcgggcggacgcgcgcgcgcgagcggcggctgctgctggactgggccgactgggccggggagagagagagattttgggccgactttcggcccaaagccaaaagagacttttaaaaaacctttttcaatttaaattattcatgaaatgcaattccatttattaaaaatacttccttagctcaaataaatcccagaataatctaggaattatagaattaagcaaagtatttaatgaaattttatctggccccattttatattggaatctattaattaaaattagatttctcttctaggcttttaaaataaattctaataattccaattaaacaacaatttatatattttggatttttagggtgtgacaaacctaccccccttaaacagaatctggtcctcgagattcggaagaactggcgaacagatgcggatgagctgacttcaattcatcttctcgttcccaagttgattcttcttcggagtgattactccattggacttggcaaaaacggataactcgatttcgggttcttctctcatctatttccaaaatacggattggtttctcaacataggtcagatcctctgggacttctatctggtcaagattaggcttcttcggtaggtacccttaaacactttttcaattgcggacaccatggacacacattagggactccggccaaagattgaggtaactctaactgataagcaacctctcctcttctactgacaatcttataaggtcccacaaaacgcggtgccaattttcctttggtgtgaacacgatgaactcctcgaacaggcgtgacacgaaggtacacataatctccttcttcaaaactcaaatctctgcggcgattgtcggcataactcttatgacgagactgggccacacgcaatctttctggaatgatcttaaccttctcttctgcttcccttaggatatcagtcccgaaaacctgacgttctcccttttgatcccacaaaagcggagtgcggcacttccgaccatacagtgcttcgtaaggagccatctgaagactagcttgataactgttgttatacgaaagttctgcataaggtagattcttatcccaacttccaccgaagtctaaagcacaagctctcaacatatcttccaaaatctgattcaccctttcggtttgtccgtctgcctgtggatgataagcagtactaaagttcagcttagaacccatctcttcttgaagcttcttccaaaaatttgaagtaaactgactgcctcgatcagacactatttttttagggacgccatgcaaacacacaatccttgccatatacaattccgccaaccgacttccggaataagt

SEQ ID NO: 76300 - DNA, 2005 bp, Oryza sativa
  unsure (1)..(2005): unsure at all n locations
atgctctgaaacccaacccagcataatactaggactgtttatctgttcataacagattactgaatgtgttattcatgtgtgttatatttccatgtccagcccagtcaactgtattcactggacttctgctgcacagctttctctccttgagaatgaaatgcggagaatagagcgggtgaatgtaagtaatccttctttcagttatttagatgtacggtatatttttgtggtcatataaatctccagttctttggtttgattattaggagtttaggaccttatggttaacttctataacatagatgtaatcacaaaaactcctagttaaaataaacggtgcacaagaaagtttcttatatccctgttcctttctttctgttagcatttttctggaactcaagtgatattttacaggtgatattatcttgttttctcctaatagcctagtagtacactaaagggaatttcaattttgaacaggttgggctgatgagtgctgggatgggagtttcagttgatgtattccgattggtaaatttgtatgtctttattatgtaaatttggcatgtactatctaaatttctctgtttgcatatcctcaagattctttcttccatgtctatgttaaggctaatagagtatagataaagcatacttttgtttaagcatacagattatattatgcataatacttctctatgttgttaattttacttgttcttaagatattttctatttaacaggctagcgtgcgttgggaaaagagacagtcaaaagttttggtatggttccttcccccttcgtcatctttgtgtttctcatagagttagatgtttttaaggatttcgttatcatttacctatttgtatctttgcaaatgggtcattgttttgtaaactaaacattttatgtaaacctttattttgttacaggaaaaaattaggacacggatgacaaacaaaaagtattcagatataagtagttcttggactgatatctggggatccccaactcgataccaaggaaatggtaagctaaaacaaataacacagtttgttagaaataccttgcatggtaaccatgcagaccagcatgtattgtgtaaatataattgttgttaccaaaaatataattattgctcattcttgtatttctgaatccgattgagatttgctgatgatatcagaagaagaaggaacagagagagcgaagagagcagctgctgctgctaggagatggcgagaatactcgagaaaaggcgcagacaggccaccggagtacaaacttccagaggcagcgggcaataaagagtaatagcagaacaaagaaatatttctatcctgcttacgttatctgatagcatttcgtcacctgtacatatagccttattgtttgaagagagctgacatgtagattgctctctcccaattcctcatttttcatttgtaatatatagctgataacaataacctgtagaatacaaacgtcaatagttaaacattcggaatgtaaaagatgaatatgtgcacattctccttcaacaatggtatacatcctgaagatccatcttttcttgtgtgtgtttgtgcagatgaattccggggcaaatttcctttggcagtagtctggtaacccccaggcatcgatgatgaactgcaacatctgccaaaggacaacttgcccagcaatgcagctgcacatctcatggtctcaacctatttctatccgtgtgccacatttagtttcatgtgtagagcgcacagttcactgatcattgtgcagtgatatttatactcgctcctgcatggtgaaaggnnnnnnnnnnnnnnnnnnnnnnnnggcctttctctgctcctcctgcaaaggcacacggaggctgataggatatactgtaggacaatgcctgctctctagattgtgcccacttacaggaacaaagtctgaaatggagagatcattgtagtgcatatatctccaatctttttaggtcatggggctacttccc

SEQ ID NO: 76301 - DNA, 12707 bp, Oryza sativa
gcgacattgagattctctgcccaagcaagctcagctgatccaaagtcatctctgcatccctcagtgacccatctgaccgggaagcaataagtttcagggcatctctatcaacatctagtccttcgctagtagaaatccactgtaaagtgttgacaatgtcacactccttcagtttgggaaagaagaacttttggcacctcgacacgattatatgtgggagatcaagattggggctgatgaggataaaaaccacacgccgaggtgcacgttcgatgaccttcgatatgacactccacgtatcaggtggcaatgtgttgcaatcatctactataaacaccctgtgctgagttggtacaggtgaaagcatcacattatcaaggatatccacaatgctgtcaaggtcaatgttaccaacaggcccaatctccactaagctcctactcttgcccagattgtgtgcgatacaagacgcacatgaatcacagggcctcgggtgctcaggagaatggcaattcaacgcctttgcgaacacccgagcgcatgatgtcttgcctgtgccgtgcggcccgtagaacacatacaccaacccaattttcctcttcaggatggcattggagagagcctgcaccaccaagctctgcccaatcatgtccttgaaagtcttgggcgaatacttctgcgtgaggctctggtgccggcctcgatgcgagccccgtgacctctgccccgaccgtgcctctgatgcgaggtcagaatcaagctcactggtctgattcgagaatatcccgagctcccccgagaagctcctggcaatgccaccgatgccattgcgcacgccgtcgacgagcagaggcaacgagtctgagtccgaactggtcgaggtcagcctcgccgtgaccgggaaatgcggatgcgaacgcgagccgtccatgtgaccgcacgagcctgcggaggtggcggcaatggacctccgcgccgccgacgccgacttggggtcggagaggccgcacgagaagctccggccggccatgtcgaggaaggatttgccgcggtggtggatgcgtgaccaattccaggggatgccgcacacattgcgcgagtcctgcgacgcctgcggcctctgcagctccaccccgcactcgtcgtcgtcgtcgtcgtcgcctccgacgacgccgaagaggtacttgttgccgcagacggcctcctgcgagctggagttcaccgagacggcggcggcgccgtccacgccgcgatctagagcgccgccggtggcggacgcgggagcggcgcgccggcccgcgccgcccttgaaccggcgccgcgggccgcgagacggcttgggctgcgggttctccgcgagctggtcgagcagcgtcttgagcgcgccgccggggcgggagctgtcgtcgtggaggtcgtccccgagcccgagcccgaccccctggggctcggcggcgaccctcgacgacgagtccaccgagcggcgggtggacgggtcccgcagcgagcgcgagcgctgcagcgcgagcaggtcccgcatcagcgcggccgacgccgacgcggacgaccccgtcgggctccgcctccgccccgacgacgcgctcccggcgccgagcccgtgcgcgtggtggtgccgcaggtggatgcagttggtcaggtgcgcgtgtccccgcatgtggtgctcgccgctgccgccgccgccgccgccactccccatccccgcggccgctgtcgccgccggcgccggcattgcgggcgatcgatccggactcctcgcctaaatcatcgcgtcgcgtcgcgtcgcgtcgcgtttcgcggcgagcgaggccaagaggagggtggtgggttggggggcgtggcctcgggtggcgtccccgaagtggccgtgctttcgacgtcgcgtcgcgtccgcgaccgcggcgtggggtggggggagtcgtagggttcgagcctgccgtttggccgttggatgcatctgcagatctgcaccctcacgcccgcgtgtgattactgtgccggttcggtaagtttcggggagctgagaatggccagatgatagtcagtttttaacaatataaaaaaactggattttctagtttctatttttattttattttctaaattttataactatatcttctcataatatgtaccaaaagctaaatttttttggaagaagcttctgatcttgagagaagctgcggtagctagaagattcccaaacaggctcgaatatatttgagagcataagattataagaatatggaaaagctgaagtcctaatttctgatttccaattcattttgtgaattctataactaaagatttttaaaatttgggtgaaaatctagattgtttggcttatgccagctgaatattttaggagaaaatgtagttggcagaaactccccaaaatagacaaaagctcttctagacaatttaaatttctgtttagattctaaaaaattatagatgtaaaatcgtaaaaatgaattgaaagtcagcaactagaaaacacaacttctacagatttttagaaactagctatcagctacttcttgtttcttaaaattttgaactccattgaacaagtctgagaccgtctgtgacacgagattattacccttgtgctaaagttgagtggtctaccgctaacagtggcaaaatggcgctaatagagctgcttgtttatgctttcttttcgaggctatgtattgaggctaaaaaaaggaaaggtgctaaactgctgattgcacgttgtgtcgtgctacattttagtttagataggtaagttgttggtttattaaggtgagctaggatgccattcggtgggagaatctctctacgagactcgacacgctgctgattatcttttggttcagagcttttccttttgttgacttcacgttgcctacttggtctatgctttggcaccgtaccacgaacgtgcatatgaatatgtgatactggccgacagcgtcggtaattacttattactgtacctaacaagttaaccggagtaacgtaccagtaggtaatgttaatgtcaaatcatgagaaattatcgtgccaagtacacgacagagtcatcgacccgtatgagagtagtaccgcggtatagccatggtgggtccgtaatctagcagtagctgcggtactctagctgtgggcctgcatgtgttatctgtttttttttttgttcacagtgatacactagtacatccatccaaaatgtagagtaatatttctaacatattacgttgtctcgaaataaagttatttctccgcctatcttctctcaaccaatcacaactattcttcttcatctactttctcttttcaaccaatcacatattttctccaatcattctcatctacagtattttcttaatacacgtgctaaccatttaagttatcgctatcctatggtttggtgattattgcacgaaaccacgtaattatcgtgatatatatagtaattttaaaaattgaaaatatcatgatagccgcactgttttataaattgtgatggtgacagggattggggaggggtgtacagcccacgcggcagtggcgagcactgggcagcacggcccgggctacgagtagactctacggccccttataatcataggaatgaaaaaaacgaaggaatagcaaaaagattctgacaggaatacaagtgtaaaacagaggattataaaacacagcaaaaacatagaaataaccgtttgattgagccgcagaaaaaacactgaaatttgaggagagataaagactcagaggattcttaacatgaggtaaaacctcatgctaaatttcctccaaaacttacatgggaagaggcattccataggaattttatgggattacataggattcattcttttgattcaaatggctatataggaaaaattcctataggaataaaatcctttaaaattactatgaattttctttgaatcaaacgggcctacgagtgaaattgctaggcccagaaaatactccgttcgatctgatcttcctgcattcttcatcagccagatagcactgtagtttgtgcggatgaattcacgcgaattctgagggtttattttcggtgcacaacaccagcaatccagccaaaaattgaaaacagcatatcacaatacaccgggaaacgtttttgaaagagagggctcctacccccaatgggcgcggaaatcgaggcgaatcattgtgttctctcgtccaactgcagctctcggaacagaacgaaaacgaggagaccgaggagaagatgagtgcatcgtagtacactcgcaccactggaactccttcctgtgctcctggcgcagtagcttcagttcgccgcgagtcaaaatctgaaacctctgatgacaccctcaccagtactgcaaactgacatatgggcccccacagaccctcgggcccatatgtcagcgagcagtacggcagaggatctagattgctgatgaagcgtgtgcctcacccgatcttcaggtaaccagtgtgtatcgttacatggtacaaaagtatgctcaagccctctttgtttagatttataagctaacttataagtcgaatagtctaaacctaaacaaacaagtatctttttcgtttggattttttgaagccataagccactctaacactattaagccaaaagctaggttggataagttttttttggcttatgtgaggtagatgtattacttaaccactaaatttagtacattaaatccactggcttataaatcatataagccaataagctgacttaaaagtctaggccaataagtctaagcctaaacaaagagggcctcaagctgccgggcaatattatcttttttgacgctgacttatttattttctttactctgaatgtactccctccgtttcacaatataagtcattctagcatttcccacattcatattgatattaatgaatctagatatatatatttatctagattcattaacattaatatgaatgtggaaaaagttagaatgacttatattgtgaaacggaggaagtagtatattatcttcagtcttacttcaccttgcaccgtccacacagtaaccctgactgaagcacagatcatacagtacatgatacgtgtagtaccatttttactgtatcagggtccaatatggagtagtcctagactctgatgagaagttgacaaaacatgccctggtgctctggtgagaaattgctacaatactctctctttacatgtgggctgcttcacacacagcacggcagcatgtagccggaatactgcctaaccctatgaggacatagacaaagtagcaatctgtcacaaaattgatcagtgaagctataagccagctaaatactgaggtggagaagagaagagaggagagagagaggagaagtgggctgtaaacttacagctggcttggacataagaaccaagaaactctatgagagagataagtgtgccatgtattaattatgaagagctaactatttgttaggaacctaattgggctgtatatgggccaagctagccaagtcaaagcgaggcccaagcaagcagaagggggcagcatacaaaagcagcagcagcagcattgttggaaggcatcgaacagaatagaacccggcacggcggctcagcaacggcggcgacttggttcgggcttgaaccttatcgatctccttcttcctccctacttctgctagtaacttgtatcccctattcaatcccatttccaccacaaagcttgagttgtagtaatacaattgcagctcaaaaccacctcgaccttcattgcttgtactgtatattggttcattgagatttagatattgggttgctaacaatctggtatcagagccgttcggttcactgggattcttgtcatggaggagtttgggaggcagccatgcaagagggagcaggaattaggttgggaaagttttcatccaagcagcgcccaccatctgttcgatgaaatgtcaagcccattggaggtgtttgaggaacacgttcttcttgtcatgagtgaggagaacatcacatgggatgaagcactccatctgttacaagaggaactgaaggatgcccaatgtagatttgatgagaagctagatcgttttttggaggtgttcggcttgatgggagacaagagcaatcaatctgagggagacaaaaggagcaatgaatttaaggaattcagtgcctccatcaaggagctcacccccaccaccgaggctgctgcatttcaatcaccccaagcatcaccttcttcagcgcccaccaagtgttcgatgatttgctttggcctcgacaccatgtccgacctcaacatggcagcagcggttgtgtgcgccaccacttctctagcctccgtggagttagtggctagagggaacgcaacctgtgaaccctacgtcaacacccctggtcatcccaaggagacgcacaccaagtgttcgatggttggctttgaggtcaagggtggcaccgaccacaccaaggtcacatgccataccatgatgggtgtgcctgatggcgttctagtacctgaagcatcattccatgaagcgtccaagtatccaatcctgtagcccatcacagttggatacgctgtgacagattggcgtgctcacccccgccgatcggaagatttatttataagagcaggtacaataacaagctataagccaactataaatatattttaaagagataaaggaagagagagaagaacagcgagctagagatctgtagccaactgcagcacggactccaaaagcaatgcgtgtatgacaggtgggaccaggtattcatagtatagtaagtaactattgtacacatttgctattacattggctatagataatttagagttagtagtgtgctatactattaaacttgctctaaacaggccagatccgacaacggcaatctatcagcagcgattccagaggagaaatcatgaacaacgatggtccctgttatggcgtctgcttgcttcatcatttcgtttaggctaataaatcaaaattttaaatttaatttaaaagtttagatcgcacaccgtactgtttgtttgcaccattactgtagcaccgaatctggacaattgatcggaaaagccaaaattatatgcagtcgttaacttgaagttcctaatataactgctgattcgtactcgtagtactttgttcatcctgagtgtctctctctctgtcgttttggctgatatgtctgtctgcactcagccgcttgtcccactcccaagtcccaaccgcataacattgtgcttcaaccttcagatgtgttctctgcatactagaacaatgtaagatgctcattcgtgctgctggactcgttagttcccatcacaagtcacaaccccagcatgttgcagcagtgcaacatcctgtatatgggtttatatatgtaatgaggtcgtacaagtaacaagtgtacaactctagcgcaagcaagttcagagacaatgctgcacagaaaaagcctaattatagagtaactgcagaactacgaaagtaacttaaacttcatttatgttctgagaaatacagtcctgagtcagcgatcaatgaacgatttacatcatttacaggatctgtttttctattcacataacataaatcttcactcaaccatcacggttcacggatcaaatttgttggctcactcaaaacgtacttgggcagttcatacttggcacctgcagcagagttttaaaggttgttattagtcttgcgtgatatagtggagcaaaacagtataggtggtgaagaaacagcgagaattcccaacgaagatctgctcacctctctcgtcataacaaagcgtcatgtcagaatttgaaacaacaatcccagcactgttcactatggtttgtgcaagaggtaattcagcttcagcagcagccctaagtgcatcccaaatctctgtaaagatacaacgagctaccagttatttaactaaggcgatatttgtcagagcacactgttaaaattaagcaattgtgttcaaattttaagccatgctacagttgtaaaataaactccaatgccaatatgaatgatttctacaaactttcttaaattcgaacataacagggcttgttgtattgccaaaccaaataaagattattcagaagagggcatagataaagatggaccttagcaacttagctgcgaaatatgatttaacagtatacaaacattcaattgattttgtttgacatacataatagataaatgtcatagatggaactatggaagagcgttttcccaatcagccttgaaaaatcagctaaatacctttctggcctccatagtgtggagccgtgtcccagaattcttcacgcatctttgagagttgtgttggtgttattgcctgagtgtgcttccaaggttttggctttttgagcttcttactgttctctgcattaaagaagaaggttcaacattacttattcattctaactcatgtcaaagaaatctaataaaaccttgctaggatataaatgcatatcaagcaggattctagttccaggaactgttctgcaataaggccttgttacaacacgacttatttataaacctacattcatctactgtgaatagatgtatcataattttctgaacaaaaaaagcagattcatctttggctcttcactaacttggcctgtatttaaagtagcaataccaggcaatccaactttcgaaagaagtataaccagtgctaaaaaaaattgaagtttcattagcgagcagacaaatatcccaagtgtgaggctgaaatttcacagatgagtgtgtctttctgtaatgttccacctaataaagtatctataactagataaggtgttagaaattgatcttttcgataagcaagacaagatttagcaattggtgaaggcaaagtgcttaatctgaacaaacttttgattattctacttcgagaataatctgtcactttatttctctcatcatagacaaatgctacttttgcaacatacaaacaaaatagcttttctcctttaagaaaatgatataaccaccaatgctcttggcattcagaatactggtagcgttatctctccactaaccaaatgtgacctccatgacgtaggaatttgcactactcactctacttgtatcagataccatccccacatttcgatacattaattccatgagagcactgtcaatcctgcaacataccattactagcagcagatttgatacactacatcacagtaatgagtaatctacaggtgatactaagtttcatccaagtcaacagttctactgcagctggatacttgcaagacgcttaaatcgacagctcaaagtactatcggattatcagttccggtcacaattcgatcaataaacgagaagactaatcaacaatagaacgaacaacctactcctagctaacaacagctctggaaacaattgatctcggatctcagaatctgagcagaaaacaagaacaaagacagacaaacgaatcgaagcatcaaggaagagagagtaagagtaccatcaactttgggagtggatccagcgcagcccatggcgacgacggccgatcgatcagacgctcatgtgggggggacgcccttccagaagcttccggaagcggagccggatctcgcggcgggagaggcggggtgtagtagtgggagacgaggaagaggacggtggatttaataagggttaataaagtggacgagtaggagtaggagacggcaaagcatcagcagcagcagcaaattcagcggcatacgagcggcaaagccagtggaaaaagagaaaaaaaaaaaagaaggcaactgctgctcaggtgacgtcacctacgcaggtgaggtgtcccgccacgtcacctgccgccgcgggcccacgtatcctcccccgcctagacctgttccacgtcgcgacggggcacagatgtcgctgccgagtgggccccacgccggtccacgcacggggatcgcgcctccctccgcttcccgctcttcgtggtcccggttcagtggaccaacggaggctgacatgtgggccctacatcccagccggtccacgtcggttcacagcaccggctcccccttcccgtcccttcccgtcgtggtgccctgcacgcatcctctccgccatttttccgccgcatctggagctctaaaacccaaaccctagccactgcgccgccgccgtcgccttcgccgccggcccgccgccgccgcttcagccatgaacgcctttcggttcctcggggacatgacccacctcttctcggtcctcgtcctcctgctcaagatctacgccacgaaatcctgctcaggtgagcccgagccgtacagtgggggtagggtttcggccgcttggttgggggtgggggggattctccgctcacggatctgtgtgttggcgcaggggtgtcgaggaagacgcaggagctgtacatgctggtgttcgtggcgaggtacatggacctgttcacggactacatctcgctctacaactcggtgatgaaggtggttttcatcaccagctcggcggcgatcgtgtggtgcatgcggcgccacccacaggtgcggcgcacgtacgacaaggatcaggacaccttccgccatgtggtgctcgtcgccgctgccttcgtgctcgcattgctcttcaacgagcggttcaccttccgcgaggtgatgtggtctgaccttactttgcttgttcaccgcactgttgaattgatgctgcaatgggacgcccgataaagtggttaattctgctgaacctatgtgcattaagaaatatgatatatctgcttaatatgttttcccatgctacatttcgttgctaggaaccgtaattaaaattcgtgtacaaggctgctagtgctgtgcaatgtaaccttaacaaatttatctcagtatgagccaccctagcaatctgagttcacagtttgcactgacttgaacaagactataggcacaatcatcgttttgttcagtgcagtgaagaattgtggataccctattaataaaatcctacttaagtaaggcaatgcagactgccgacagatgtttgttgatctatatgctatttgctgatgttgtattgttgttagacttcaatagtggtcaaatgccagacaatttctcagacctcattctagttgttttcaaagaacactgctacagtaggagactcatctgaaggtagcatatccatagaatgtaacaaaaggttaggtgaataacacctatacctattgaattaatttagaattttagaaacctatgtattatttgctcagtatacatcatcctgcactaatcaggatttcttccctttgggtaaatagaatctaatcccatttttctgtagtttcaattgtatggtacagattatattcttcgaagtggccactttttttttctagagcacacatacttcttcctcttgtttctactggaaccaattagtcagaatgatgcatagtaaagtagcacattagtaaaacacggtcatgttgcatttacatttgttagtatgatacacaaattaacataatttcaccgttcagatctgctgggcattttcgatttacttggaggcagtggcaattctccctcagttagttttgctgcagagaagtagaaatgtggacaacttgactggacaatatgtattcttcctagggtatgagttttaccacacaagctttttaccataacatatttatacatgattcctgtattacaagagaatgaaacatgtttgcttttcatgcttcaacggcttctgttgcagtctccaagtttatgatggaaacatgaaatatatgcatgcattaactatttagtttttgtttggtccttaggcttgagaatattgaatatgcatgtatttttttttctttatggacatatgacatgtcacatgttccttctgtccatttatattgctggtcataaattttggcacatgaaatgcatcccatctattctttttttgacgtaagaaggtagagctggctctaccttatagccatttccttaatagaaatgaggtagtacaaagttttagtgaaggaaggaaacgaagaagaaacggaggggactttacattagttttggtatttacagatttaaggttctatctgcagtagctgcatcccatctattcttagttctctttcgtcgatcttccatttttcctggttagttctaggcttgattaattaagcctacatttttttaatatacattgtgtccagattcggattagggcatgctttaaatagtgaacgatcgacatgcttctaggttcccagttggtctctttcaagtctcacaatacttgttttgcagggcctaccgtgcattttacatcctaaactggatttaccgttacttcactgagggtcaccacagcagatggatccgtaagcgcctgcccctcgtatgcttgtgtttcatatcccatgttctatatatgaaaagaagttctgacgatctgtttcttccagcttggattgctggtttggtccaaacagctctttatgcggatttcttctactactatttcttaaggtaaactggatactgttgtcaaacctcatttgcagactctctgggtactgacaattccatgtcggttgttgcagttggaagaacaatgtg

SEQ ID NO: 76302 - DNA, 2932 bp, Oryza sativa
caaattaaaaacctaaacggttaaaatccaccctttttgcaaggggctaaattccacttagctccacacatcgcattaccaaacattaattcacatgaaaagcaactccatcggctcaactaatctgttctttccgttccattacatatgaactaatattgatcaaggctaaaaagcaggctatatttttatcttacattaatttgtttgtagtaggtatcatgcgaagcaaaactatagtatacatatgctcatgggacgctaggaattgcacattgacctaaaaaatattttaagcctgaatctctattgagatcttgtcattgattatttggggccatttggttgaaacacagcacaactttgtcaagaaaggcaattcataaaagcaaaagtaaacaagtgaactggcgcgtcatcatccacaaatctctgttttaacttttaattagtacgtaactaacaaaaaccaaagaaattattacattaggacatgtacagacagaggaatagtacaagagatgtgagactttcagaaagtacaggaaatgtgttgcaaataaaagatctcagtgccaatgcagggtgtttgtcctctgtatttttatgcattcctttccctctctaaataatctctgtgtgtgtgagccagtcatagtggtgcacattgcacttttcactggtgtcatatcgtttcatgcatcttgcactgattttatgtatgcaaagttggtgtttttgcatcattgcatgagctccttttgcatgctgatgcttgttgtataagcagatcactacagaagctttatatcctcttcctggatgtagcccacttcttcatttgcatcatgttctaatcttcagcacctccatttttgcttttgtttttcttgaagaaaccatagcacccaattctctttctgcacaaaacaaaagaatgggtttgttagatcattttctgaattagatatgttctagtagtccctagtgggaagatgatgattagaattgctattgctgaattaatagcacaataggtcatcaaaaggacataaagcatttgtgcaatgattaggattcaggtgacaagaagccggccttaattaagcttttggaaaaggaaacaaaaccacttgggagaagaaaaaaagaaataaaaggaaagtagccaacatgaagaaagatcctacaaataatttgtctgatcataaattggatgtatgaatgattggagtccatgtggcatccaactgtggccaaatctattcaagaccctacaaatatgtcatactagtctgaaatagtctatctgatgacctatttttaaggataactagtgcaacccacaatattgattactaatgtgatgctaaaaacaaaaaattacaaacaacaagttgaacatatatactccttaaacaagcgcaaccattgacaaacaacggccatatatagaattttctgaaactgagaaaccaaacattgtctgaaactcatcacaaattcagaagccaaactaggagtgaacaaaagactatgtcaagtcatgccccatttgccaagaagactttataggtagaatagattgactgctaattaagttagattgtgatgaaacaagatggacttgaagctatgactctcactagccgtgttgaccaatctgcctccaaacttgatggcttcacactaacttactcaacggggcagtgtaaattgttgggttgtttttagcagcctaagctgaacaattttttcacacttgacgtatttgctgacagagctatactttgatccagtctattaccatctccagactttgaattttgtatgtggttatgtgtgagctcttgacctcagatttttggaatttttcaaaaagttatcttctagaactacttatttgtctcattcatctgttggaaaaatgggttcttgggatggaactgctagctggcaggaaaacgtttaatggcagaaaatcttcagcatatggtggaaatacattcatattattattgttgtttttcatttaatgttgaattcacctttcttatttgtgagggaaaactctataaaaatggagattaaagtgtactgactgctatgtgcgagctattgacaaacagtaggattttcaaaaaggttaacttctagaacaactgttttctccttcatttttggggaaaacaagttttctcaggatacaaaactactaattggctggaaaaaaataatggtggaaaatcttcagcacataatagaaataattcctatattatttattgtttagtatcaaaataacttttcttatttgtgagggaaaactctacaaaaatggagattaaagtgtggtcattgtttcttaattttcaatattttaaattgcgattctgatctcaagcgattcacaaagaacccaacacaatctaacagaatcaagaagagcataattttttccccaaactacaactaaataagttccatcaacctaagttagcaaactctgttctccaacttttttaaaaacaaacagattttgaaataagacaccattcctaaaacccaaccaaactcccattcgagaataataaaaaagagatatgcaaaaaaaaaaagatccaatgaaactaaactttacatctagaaactgaaataatgcacaattagcaagtctaaaataatttacctgctcctgctcctggttgtttgagccttcgggttgccgccgccatggccatttccgatgctgctgctgctgctgcttccatggccgccgctgctagtgctgttggtgctgctcgtcctgctgctggtgccggcctcgctgaactcgccgcccttgctccaccactcctcctcctgcagctgcgcctcctgcttcttcttcttcttccccttcgtcttgttcttcttgccgccggcggcggcg

SEQ ID NO: 76303 - DNA, 4776 bp, Oryza sativa
ccttccctcgccgccatcgggttccccagcgggctccgcatcctaaccctctcgaactcccctcctcccccacccaccgccgacgccgacgacccctggaagttgaactccagccgccgctgccccgacggcggcatcggcatcatcccgacgccgagagagagagagagaggttggaagagagatggagagggagaggaaggtgtaataatggcgatgtggaggaggaggcgaggaggcggagggggagaagaagaggagagaagaggagaggagggaaagcgatggcgggtgggtgcaagcaagcaaggtcgttggtgagagatttaaaagcgggatttaaatttggagggagtacattacatacaaagctttaaataataataattaaattataaacaaactacactgtactttgtgtatatacggcgtggcgccgaactgtacatcacagcaaagctgctgtacatctccgtcaggtccataccgtggattcgtggagccattgggttcggaatcatctatcataatatcattatcgttacgtgatcttaactttatattatcccgcacgacagtgtttataaaagtagtgtcattatggtagataatgtgaacccgatggactaatggtagtatcttcacctcccgcacgtaaaacgaagggatctattatggtattactaattaagtattagttaaaataaactttaaaaatagattaatatgttttgttaaaacaactttcctatgtaattcttttttaaaagactattgtttagtatgtttggaaaacgtgcgcgtgaaaaacgaaggagtataggttgggagttgtgagtgacaaactcagcctaaaatcttcataaacccgagacaatggctactgttcacacctctcgtattaatatgtaagatgtgtgcagtggtgaaatggtgatgtgttcgctaccatgtgtgatcacgtctgagtcggatgacgcataattcgtgatatattaaaattttgttattatgttaatagatggcggtgtaagtgattggtaattaatgcgagtgattaaaataaaccaagggtacatgacatgagtgttgaaatgtttgctagcttgattgttgcaatggcgtttaatcggtgttgtaggatccaggggggtgaatggttggtatacccaaaaaccgaaaacttttagtggaaataaaagttaccctcgaaatcgacggaagtcggtctgaccgagattgatctgccggtctgaccgaagcgtagccgccggtctgactggtgttgatcttccggttggaccgccctggaatccctgctgcgcctgttgtcgtccccggtctgaccgaaggtcacccgccggtttgaccgccgccttgccgccggtctgaccgccgatgtgtcgccggttagaccgccgaaacccggtgaaacataaattgaagaattctaaaagtagatgacgactttattgattctctctgtatttacgaagtgcacaaacagcactccttacagaaatttcgactaaactcaaaaccctaactcaaaactcaactcaattgctttcaaaagcgataccgggaagcctcatgctccccctctatttatacccgaggcaggcaggaaccaaactcatactaggagtcctaaacaccttagaaaaccctttagtacaagaaagaaactttacataaccaatcgtaccaaatttggactccttccaaattcgactccgcatcccatacacacacaatacctccatcgtatgccatatggaatctccatcaaccacgtgcatcaactctagcctaagtatcccgcataatctctgaccaccacggacgtcgtcttatccccaagccgactcccggtccatcaccgcaaatactctcccgagacatcgagtcacctacacatgaaataaataaagaaaccatattccgagaccaagctatctccaacttgactcattagtagcaaacaacagtattacatacgtatagtatccatctagaagccataatcatgaaataatcacggatatccaaacaaacaacccgaaagcgaaactgacacagtgtcggccggtcagaccgcgggctggccggtccaaccgctcgattaccgccggtctgaccggcatacacagcccggtctgatcggtcacatgaaataatgaatcctgcgatcacctgtgaatccaatcatctccaaaccacttcatgaataaattccaaataacaaaaccaataatctccaatgcccaattattcatcacagaataataataaaaaacacctttgattttacaagtgtgagtgctttactttgttgtaacaggaatgctaaaaaaataggatcctgtttctcctaacccctcaagctggggtctggggaggcatgtgctaccgccggtaggtccggccgatgagccactaggcaccattggtgtagcctcctacttatcctcatctttacctcaactcaacttcggttgccatgggccacctcctttatgttctctcacgtcgctagtagtggtttgtgtgtgcccacacgagacacgaccataggtctaccaggtgtaccactgcctccatcgttgtacgataataccacataccccgcgttgatgttacatggttgtccgatgataagtaagatctatatggtggaactaactaaaccttcacaaactcaagacagtggccacggttcacacataacaaaaatatgtgagatatgtgcggtggtgaaccggtaacgtgttcgttaccacatgttaaaacgtctgagtcggacgaggtgtgttttatgtagaactcataataagaaattttcttattatgtattctacatgtcagctgtacggttcttttttcatttgccacgtgttaatgtaattctatgaactagttagtacgtggcaaataggtggcggttttggtgattgataattaatgcgagtgattaagaaaacctaagggtacacttggatttattgagtgttgaaatgtttgcttgcttgttggtggttaatcatcagtgtgagtgctttactttgttttaaacgtgatagtataaaattgtgccattttcatgacagaggaactgttcctatccattatatttcgtgcagcccctaattgttgtgatactttagttcattctgaaatgtgatacccatgctatataaatatggcattttcatgacgctgaaactgtactgatcgatcgattgtgttcagcccctaattgacacagcatgcaattaacagctcgatgaaagcgattcagtgtttataatttgcagcatagttcagtagccatccagatgtctggcacgtgcttagaccgatggagaaaaaactgacatgatggttgctacatgtcttgagctgttacatctcacaaccactaaataatccgtggttaatcaaaatactactgctgcctttgttccataatatatatcactgtcaaacatgacacgatgtctaaaactaccttttaacttttagtttcttacacacactataagatgtagcaacaaaaatcataacgatagaaaaagtaaattcaaatatcaattgaacaatattatttcttaaaaaataaaatttaatttgtattagactaattttcagtcgaatatttaatgagttaaatctttataaatctgtgacagagagagtagcactcgtacctatctcagattaagcaagacatcaactaaattattataatctgtaacttgtagtattagatctctcttaagtttatagaatataatctcaaggattacgagactaatattttggatgattagaatagaattttagtggcacagtaatcagtcaattttcttgttcctttttgtctgtcactgcatgcacaaattgcacatataaatgaacagtatgagagagataggagactttgcaggggggtcaggaagtcatgggtttctagatgttggtgataatttgcaggtggttgaggagccactggggactctagaatgaaatgacttttgaaaaacgggtacaaatattttcccgtgggggacgacaaggcttctctttcgatgggattctaccttttctttggtttcaattcacagcgattgtagtgcttttttttatgtaaaagaggaaagaaaggttttattatttatgcggacgagatgtctttatatgttttctcactgactagcggaccgatgcaaatctatgttgaatttttaggtcaatgttttcgttttcggaggatcgatgttgggtgaattataagattttttataaagaattatgtcggtaaagctgttgatgcatgcttggagtagaacttgttaatcagctgtctgattgtaatttgcattcctcagctccttttcttagttttgtcttctcaacactcaattcaccatctagaacaatcatgcgcacgcatggttgcggtacattaatataagttgaaaattaatactagttcaattttgttcagaaaaaaaggatagaagaaatgttgcttcaattactatgacgatatcaatctgccacagaagacagaatctacacgtcgttttcagatatggttaaactattccacagcacaaaactttgaaatattcagatacaagtacaattaaaacaactgaatatatatatatcttgagtgtctcattttcaatgaacaaatcgtcagatattcattattagatacagatacaggtcttcagaagatatcaaaagcgaaatattatattatgg

SEQ ID NO: 76304 - DNA, 14125 bp, Oryza sativa
ttagttgttacagttcttaaaaatgatatttttgtctagaacatgtaacagttttcctgttgcaaaaaacagatagaaaacttgcaaataccaagttgtgttttcattaaaaaaacaagttcggtgattgggagtagagaagaaaaccaaagcttaaaatgtgaatgtaattgcagagaatgaaattgtagtgtaagcattgaaactgcaagcaaaacactaattaactcgagtgttacctgtgttctaattccattactaattgtatccccttcactgaccaaaactcatagtcaaccttgagcaggatgagctgctacagacccatggaagatgtgctgcaatatgaaggaccatcataagcaaggtagagctacttgttttttcttcaatttagtgagtcctacttataagtgtttaggaaatactgcctcccacaccatgtaaataaatttaaggaaaaaaggaggcaggacaagatgaagcgtttataatgcaaactattgaaaatcacaattcgtggatatgtgccatcaaatttgcttggaaactctctctctctctgtggagattatggatatcccatatctacacggcgatgatatttgggctgaatataggataccgaatatagatagaatattttatgtgtatctcgggtttgtttctcaacttgtgcatcaaggaaataccctgggacttagtcggttacgactgtattttatctgtatctgcatattccgttagggatatagattatcttttgtaacacggactcctccccatatataaggggggtccgggtgcctctaggggcatatgttgattttcccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaatgggttccatctccggcatcgacgacctcgtcttcccacccgggcagacgtttcggttcggcagcctcgacttcgtcaccagcaacttcggcaagatctctctccttgactcggagtcggaccagtcgggagagaaccagatttcggccccgtttggactcccaaacgcggctgaaagttacttcaagaccatctcgaccgagtcggcttcaaaccactcgggcgagatcgcaccttcaccaacgtcaccagatcaagatgatggggcttacccaccgatcctgatgaagctccccgacgatttgacggccgtctccatcacgacagcgtctctttcccgtaggcctaggcggaagtcggcttcaataccgatttcgcctagcttcagggaagttggcgtcatcctccaaccactcggcacggtttagacggatcagctagatggcgactacagctctcccaccgtcgactcgcgccccaccgacatcgtggagtacgacgagtttagctctcgctaccacgacccggatctcgacgacttcgacggaagcctagatgacaactacacccctctctactttggcgtcttcatggccaataacgagacggaggagcaacgccaagcccgggagaccgaagcgcgtcgcgagactgagcgccgccgactggaagaggagcatcaagcacaagaacaagaacggttacggcatgagcagcaggagcgtgagcggaccgcgaaggaggctgaggatcgacggcagcgagctttggaagcagggcgccgggcgcgtgatctcatcggccagcaagatgttgaagggacgccggtttttcgcacccctcaacagaatgcggttgccgcgatcaccctcctcgacaccctactcagggaaaacgagctcaatcaatccgatcacgtcgtcaacatcttgaaccagacgaagactatgattgcggcttcggtcccagttaactccgaaagcgtccatacgccgactggcagccgagtcccccacttccgatctcatgactaccgtcatccaagcctcagcatcaccggcgcaggatccaatcgcaggagcaggggccacgacgagcggtctgttcactcacctcccgatccccatagggagcgccgagtggaacggcctcgctcaccacctcgtcgccgccccgtcgatcttcgcgacacaatcatacagcgccgagcagctcgaggctatcatcactcgccggaccgccacgacgacgaccttgacggagtagcagccttcaccgacgacctgcgtcgagtggattggccagccggcttcaagccgactggaatagagaagtatgatggtaccactaacccagaatcgtggcttaccgtctacggtctcgcaatccgcgcagcaggaggagacagcaaggccatggcgaactatttaccagtggctttagcggattccgcccgatcttggctccatggattgccccgtggtacaatcggatcttgggccgagttacgtgaccacttcatcgccaactttcaaggcaccttcgagcgtcccggcacacaatacgacctctacaacgtcattcagaagtccggagaatcccttcgagattacatccggcgattttctgaacagcgtaacaagatctccgacatcaccgacgacgtcatcatcgccgcattcaccaaagggattcgccacgaagaattggttggcaaattcgggcgtaagcctcccaggacagtcaagctcatgtttgaaaaagccaacgagtacgccaaagctgaagacgccgtcaccgcgtcaaagcagtcgggtcccagttggaagccaaaaaaggatacgccggcttcgggaggaggtggaagtaacaatcataaggaccgcaagcgtaagcctgcggaacttgttgcaaccgccagtcactcttctcgacagcattcgcgcgtcaacacgtttgacaagatcatgaactcccaatgcccgcaccatcctaactccaaccacgtggccaaagattgtttcgtctacaagcagttcgcggatcaatacaccaagactacacggaagaactccgatgaagaacaaagcacgtcgaggaagaaggacgacggcgacaccccggcaggttttcaagaccaccgcaaggagctcaaccatatcttcggcggccccctggcttatgagtctaaacggaagcaaaagttgaccgaacgggagatcaatgccgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatccttttcgccaagaccttggatgatatgcagattcctcgctccgagttaaaaccaagcaatgcgccttttcacggcgtaattccaggattatccgcaactccactcggccagatcaccctcccggtcacttttggcactcgggaaaactttcgcacagagaatatcagctttgaagtcgccgatttcgagacagcataccatgccatactcggacgcccggcattagccaagttcatggccgtcccgcactacacttacatgatgatgaagatgcctggtccccgaggagtcctatccctacggagtgacatcaagcaagctgtcacatgcgacaaggagagttgcgacatggcccaaacccgcgagatggcgtctgcccgagaggatatccgactggctgcagccacggcgagcgaaggagaaatacctgctaccaagacttctaaaagtggagaaagcgaagctaagactaagaagattcccctagatccctctgatcctgctaaaactgctgtaataggcgccgagttagattgtaaataggaaagtgcgctcatcacctttcttcagaacaataaagatatctttgcgtggaaaccatctgatatgcccggtattcctagagaggtgattgagcactcattacatgtcaaagaagacgccaagcctatcaaacaacgactccgccgattcgcacaagacaggaaggacgcgatcaaggaggaattaaccaagctgttagcagcaggcttcattaaagaagtccttcatcccgactggctagcaaacccagttctagttcggaagaaaacagggcaatggcgcatgtgtgttgattacactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgcccttcggggcatactgctacgtcaccatgccatttggactgaaaaacgcaggagcaacttatcaacgtatgatccagagatgcttctcaacgcagattggccgtaacgttgaagcttatgtggatgatgtagtcgtcaagaccaagcaaaaggatgatttgatctcggatctggaagaaaccttcgcgagcatccgtgctttcaggatgaaattaaaccctgaaaagtgcacattcggagtaccgtcagggaagctgcttggttttatggtgtctcatagaggcatccaagccaacccggagaaagttactgctatcctcaacatgaaaccgccaagtacccagaaagatgttcagaagctgactggatgcatggcggcgctcagccgatttgtttcaagacttggcgaacgggggatgcccttctttaagctactaaagaaaacagatgatttccagtggggacctgaagcacagaaggccttcgaagatttcaagaaactcctcaccgagccaccggtcctagcctcaccacacctgcaggagccgttgttgctgtatgtatcagccacctcccaggttgtgagcactgtcttggtcgttgagcgtgaggaagaaggccatgtccagaaagtccagcgaccgatttattttgtcagcgaggtcctagccgactccaaaacgaggtaccctcaggttcagaagctgttatatggtattttaatcactaccaggaagctatctcactactttcaaggtcacccggtaacggtggtcacatcatttccactcggtgatatactgcacaaccgcgaagcaaacggacggattgcaaagtgggctttggagttgatgtctttggacatatcattcaagccccgaatttcaatcaagtcccaagcgttagctgattttgtcgccgaatggaccgagtgccaagaggatacccccgcggagaagatggagcactggaccatgcattttgacgggtcaaaaagactttcgggcactggagcaggagtggttctaatttcaccaactggagaaagattaagctatgtactttggatacatttttcggcgtcccacaacgtcgccgagtatgaggccctccttcatgggctgcggattgcaatttccctagggataaagcgtctaatagttagaggcgattcacagctggtagtcaaccaggttatgaaagagtggtcctgccttgatgacaatatgatggcatatcgacaagaggtacgcaaattggaagacaagttcgatggactcgaactaagtcatgttcttcgacacaataatgaagccgccgacagacttgccaactttggatccaagcgcgaggtggcgccttccgatgttttcgtcgaacacctttatacgccgacggtacctcacaaagatactgctcaaattgcgggcactcatgacgtagctatgattgaagccgactggcgagagcccctcatacgatttttgacttctcaagaactccctcaagacaaagatgaagccgagcggatttcaaggcggagcaaactttatgttatgcatgaagctgagttatacaagaaaagcccttcaggagttctgcaacgttgcgtatctttagaggaagggagacaattgctgaaagacatacattctgggatatgcggaaaccatgctgctgcacgcaccattgtcggcaaagcttaccggcagggttttttttggcctactgcagtgtccgacgccgacaaaattgtgcgcacgtgcgaaggttgccaatttttcgccagacaaattcatttaccagctcaagagttgcaaactatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataatgctcgagacttcttcatcaacattgtgcatagatttggagtgcccaatcggatcatcactgataatggcacacaattcactggcggagtttttaaagacttttgtgaagactttggaattaagatttgctatgcctcggtggcacaccccatgagcaatggacaggtggagcgagccaatggcatgatacttcaagggattaaagcgcgtgtctttgaccggctaaaaccctatgccggcaaatgggtgcaacagctgccatcggtgctttggtctttgcgaactacacccagtcgggccacaggccagtcaccttttttccttgtctacggggcagaagcaatgttgccgagtgaagttgaattcgaatctttgcgctttcgaaatttccgtgaagaacgctacgaagaggaccgagtggatgacttgcaccgattggaagaagtccgtgaagcagctttgattcggtcggctcgatacttacaagggttgcggcgttatcataatcgcaatgttcgatcccgtgcctttttagtcggcgacctggttttgaggaaaattcaaactacacgggatcggcacaagttatctcctttatgggaggggccatttatcatctctgaagtcacccggccaggttcctatcgactcaagcgagaagatggtactctcgtcgacaactcttggaacattgaacatcttcgtcgtttctacgcttaagtttatcattgtacttccctatcttgactgtcaacatcaagttttcttcttgaagttgtcagtcgggggctattattataataatggagtgtgattttttatcaattcaatttgcttacttggtttatcattgccttgttcgatttttctacttagtctgcgaggactgaaagttttttatagcttctttgggttttaggctcaacaaagcttgataaaagcttttaagaaatcaaagatttggctagaactatcaagcacagcataaatacaccagtattgtacaaattgagcctccatttgttacattcatactcagtcagagtcagtcctttcatcatcagagttattgttgctcggctgaaggtcgttgttgcggaattgctctacaacgtcacttgcaatcttatcagccgcattttgagcattgctgataagatcaagagcagcctcttcgcttgtcccgtctgcaaatccatcaatggtgtcgatttcaattctcgggtacaaggatttggtcatcgccaatgccatgctagctcccatacttccagctttcttgatgttcttgaaatatacatccggtgcaactctcagcttgtcaaagatttcggttgcgtcaagtgcactcggaccactgttattgaggaacatagcttggacaagtggtgtagcgacattggcaacttcatctcttgctcctttaagcctcttgattttatcaaccaggacgtcaaactgagcttgagatttgattttacggtctacaaaacacatttacaataagaatctgctacattaaaaagaggaaagttcagattgtcagctggcagtaccttcaacctccttcaaggccgagtccctttctgcagctagttctgctttgtcttttctcaaagcttcaatttgcttctccatttgagccatcctggtggcttgcgctgtttgaaatccgaatgtttgaggatccagttatgacagcataaatgggacagatctagagattaccttttgatgaaccactcagctcgtagtttgaatcctggagctgagcaattcgttcccttaattccttctccgttttcttggcatgctccttggcctcgtgtagctggctcctaacagcttcaagagttcccaaatgaggaaccagcttttctaaggttgtggtcttggcctcattgcgaagatggattctctgcacggtggttcatggattagttttgctaacgagaaaacaaagtcatcaaaggcagtcacctagaagacttacattcacaatgcgagtagcttctccaagtactttcttcagctggcacacttcctcatcttctttttggcgatttatgacaatgccggaaacttgagagttctcgtcccaccatttgagtaagataggaggacgagagtcatcagctgcctttatgcggagaatttcttcttcgtcgccgcctagtggacctgatgtattcccaagacattagacgagtaagctggagttattcagaacggcatcacttgagaagatgagttacctgaggatgtgcctagctgagcgtgaggtgatccctgctctttatccggagacccaatcactgagtcattaccagcctctggtccttgagaagttgtcgcctgcgcttcagcttcaggaatctcttgatttagacctacatccgactggtttccagtcgggggctcttgggttgttgcagtttcagtagctgccgactggtttccagtcggcggctggtcactcggattggccttgtcatccgaagcatgggcaccagtcggctgactttcggcagtcggctggctttcggcagtcggctcagcatctttggataaatttgactctgtggcagccggatcaggatcttttccagttggatctatatcggacggtttcctgcaaagtgtcctttcaatattcagcgtaatttctatgagagaagcatgccggaataaaatggtaccgagaggtttatacctggaagatgttctgatctttggcatttgacggccagccagttttttcctaggcatggtatgctttgggagtttattgggcgtgcccttgtccccagatttgttgctgtcatcgacttcgtcgtcattaagcaccagctttctcttgcgagaacctgtctgcccagccggtttggaggtttgaggttgcgggtctgacctgattgtcggccctccacttccctgaacggtgtgctggcgaggagatcggcgttgagcaattgggggatcagatttcatcaatacgtactcctgaatgagatgcttccacggttagctcactcaacatgaagataaaattatgttttggtcatgagttgaaggtttcagatacatacctgcggaggcggattgaatgcattatatggtacaactggcagctgatgtgagtagctgacgacaatagcatttgagaagattttatacattctctccttcatgattttaaagtccagagagtctgggtcttcacggtttggatcatgcttgccgtcaaactcaaatgctgtgcgggatctctctttgattggagataatcgacacttaatgaaatgccgagtgatttgctctccctgtaagccttgctctttgagcttcagcatgcgttccatcagttctaaggcttgggcggcttcatctcccatgggaagagagttccaggtatcttggtatactgggggaagacaggagtactcaggaagagcgggctcgggattttgaatataaaaccagttggcgtgccatcctttgtttgaagtcttgaaaggcatagagaaatacttctggctcagagtgcccctcagttgaaatccagccccaccaactacgcatggtttgtttttgttcggttgaggcttaaggaaaaagattcggcggaacagagcaaaatgaggtctaatgcccaaaaaagcttcacagacatggacgaaatttgcaatatggactatggagttcggattcaaatgatgtacgctgattccatagaaattcagtatcccacggaagaactttgaggttggaagagcaaatccaccataaaagaaatgagagaagaccacgacctcgtgtgtatcgggggtcggaaaagcctcaccgcacgctggccgccacccgatgatctccttggcagggagaacgccgtgcgccaccatctccttcaggttctcctccgtcacgtcggacggcgcccattggccttcgaagctttctttctcttccgccatcgattttccccgaatgcgctgatttgattcgagggatggcttgggagaggtgaggaattgaggcggtggatcacgggaaggattttgatcactttttgaaggtggatttgagtggaatggtgaaccctagtttgccggcccagctctgtactgtagcaaggagtggggaaaatggcgagagttccggcggggaagacgaagcgtcgtttggatctcgggttttcttgttaagggtatcggaggtgcgaatgggcctaggcctgaacagtacctcagcccaatacttttaacagcgtggcccattgtgttccttagggacttaggcattctttgctttggcaatttatgtacacaatagtgttgcccaatgctgataaaatcctttttacgcggtcatataattctttggaattattgcgatgcaaattaaaaggtgcccgacagaaaggcgttatgctgtttttgtacgcttttttaggctacaaaagctgtctgggttaacttggaatgacttgtttttatcatagtcatttcctcggtatgttatatgcctgttttcattatggtaaatagtcatagcctaggctattagacttattcattaccatgatttttataatatttggtgggtaatctttagagtcttatattcggatgcctgtcaagtgtgttcattcgtgaactttttagagtgttaaccactcggatttcttttattatggctgaaaagcagtcggctggaatgcctctttaggcgccgcgtatgcttttgtcatatgatgcataattatgctattattttgttctcaactatatgtttagtttgttgactaatcacatagttgggggctatacctaattaggtgcatctattcgatgcaccatattctttatcttttcgccctttacagtcttcgtcttcactactcggcaggccttggcatgaaaagtttgaagcactcggattattatctttgagcaggctatgatggttgactgcaaaggtctcgggggctactgtggagattatggatatcccatatctacacggcgatgatatttgggctgaatataggataccgaatatagatagaatattttatgtgtatctcgggtttgtttctcaacttgtgcatcaaggaaataccctgggacttagtcggttacgactgtattttatctgtatctgcatattccgttagggatatagattatcttttgtaacacggactcctccccatatataaggggggtccgggtgcctctaggggcatatgttgatttttcccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacactctctctctgctagtctgattcatccttgttagtgtaagagcagttagtgagaatatgtatgctacccgtgcaagcacattgagatgacagtgttacttgcaagttgcaacaccatatgcgatgacagcaatggaagagtctctgagtgcaagcatagggggacaaagcttttatactctatgcagccctgatacaaaaacaaaatggggtgccattcttccaccatcaggatttgatcttacttgtcaacaagcaattatcccacagcgtgtacagatcgagagctagcaacaaaacctggagaaatattggggcaggttggggatggcaactagcagtgagtgcgggctctggtctccggatggagacacaacaacaccaaaatgaagcagaccaaggccagctttcagagtccagatgaacatatggcaacttgagatgaacgacgtgcggcagttggatggaggcggtggcggcgggggaagtggtggtagggggagcgggagagcgggtagagaagggagcggcggccgacggcggtgaaggaaccgtcgacacgggagggggttcacaagatttaaaagttttaattgttgtttatttttactgaaacatttgatcgtccgattcgtttggaggaattgggcgcttgatttggaatctcctctgcaactaagagatgctcctaactttacccatccacatcctactaacattgcaacctcatcatatctgcaacgtcagagccaaaacaattagtgatagaacatcacagccggcaattaaattttaaagtatacattatttttctctattttgtatatatacatgcatttacagaaatatacattttccgcggtacaggaacacggcaccgtgccatcagtgcagctcgaaggcacggaacggacaggaggggcggtgccgcgggaccgacgtggtcctgcagattggtcgcacggcaccacttgcggtgccggtggtgcggcaccggcatctaagcacgcatgagtttttaataccgttcaaaacattgtttatttagttattgtttaactctgtttactactgttcacagagctggttccgcgcaatggaaccgcaggactgcattggtgctgcgtttttgagccgcgggactgtcacagtttcacagtttcggcccgtaggaccatcgcggttccgctcgcccgttcagcgggaacggcctggctagcgctctcgtgttcctgtattcaacctgtgggatacgtatgtttgtgctatttcttctcgtgtaagtatgtaaacctaaattattaaaaaaatagatataatctcaaaaaaaattctcacagccgctgttcgtgttgacactatcgaatttttttcatttttaaatttatttttttaatatttacagaaatattatatcagcagaaagatttacaaaaatagaccctgtcgccctctatttgggcggcaagctgacgtggcacacatgcgcatgacggtcattttagggggctgtgaattttgcacgtggcccccttgccgcccagtggggcctccgtgcaaaattcgcaagggcagtaaggggcttagatgcaaaaagaactagccaattgcttttttgggagggcaaaaattacatttagccccttgccgcccttacagaggactgtagggggctaagcgcaaaatgcgcacacggtgccgtcacgacgccgtgtgccacgtcaacttgctgcccaaatggagggcggcaggatctatttttgtaaatctttccattgatataatatttctgtaaatattaaaaaaataaatttaaaaatgaaaaaaattctgatactacctgccaaaaagtgagaaaggccgaaagacgccgccgtaggactccccctcgcagagaaggaataagttcactttgggtccctctatttgtcggttagtctgattttcgtcccttgaccgcaaaaccgggtatgacccgtcccccaacttacgaaaatcaggcaaacaaggtccctcggcagtatgaagggcggttttggccgacgtggcgcctacgtggctcgtttgactaggtcttcgtcccacgtggcactgacgtggcgattacgtggcattgacgtggcgctttcgtggcaattttatccgaaaaaataataaaaatcgtgggacccatatgttagctaaaaaaaaaaggtggggcccatttggttccacctatcagcctccctcctttctctcttccccctatac
